United States Patent 7,745,391 (HUMAN THROMBOSPONDIN POLYPEPTIDE) - sequence listing, part 208

SEQ ID NO: 504714 - DNA, 1400 bp, Homo sapiens
  misc_feature (747)..(747): n is a, c, g, or t
actgatattctacagcttaacatgttatcttgacagatcaaaaagaagagtgttgtctagcactggcaagatcaacatgaatggcttacacacgtctaatgaacatcttgcataaagcatgtggaggatctagtatcccgcgagcactaaacaagaggccaaggtaacaacgaggtccagtatggatagagaaattccacaaatgaattacatgcccgcgatgaataacgttgtctacctttggtactaaggagtgcgcgatgacttgacgtgcgagcaagcataacgtaggcaatgaaatcttcacactcggtgcccgctgatgacggcacactagccatcaatagctttgcggaaaaagaatgctaggatgaacgccaaacataatgcaccttaggagagatcatcttctaggatggtggagcaatccaagaggatcgccattggaacgcgatagaaaactgcttgacgacatagatagaggcagcatcccggcggcacatggagactcttacgagaaatcgcgaatatgtaggactattcttttgctttgtcctaacgttagaacctgttagacaggggagtcccatactcaagtgctcgtagagcatagtaccccttttgcctcggggccaatgttctacgcttcaacattgacacagacaccgcattgtaatggctcaatggtatcatgtgggaacactcattgaggggactttgcaccaaagtattgacagcctgggaagncttcctaatgtaaagtggccatctaacgttggtcgtagtaacataccgtccaaggggaacttccacggcgtaaggcactatgagggaggggatatgcaaacatcgtgtaaagcaagaacaatcctgaatcaaggaggactctcacctataatcgttagcactttattgcacttcgaacagactttagggtgggaagacacctacaaggtttacatcacccagccccatagatggcggaacctccacaacgatacaagttgaaaagaggctgcccgaagtgatggctgcacgtggaaacacttattttgcacacggggttttgcccaatctacgacaacctgggtcgtaggcaacgcacaaaaggcttctaaagtcacataggcgtttatacggcgattatggaagacccaaaaggcgttattacaaccgcgggcatgacactttcgcagccgcaattggcgcaatagggacggcgatccaacccctggagattaatatggccccagagctacaaggccaaatgtcgagagtccctgataagcttagacgagaagaacggatacacttcgagaagagcaaaatgggacaatgtgagccccaccggtaacattagcaacccctgtagtaggatacgagacacaggagtgtgacaa

SEQ ID NO: 504715 - DNA, 100 bp, Homo sapiens
  misc_feature (58)..(58): n is a, c, g, or t
tttggtgtctggctatggacccccatctgactgtccagctctctctcccccacccctnccggtgttgttattaaacgtctgtggagcttctgctgcaagg

SEQ ID NO: 504716 - DNA, 431 bp, Homo sapiens
acggtatagagtctggggaaaaatgtagccatacttgctactcatgggtacacttaaactacgtctttacgtgtgtattgcgctatttgtagcttcatcacgtttgctgaagatggcggtatataggctgagcaagaggtggtgaggttgatcggcggttatcgattacagaacattatactctagagggatatgaagcaccgccaggtcctttgagttttaagctgtggctcatatcagttctggcgagcagttttgttgatttaactgttgaggtttagggctaagcctagtggggtatctaatcccagtttgggtcttagctatagtgtgttcagatatgttaaagccactttcgtagtctatttcgtgtccactgaagtcttttacaactcaggtgagtaaaagcaatataggggaggagtgctcta

SEQ ID NO: 504717 - DNA, 378 bp, Homo sapiens
  misc_feature (17)..(17): n is a, c, g, or t
  misc_feature (124)..(124): n is a, c, g, or t
  misc_feature (146)..(146): n is a, c, g, or t
  misc_feature (151)..(151): n is a, c, g, or t
  misc_feature (154)..(154): n is a, c, g, or t
  misc_feature (159)..(159): n is a, c, g, or t
  misc_feature (163)..(163): n is a, c, g, or t
  misc_feature (172)..(172): n is a, c, g, or t
  misc_feature (192)..(192): n is a, c, g, or t
  misc_feature (205)..(205): n is a, c, g, or t
  misc_feature (209)..(209): n is a, c, g, or t
  misc_feature (340)..(340): n is a, c, g, or t
aaacaaagcagaaatanaacagtcacagaaggtggtaaaggcagatattgtaaactacaaccagtgaacctatgtgcaagaactgttaacccttctagaagctctgtgtgtgcagtagggtganctcatttttacattgtattganagtantanaagcncttnacctctggntgtatctgaaaacttctaanaacttgtattatnagtnaccatctctgtagttcagttaacactttcctccgaacttgcttcatctttaagtgttcctcccaaccgcagcatgtacttgggttcaaaagaattcaactttggggccacacactttgcattcaaactggnagtctcattctctggaattagactgtttcattgaaaaa

SEQ ID NO: 504718 - DNA, 209 bp, Homo sapiens
tttttttccccccccccggggggggaaaggggccacccccccccgggggggggggtatttttcgcccttttttttcctttcaccaaaggaaaaggggggggggggggggggtttttttcttttaaaccggggaaaaaatttagggggcccccgggtccctttggggggggttggttaaaaaaatggggaaaaaagggccccctttttta

SEQ ID NO: 504719 - DNA, 477 bp, Homo sapiens
  misc_feature (228)..(228): n is a, c, g, or t
  misc_feature (243)..(243): n is a, c, g, or t
  misc_feature (366)..(366): n is a, c, g, or t
  misc_feature (410)..(410): n is a, c, g, or t
  misc_feature (412)..(412): n is a, c, g, or t
  misc_feature (419)..(419): n is a, c, g, or t
agtggagtcttccgcacccagcgcgtcgccctttcccgccaggtgaaggagaaacccttgtggccccaactctaaattagggttgccccctgatttccggtccttccatctcatcggtggcctctcactgtggctcactgtttaacacatgcctgtcccctgggcctcccccccagatgccctgggttggattcctaagccttgggagcggacagggctgccccctcnaaaggggccctcccnacgggcagaggggcctgggtcccgaggggacaaggagcctgggttgccccccccccgctgagggggttcctcttgccccctccccccgggggttgtatatagattataaatatataagggggnaaggggggggcgggggggggttggggggcgggggccccccttcncnttttctntttcctggtgccctgtgctttggcgggtttgttaaaaaagaggaataaaagggtttta

SEQ ID NO: 504720 - DNA, 288 bp, Homo sapiens
gcagtgcatatagtgataataactcactgcagccttgacttccaggctcaagcaatcctccaacctcagactttccagtagctggaactacagcgctatgccaccatgccctgctgatattttgcatttttatagagatggagactccccatgtttcccgggctggtctgtaactcctgagctcaagtgatccacccaatttggcctcccaaagtgctggcattacagcagtgagccaccacaggtgccacagttttatttttatttatatatttgggcgtacgggga

SEQ ID NO: 504721 - DNA, 446 bp, Homo sapiens
aaacagacatgaaataaagaattttatagaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaccttgtggcccccttggcccaagcggtttttaaattgggcaaggtttttccttgggcccgaatttggggctaattgggcaatttccccttttggggggcggtttaaaatttaatggcccgggttttaaaaaggtgggaatgggaaaaccctgggggttcccaaattaaaccgctttgaaaaaaatccccttttgccaagtgggggaaatagcaaaaggccccgaacggatggcctttccaaaaagtggcccaccctaaagggcaatggaaaattgaaggggtaaatttttggt

SEQ ID NO: 504722 - DNA, 590 bp, Homo sapiens
tggtctcagcccaggacctccagggaacaatgaggcctacgcagagctcatcgtccttgtgtatgccgccggcaaagcagccacctcaggtgttcccagacatttactgacccccagacacctaatgcccacactgtctcccgccaagacccaaaaccccacgcagactagtgaattcccatgggccctgactacaaacgggtaccctggaggatacctggagacgtagacaaggagtagcctcagctggctggccatggctccatactagttaccccccccagtgcctttcgcgcgacacggacacgcagtgtggcctctgacagtccgcagtggctaccggattcaggccagcagcacgacgactcatgcgggtcctgtcctacctggcgcaccgcgctggccaccttcgaaccattctcgagcatgagacgcgcacagaggaccgtgtggaacgggccaagacgatgacaatcacgtaccatcaaagacgacgaatggcgatctcgagacccacccggcggcctgcactaaccccgaatccaggcatgacgagctgacgcgcacacaccccccgcactcccacgccc

SEQ ID NO: 504723 - DNA, 836 bp, Homo sapiens
gcggagaagagcgggacagtgcagggccgctgaatcagcttccaagagatgatgccctacactcacgattcactcctattgaacaagacggggtactgatagctcccaaggtcatcctcccagcttgtgatgtacactatcggagtgccgtgccacgtgtattgctgagtgcgtgtcacatcaaattcatgcctgggatccccgatgggatggaaacacaggcttgattgtcaatatggtcgagcagtgccatatagcagacagattgtctgaaatgcatgtgggacccactaattcgggacatgcgttctgtgatggttgtgccatccgtgaccagccagataagacttttggtgaaaccattagtctagacatccctaaaggagagcctgaatgggtagcgcgtgcatcgcgaaccaaaccttcgtagttgacactttgcttgggctgcgtacgcatggttctcctcgtacaagccatgggttggacatacgccttcattgttggaagggaaaagggtataagatacgcgcccacagaaaatccattcgattccgatgccctatatacgcaggctaatagggctcgaaactccccaagccttggggccatgttttgagatcccactggattccgcaacattgaaaggactccgccttggtgaaactcagtagtaggatcgacaggcgccacgaactacaaacctggtagagcactgccacagacgaggaaaagacctaagctaggggaaacacaacgtggtgacccacttgaacccgccttcctggagagctcccgaaaaggcatgaagtcattccccagcgcagaacaaagct

SEQ ID NO: 504724 - DNA, 732 bp, Homo sapiens
  misc_feature (3)..(3): n is a, c, g, or t
  misc_feature (555)..(555): n is a, c, g, or t
gtnctctctgctctcgcggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaaaaaaaaaaaaaaaaaaaaaaaaaaaaaaaaaaaaaaaanaaaaaaaaaaagaaaaaagaaaaaaaaaaaaaaaaaaaaaaaaaaaaaaaatttggggcccctttggccaaaggatttttaaatttggaaaagtttttacttggggcccaaattggggccctttgggcaaattccccctaagggggggggtttaatttggctttggccccttttggc

SEQ ID NO: 504725 - DNA, 465 bp, Homo sapiens
  misc_feature (3)..(3): n is a, c, g, or t
gtnctctctgctctcgcggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaatacc

SEQ ID NO: 504726 - DNA, 214 bp, Homo sapiens
taagagaagcgtgcaagctcaacagccactacctaaaaaatcccagaacatagtacatgaactcctcacacccaaggtggaccatatctatcaccgctatagatagaactaactgttagttataaggtaacatgcaaaacattctcctccggcataagccttgcgtcagagttaaaacatctgaacttgacaatttaacaggcgccaagtatct

SEQ ID NO: 504727 - DNA, 878 bp, Homo sapiens
cggttctactgttcgcctctcctgtatttcgcgggttgttcgtctccggttatccccgcgcgggtgttctctctgcgcctgggcgcctcccctgtggtggtcctacaccgcttcgtcaaaccatggtccactgggtccagatggggagaacccaagtcttggtggtttgaccccccttttcccccgtggccgcatcgtttctctccccgcgtcccccctggatgtgtctcccgccccctgactttgcatcgccgcaccccgttcgtaatgtcctccttcgttcccccctggtgaatgtgccgcccccccccccgcgttctccttgtaccccctcagaattatgtccccttacttcacacattcctcccccacccaacaagccccattttttcagaacaatttctaattggggcgcaccccctaatacaacaatggtagccctcactcgcgtggatcaccccgatcccccgcggataactgctatccgcgcctattctaaaaattaacaatccttttatgggtcatatatccatctaaccttctatctgcgtagaggggaaggcatttctaccaccccggttagttctatgcggcgtggaaatcacctcaccgggctcggaattgtcgcacacttcttccccccgcgagtatgtggtcgagatggcaggcccgcgcgatgtagtatagagtgagaaatgagactgcggcctctccccgcatattcacaacaccccccaacaaccccgccctattcattctagggcccccaggaaaactcgcactaatcagtcgtgttgaccagttcattttttttttgtaaaccccaaaatacttccccccacccatttaaaaacattatccccctgtcccacaaaaca

SEQ ID NO: 504728 - DNA, 388 bp, Homo sapiens
cctggccttgttggtcaaagggtttttcccccgggacattcccctggggttggggggccccgggcccccgggggacaaatacaaccccccgccttccatttttggatccggcgggtccttttttctttaccgcaagctccccgttggccagggccggtggcccccgggggacattttttctttgtccgtggtgcatgggggttttcccaaccgctttacgccggagggccttttcctttttccgggtaaatgggttggacggccggcaaacccccccttcccgggtttttggggttgcgggggggttttttgcacgttccccgtttacatattttccgggccccccgcttgggaattaagccccccgggtttccctgggcccctgcca

SEQ ID NO: 504729 - DNA, 514 bp, Homo sapiens
  misc_feature (3)..(3): n is a, c, g, or t
gtnctctctgctctcgcggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttg

SEQ ID NO: 504730 - DNA, 398 bp, Homo sapiens
  misc_feature (1)..(1): n is a, c, g, or t
  misc_feature (21)..(21): n is a, c, g, or t
  misc_feature (117)..(117): n is a, c, g, or t
  misc_feature (207)..(207): n is a, c, g, or t
natgggggccaattcccaagnagccttcgtgaagccacctgcttgaagctcttggggagataaaccttctcctacatcaaaatctggagagaggcaagcatgcctacagtttggganacggtttgtttgggtcctgcccaggtttcatgttgaaatttgaccccctgtgtgtttcccaggagagctggttgttgaaaagaccctggnacctccccccgctctctcttgcttcctttctgcccatgtggtctctccacacacaatgtcttcccttcactttctgtcatgactggaagcagcgtgacgtcctcaccacaagcaggtccaaacaccacgcttcctggacaacctggagaaccactatgagccgaataaataatctcttttttttttaaaaa

SEQ ID NO: 504731 - DNA, 459 bp, Homo sapiens
accagaacgcggtagtcggcgtgcctgggatgtgctcgtgcgcctcgcatttgatcatcatctgtgtctcctcctcgttgtcctttatctagtacgacttgctgttgagccggttggccacgttcttcagcaggatctcctcgtaggtggtccttgatctcatgaacccccatcattagcatgttgttgcctgctatgctgatgtctactgttaatctgctcttctgtactatgtaggtcttgttcaggcccaggtccttgttgatcagcttgatggcgttagcaagcacattactggtgtccccatgctgaggagcagaggtggccttgttcagagagtctatagaacattgatgatgtctcttggaggctttgttatctgacgagacggctgctctgtgattttgagcttgaaggcgtgtgccccaatgttgtaggggcctgcgtacttgattgtag

SEQ ID NO: 504732 - DNA, 543 bp, Homo sapiens
ggtcagaaacacaaccaagacgcgaggatcctgaactgtttttcgagactccctggcagctgccatgagcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttg

SEQ ID NO: 504733 - DNA, 581 bp, Homo sapiens
  misc_feature (3)..(3): n is a, c, g, or t
gtnctctctgctctcgcggccgactcgcaagatggcgccgcagaaagacaggaagcccaagaggtcaacctggaggtttaatttggaccttactcatccagtagaagatggaatttttgattctggaaattttggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttg

SEQ ID NO: 504734 - DNA, 230 bp, Homo sapiens
aattaactattatcccccattcggaggccaccgtttatatctaccactgctccagtcatatacgtgttgagagcaacagctaaaacaatttgtgctacctcagatggatgtccaaatcgcttcaaaggaatttttttataaggcatactctttcattttttgggataattgattggtcatggcgctaacaatcatgcctgggcataattgcattcacctctaattccatg

SEQ ID NO: 504735 - DNA, 226 bp, Homo sapiens
agctgggatataggccctgctaccactcccagctattttttgtatttttagtagagatggggtttcaccatctatggacaggctagttttgaactcctgacctcgggtgatccagtctacctcagcctgccaaagtgctagggtgctaggactacaggcatgagccactgtgcctggacttttttttttttttaaagacagggttctcactatttcgtcgggaatc

SEQ ID NO: 504736 - DNA, 115 bp, Homo sapiens
tcacgttgatcgggagatctataggtgcggggctagtatgattatggcgttgattagtactagtcactggttgaacattgtcagtgggtcgtccaagcgatatgggtagcgagct

SEQ ID NO: 504737 - DNA, 532 bp, Homo sapiens
  misc_feature (3)..(3): n is a, c, g, or t
gtnctctctgctctcgcggccgactcgcaagatggcgccgcagaaagacaggaagcccaagaggtcaacctggaggtttaatttggaccttactcatccagtagaagatggaatttttgattctggaaattttggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaatacc

SEQ ID NO: 504738 - DNA, 404 bp, Homo sapiens
atatattgtgaatggaaggatgaaatattttggaggaagctaggtacagaaaagatgaatatgatgatgtatatttttcgtatagtaaacctttacatagtaggaattgtatttcttaatgaaatttatgtttttattttaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttg

SEQ ID NO: 504739 - DNA, 1378 bp, Homo sapiens
  misc_feature (3)..(3): n is a, c, g, or t
  misc_feature (816)..(817): n is a, c, g, or t
  misc_feature (1209)..(1209): n is a, c, g, or t
  misc_feature (1231)..(1231): n is a, c, g, or t
  misc_feature (1348)..(1348): n is a, c, g, or t
gtnctctctgctctcgcggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaacttttgtctcatttttttgagtatgctgtttatatgattttgatttccctctgataactatcaacagtatttaaatagcttatagctggtataattttttcccacgatttccaaaatcttttatgtactcaggtaaaagtagcgttatataggaaatcttttttttagacactctcgttctgtcacccaggctggagtgcagtgactcagcttcctaaatagctggaattacaggtgtgagccaccatgcccggctaattttttgtacttttagtagagtagggtttggccatgttggcnnggctggtttcaaactcctgacctcaagtgatctacccacctcggcttcccaaagtgctgattatagctgtgaaccaccatgcccggccaggaaatcttactgtagaacaattttttatatagctgtataaaatgtatatgattgtcttgacagtctcaaatactgtttttaatagcttgtaaatgtaatctcaagtgcttagaacagttcttacatataagttgctctgtagtttgctcttatagttagcccaaagactctgggtgtgaggcctgctgtaaaccaatgttaaactgcttattagaaagccctaaccacctgctttgtaggcaccagaaactcaaaaccaaatctcaactcagctacagaatctactgtggtccttgtctganaaaattagttcactcggttggnatcttgtctcagagcatcctcatctctttctcaaaagccctaaccccaacaccggcgtgttggttgtctattgaaacttaacaagtggattgggtcgcttttctcccgaataaatgngctttgaaaaggtctaaaaagaaaaaaaaa

SEQ ID NO: 504740 - DNA, 773 bp, Homo sapiens
  misc_feature (3)..(3): n is a, c, g, or t
  misc_feature (596)..(596): n is a, c, g, or t
gtnctctctgctctcgcggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaagaaaaaagaaaaaaaaaaaaaaaaaaaaaaaaaaaaaaaatttggggcccctttggccaaaggatttttaaatttggaaaagtttttacttggggcccaaattggggccctttgggcaaattccccctaagggggggggtttaatttggctttggccccttttggc

SEQ ID NO: 504741 - DNA, 799 bp, Homo sapiens
  misc_feature (3)..(3): n is a, c, g, or t
  misc_feature (622)..(622): n is a, c, g, or t
gtnctctctgctctcgcggccgactcgcaagatggcgccgcagaaagacaggaagcccaagaggtcaacctggaggtttaatttggaccttactcatccagtagaagatggaatttttgattctggaaattttggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaaaaaaaaaaaaaaaaaaaaaaaaaaaaaaaaaaaaaaaanaaaaaaaaaaagaaaaaagaaaaaaaaaaaaaaaaaaaaaaaaaaaaaaaatttggggcccctttggccaaaggatttttaaatttggaaaagtttttacttggggcccaaattggggccctttgggcaaattccccctaagggggggggtttaatttggctttggccccttttggc

SEQ ID NO: 504742 - DNA, 1510 bp, Homo sapiens
gggaaatataattcactcttgtacaattgacccattgaaagtgtacagttcgggctgggcgcgggggcttagcctggaatctcggcctcccaaagtgctgggattacaggtgtgagcccccgtgcccggcctattgtttatttttgtgtgtgtgtatttctgctgtttaacattctgtttttgtttcagattttaaaaatagctttattgaaatataattcacttttggacgagccactatgcccggccctccagatgcatttttaacagctgaattcatgtgtgaaatgacgtaaggtccgcgtagtccttctttctcagagaccagcgtgcgaggcccaagggacccaccttccgtcacccgttctgctttgtttacagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 504743 - DNA, 111 bp, Homo sapiens
aggcggccgccctgcgtcaccagcacatatgaaaatacctattttctacactccgtcatctctggataacattaatttaaaaatgtttccgtctgatgggacgaagatgcg

SEQ ID NO: 504744 - DNA, 2533 bp, Homo sapiens
  misc_feature (318)..(318): n is a, c, g, or t
  misc_feature (2349)..(2349): n is a, c, g, or t
  misc_feature (2359)..(2359): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcanaggaatgtcnggtcctcacaattcaaaacaattgaagatgacttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 504745 - DNA, 225 bp, Homo sapiens
tttgctgcctgctgagtatttcgggcctcaccctcagacctaagcggtgtctttaaagctcctataggcagaatacttagacaggctgaggaacgctgtgcagaaaatgcgcagtgtagtaagccacggatgagtgtgcacgtgcacatagcgctccaacacataccaacacatctcatagtcgaatggatagcgaaacttatgggagacctacagaggtataaa

SEQ ID NO: 504746 - DNA, 2368 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagaatgttgcccaaaccacccctttgggtttgggggggccaggccaaaggaaaaggcctgggggaattcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 504747 - DNA, 1645 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaacaaag

SEQ ID NO: 504748 - DNA, 330 bp, Homo sapiens
taacagatgtataaattaaagtaacaacacttaaattgccgatacaaggaagatattttctaaatacaagtgtataaatgtacaaatatgtgaagcgaaaggagaaaatactcatgacaattatggtcctcatttctgcaacgggccacatggtggtagctgggtatcggatggaccttcttctactaacaaccaattctggtattccctttggccttcagcaaagcacctcgagcaggtcatgggtttttttggcctgggtgggacgagacctcaaacctctcattcctggaaggagtctggggcccatttggtaggtctgggcctggg

SEQ ID NO: 504749 - DNA, 1578 bp, Homo sapiens
  misc_feature (318)..(318): n is a, c, g, or t
taggagaaaggcacagcgcctggagggcgggagtggggcttgctgcagacggctgtctcctgcctccttggctcttgcactgccaggaacacgctctccccaacacctccatggctcattccccaaattcaagcttgtagttggttgaattgtggccccagagatgggattaaggattttgagattatgccagattatctgcgcgggcccaggatcatatgagtttgtctcttctcccgtattagttttgtccgcgctcggccgccgtgcagtcggtcgttccacttccgccttcgcccacgtggtccggctccggcncacgcgagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaaggtgggtggtggccttctctgcccctcccccgctgctatgagcagcacgtggcccactttccagctcagtgttctggcttgttatgctgtttctgagcacataatgatgtacaaatcaaactagcctacgccttatgtaggtgagacgtccaggagcctggtcggctcaggtatagctggatctagatgctccctgccagtgggactctgtgttctctctggtctttgctttctcttgtgttgattctgttctcagggacacacattcttgcaggtggcacagtggcggccgcaatgtctgctttcgaacctccaatcaggctcactctgaggcagatgtacttgtgtggctgccaagggccagagagcca

SEQ ID NO: 504750 - DNA, 762 bp, Homo sapiens
  misc_feature (490)..(490): n is a, c, g, or t
ggaagagctgcgagcggcgcgtcggtgtcgggcgaactcggcgcggcacatgagcctcgtgtgaggctgatgcaactttccctttaatgaaagccacctggtgcgcaccgctggtgctggacccagcacgcctgtggccgtggggctgcagcatgctcttgagatctgtggctcttgaaatggcgctggagagctatgagccttgatgagtgttggtccccagatctagcctagtagccctcaacctcactcgcctgtccattggcttagtgaatcaggtgccgaaagggactgctggcgccttcatgttccccttacttcatcatgctcatcttctgcgggatccccctcttcttcatggagctctccttcggccaggtttgcaagccaggggtgcctgggggtctggaggatcagccccatgttcaaaggagtgggctatggtatgatggtgtgtccacctacatcggcatctactacaatgtggtcntctgcatcgccttctactacttcttctcgtccatgacgcacgtgctgccctgggcctactgcaataacccctggaacacgcatgactgcgccggtgtactggacgcctccaacctcaccaatggctctcggtcagccgtcttgcccagcaacctctcccagctgctcaatcacagcctccagaggaccagccccagcgaggagtactggaggctgtacgttgctgaagctgtcagatgacattgggaactttggggaggtgcggctgcccct

SEQ ID NO: 504751 - DNA, 567 bp, Homo sapiens
  misc_feature (209)..(209): n is a, c, g, or t
accaaaaaaaaaaaaaaaaaaaaaattatcctgattgggggggcccccaattgtattctgggcctccccaagttagctgggaacattaagggccagttgcaacaattgcctaagataaaattgactaggataatttataacgttaagacgtgtggggttaatccaccatgagatgggccaggctgtgattactgagaagctctctgtgnaccttcaacgtagactcccccccaacattacgcgaattactcaccagaaaagttagtctaggggcacattgtggcatatctatatataacgaccattgtgtcaacccacagacaagggaccaggggcaaatcacccacttcgtgatctctacatgtggaagataaaaaacttttatgaacagttgaataaccactctggagctactaagggagatgtgctaaatagggaacattcttcgtgagccgcgttttttagcactagttgttcgccggaacacctgtggatccaataatgctgatatcacgggacagaaacaatggggggaacacatgtgaaaacctcgcgtgcatactatag

SEQ ID NO: 504752 - DNA, 431 bp, Homo sapiens
tactgaaactggtaatatatcttaaactataggatttgcgagcaaatggctatatctgcagattaatgccatcactgtacactgtgaatgccatgacttgaagaattatcaggcaccccttcaggcgcaggaccaggtgcagggtcgaatctttctggatcttgtcctcgatagagtgcggtcttcttccatctgcttggttgcattgattagcgccccgctgctgtggggttatgccgttcttatgcggttttgtccttcgatttcctatgtgtctgtgctgtcccctcctgatgtgatggtcttgccggtcagggtctttacgaagatctggataccagctctcacacgcaggaccaggttgcagggtcgactccttctggatgttgtagtcagaaggagtgcggccatcttccagctgtttgcctgca

SEQ ID NO: 504753 - DNA, 351 bp, Homo sapiens
  misc_feature (317)..(317): n is a, c, g, or t
  misc_feature (344)..(344): n is a, c, g, or t
aattcggaacgagggtctcgcggttgtcacccgggctggagtgcagtggcgtgatctcggctcactgcaacttccacctcctgggttccagcagttctcctgcctcagcctcccaagtagctgagattacaggcgcctgccaccccacctgggctgatttttgtaattttagtagagacggggtttcaccatgttgggccagggctgattaactcctgacctcaggtgatccacctttctcggcctcccaaagtgctggggattacgggtgtgagccaccgtgcccggcctgcaaacacattttaatttgacaacantaggggtgtttgttacaaattagttantgattag

SEQ ID NO: 504754 - DNA, 539 bp, Homo sapiens
  misc_feature (297)..(298): n is a, c, g, or t
ccgcccagacctgaaattgatgaggaatctccggcccctttggagggtttcaaccgaacagcatccgggggtgcatttgtgggattcacagttcccagcctttccttgcctggcccataccccccaaggcaaattccaggccttgatgcccccggttatgagggtaagatttttttttcatgggccgcccccggggataatttttatggtgggaaaggtccccggtttttcctaagaataagggccaggatttttggttttaaaggccggtttggtgatgcttttccaggaaaaacnnctggtttggcccccaaggggggcccctcccagggaaggtttggcttttttccgcgaaaatttttccgaaggaaatgcccccccccttttttttgccctttaaaggatagataaaagccatttggcctccaaagggtccccccttggcccagggactttgtttttccccccagccaatcctggtggccttggtccctctccccctccccctccccctcctgattaaagttataattttggga

SEQ ID NO: 504755 - DNA, 155 bp, Homo sapiens
gcacaatgggtagaacccgagtacattcaaagaagcatctgcaacttaatgacctcccacagatccttaagcctgtatatgcgcaaagcaaagcctcttatcccgcaaactaaattccatccagtttagagactttcaggcagatcgcatgccct

SEQ ID NO: 504756 - DNA, 432 bp, Homo sapiens
  misc_feature (48)..(48): n is a, c, g, or t
  misc_feature (110)..(110): n is a, c, g, or t
  misc_feature (133)..(133): n is a, c, g, or t
  misc_feature (148)..(148): n is a, c, g, or t
  misc_feature (172)..(172): n is a, c, g, or t
  misc_feature (181)..(181): n is a, c, g, or t
  misc_feature (192)..(192): n is a, c, g, or t
  misc_feature (196)..(196): n is a, c, g, or t
  misc_feature (199)..(199): n is a, c, g, or t
  misc_feature (202)..(202): n is a, c, g, or t
  misc_feature (210)..(210): n is a, c, g, or t
  misc_feature (316)..(316): n is a, c, g, or t
  misc_feature (326)..(326): n is a, c, g, or t
  misc_feature (341)..(341): n is a, c, g, or t
  misc_feature (412)..(412): n is a, c, g, or t
ggccaaaacgggaccaggcccgccgggaggagcagagcaagcagcagnccaacgagcaccggcgccgccagggcgccagccaggccaaggggggggggcccgggagccanaccaagagggaggagagcgggcncagcgccagggagangaacgggacccgggaggaccagcngagccaccngaagcaggagnaacncancancggggacnacaagcccaaccgggaccggcgggagcagcagcaccagcgcagccaggaggcccgcagcggcgacaacaagcacaccaacgagaccagggagcacagccgcggggncggggagcancggcgcaccaccagngcccgcaccagcaacgagggggagaaccagagccgcacccgcgacgccaagggcagcagccaggagcagangcaggagtaccgggcgtccg

SEQ ID NO: 504757 - DNA, 116 bp, Homo sapiens
gatgggatttcgcgagctcacagtgcagactgcgattcattgttggttggcaacacaactcaattgtttcgtcagggaaatgccctcagttctctataagcagaataggttaaagt

SEQ ID NO: 504758 - DNA, 444 bp, Homo sapiens
aaccgagttcagatgtaaaagatcctagtctgttagctcacgggctgaccttggcttacggttggggtcattcacagctctgagtgccaggcttagactgctcctcacctcccatggtctggttccacctgacttgcgtacgaatagtagataaaactgtagagacccaaagtgcttggcagtgacccctgtcatagctcttcccggtctgaaaaacggagctgatcattccagggcccattctagctcactcaaggaagcgtcacttttccagaacattccttatttcctacaagagtacatgaagctcatttcacacagtctagacacactcaggtggagctcagcgacaggctggcatttgtctttaaaataaaaggaggtacccagatgactgaaagagaagtataaggcagaagctcaccaagaatgaaaggaggtggg

SEQ ID NO: 504759 - DNA, 440 bp, Homo sapiens
  misc_feature (195)..(195): n is a, c, g, or t
  misc_feature (226)..(227): n is a, c, g, or t
gcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtancacaggtttaggagaagacattatacatcanntgtcaaaatctgaagaaaaagaactgagaaaatttgggaaaatagactacagctggatagctgccctttaggccttggaggtggggaggctcctgggccttggtttggggtgggggggtgctttttcccagaggccttctgtgtttaatgttatttctgttctaaaaataagataataaatattaacaaactttgcttttttaaaaaataaaa

SEQ ID NO: 504760 - DNA, 358 bp, Homo sapiens
tcagccgagcatatgctacactaagctaaacagactgtataagcaaacattctggatttaaaataggatcaagtatggctgtaacccaggagtagggtgatacaacgcgtgagttcgaatagtagcagcaggacaatacacgagcacgaatggccaagtgctgatcaaggctgagagcaattatttatagcttatcgaaaatagacaaactcacactccactatgcccagcatacctgtccagctcattggcatatgctaccactacgctaaacaagcattgttctttggcacacattctggctttaaaatagcatccagtgggctgtaccccaagcacgactgacagggggtcacgc

SEQ ID NO: 504761 - DNA, 552 bp, Homo sapiens
agcaatctacacgtgattataaccctcactgtgaacccagcacagacatgctcataaggaaaggggaaaaaaagtgaaaggagctctggaaatcttaacccgactgtgcacagagtttgagaactatgtggcagatatcgaggtggatggaaagcatgtagagatggctttgtgggacacaggtctgtcaggaagataatgaacgcctgagagcccttttctacaccagataccggtaggatactgaggtgtgtttacatatacaggcctgagaggttagaaaacatatccaggcggaccccagaaggcaagcatttatgtcccaacgtgcccataatactcggtgcgaataagaaggaacttcagaatgatgagcacacaaggcgggagctatccacgatgaagctcgagccggtggaacctgagggcagagatatggcatacaagaatggcgctttagggtccacggagtgttcaccccagaccccaagattgcgtgagagagaggtttgagatgggtatcgaagcttctctgtaagctatacgtgggag

SEQ ID NO: 504762 - DNA, 476 bp, Homo sapiens
  misc_feature (195)..(195): n is a, c, g, or t
  misc_feature (226)..(227): n is a, c, g, or t
gcttcttcacactccagcccatgtcctgccatctgctgctttcctgtgctccatgtttgtaaattcattgctgctgtctaaagagactaagagtgctaaggaaattcctgaagatgtagatatggaagaagaaaaagaaagtgaagattcagatgaagaaaatgattttaccgaaaaagtccaggatacaagtancacaggtttaggagaagacattatacatcanntgtcaccatcatgtaccacaacacctcagcggatgtaggattatacgctgcacttgtatatgttccctttaagccttggagatagtcaggatcagtgtcctttcgtgcttctgactgatatgcttatattcaacggctctccatgtctacgtacgcgtggttgtacgcgtgggcgaacgcgtgttcgcacgcgtggcgtttgtcgtgggtctgacccacgcgtccggttataaatcaagagcggccgct

SEQ ID NO: 504763 - DNA, 155 bp, Homo sapiens
agaacgatggcgtcgggtggaggtggctgtagcgcattcggagagactgcctccgcccagaacccggcctggagccggagtccgagggggcggcagagggatcagaaaccgaggctggagacaggcgacgccgacgggggaggacataatcaccg

SEQ ID NO: 504764 - DNA, 147 bp, Homo sapiens
cctaagagctcatgatgaataaagaagaacgtctttttgtttttaaaatgattttaatacgttttacaccgttctctcggtacttttttttagctaagtcagcattgtttccagtgtaaaggcatacctcactctgcaagaaccacg

SEQ ID NO: 504765 - DNA, 602 bp, Homo sapiens
atcataagggtatagcccgcaggcaggcagctcagaacgttaagactattaccatacccacgccaaacaggagagcagaacctttaaacctttacgaatgatcaactgagctactctaacctactaaccgcagaattgcgcaccagccacccaggcacacgcgatcaccccatttacccaggggaccggaggccgagggtttgagagcaccagatcaccccttacgctataacgcacctgcgcagctgagatctccagatgtcccattgtcacctacgaaagtgcgtatgacattttagcacacacgatcactcagtaccctaactgccattctgtacccagctaccctaatacgtaaagccctacagctcaacagacaaatctgctcgactgatcactagaacactaagagcagtcctgaaaccccgatcaacctaacaacctcacgatcagtcgataaaccgatatattgagatattcatgatgaagtgtacaaggctacgacatgtgcccacgtaccgacgttaggacaatgggtcaagcatgaggccataagaaatgaagtacatttcttaccttagtacctacgatagtacttatgc

SEQ ID NO: 504766 - DNA, 404 bp, Homo sapiens
  misc_feature (15)..(15): n is a, c, g, or t
ccaccactgacctgngacagagaatcgacaatgccgacttctgtacttagtcttgcatactactgatgccacacctgagctgacttttatcagtctcactgcctgaggattcccagggagatgctgctcacaagacagagacatacgagcctgtaacagaacacccaaccttgtacaaggacaattccaacgctcctaaatgtcggcttctataccctaaggagagacgacacggccacatgaccaatttctttctctgcccacagagcatcgatacagtcttttgcaatgatctccttgggaccgaaggtgaccatcacaaggaataccctgaatgcgcagatttcaacctcccggagattccggacggtcatatacatgaatgtttccaagctcctcctgcc

SEQ ID NO: 504767 - DNA, 148 bp, Homo sapiens
ccatagaggatccccaccgactagccgacagcattttgaaatttccttattgaacgtacttacttccctgatatggacatttcctggagctcatatgtcttgagaccgtctggtccccccaggaccttgccccactcttcccagagtc

SEQ ID NO: 504768 - DNA, 408 bp, Homo sapiens
ggatcatgagtcagtcggaaggaacgaccatatcaacctcataatcccttcatgtggcatccagcggatctctggtagctggagacagtcatcgagaccgctggtctcgcctcctcggtcgtctcacagatgcacgcacaggccaacctaggtgctagacaagcaacagcatttccgcttctattgcaatcattgcagtagagtaatatctccatgccaggttgatgcatcatactcatcagaatgttccctgtcgagaccatcaacatgtccagagagacaccttctaaggcgaagtccacatttacggttccaagcattgtgactcgtgggatatgcctcagatgacaaggtgaggtctgagcccagtaagatatgggtcgatccaacaatgactatctatcagct

SEQ ID NO: 504769 - DNA, 399 bp, Homo sapiens
  misc_feature (233)..(233): n is a, c, g, or t
  misc_feature (252)..(252): n is a, c, g, or t
  misc_feature (343)..(343): n is a, c, g, or t
gaagagtcttcacaaattttatgtcaatgtggatatagctaatgactcacatacattagcatacatatttttgataattcaataaattttattcccaagtacgtacagattttatttccaagatgatgataagaaaattggaagatgggaaatactttttagcaacatggtttttcacttgtgtatctgctaaaatcctggggtgtcacatagacacgctaaacctcgtctcnactaaaaacacaaaaaacnagctgggcgtggtggcgggcgcctgcagtcccagccactcaggaggctgaggcaggagaacggcgtgaacccgggaggcagagcctgcagngagccaagatcacgccactgcactccagcctgggcaacagagcgagactctgtccc

SEQ ID NO: 504770 - DNA, 188 bp, Homo sapiens
cacccgtgtgaaaatgtttttcgcttcccccggacgccggggggaaaaacacccccggggaaaaagttttttccgtccccccgggccgggggggaaaaaaccccctggggaaaatatttttctcccccccctgcgcggggggggttaaaacctccctgtgaatattttttctccctctccgggggggg

SEQ ID NO: 504771 - DNA, 414 bp, Homo sapiens
  misc_feature (18)..(18): n is a, c, g, or t
cggagggttgtctccacnggcaggttgtactccaccggcaggttgtactccaccggcaggttgtactccaccggcaggttgtaccccaccggcaggttgtactccaccggcaggttgtactccaccggcaggttgtactcaaactctcttttcctaaagccacacatttttgttgttattagtggtgttattacttttaaagaggttatctcttatttaaacaatatttatagcaagttatacataacaagtaacaatcatactagtagacatcttcaattctaatgcaagagcataagctcttcaccagcatcttaaatactgcgagagtcagtagtgcttaccaaaagtagagggtactcttctagggaatcagaaaattatcaaaataaggcacagcctgttgttatcaca

SEQ ID NO: 504772 - DNA, 254 bp, Homo sapiens
  misc_feature (18)..(18): n is a, c, g, or t
cggagggttgtctccacnggcaggttgtactccaccggcaggttgtactccaccggcaggttgtactccaccggcaggttgtaccccaccggcaggttgtactccaccggcaggttgtactccaccggcaggttgtactgttccatgggtgaaggctctaacacggtcactgtaaaaactgggtaaggagatgtaagagacatgggccaagtgctaaatggaggaagagggtaatgcaggcctagaagtacctg

SEQ ID NO: 504773 - DNA, 1016 bp, Homo sapiens
  misc_feature (140)..(140): n is a, c, g, or t
  misc_feature (303)..(303): n is a, c, g, or t
  misc_feature (409)..(409): n is a, c, g, or t
ggctcgcgtgaagttctcccacggagaaacagcctatgtggcagcttgcgacgtcggcgctccagcatcagtaggagagcaccgagatggacgacgtaacgccaggtacggatttcgacgtgccggctatctccgcacgnttctctactaggaggtgcgaggactgaaccctcgtggaccctcccaagggactccagtctgcatgggacgcctgcaatacttcacgtgactagcgtgacatggagagagttggaacgattggtgcgctggtctgggacacagctatcactcagagtctgttgntatccacgattccgtcgaatcgtgaagatctattccacgatggatccgaacgctccggctagtagctgcgaagtgggagaccaagttcacgtgggaagcatgtcgntctctgtatcgcgtgcgagaggagaaattgctgtcataagccagaactcgagaaaaggccgtacagaaaactagagcaaaagcgtcgccaggagccgtacctctgacacgctgtgcccggatgccatgcgcttgagggagcttggtcttcgccaagagcgaaagagttgtggaggcgaagcagaatccggcgtcaaactagatggcagtccggctcataaaggcttcatttggcacaaagcgacagcagaacaatgtggaacacaagggtttgaagagcttgtgttctggtgtctataagaagctcacgggcgaaggatgtgagattgttgaattcccagagtttcaattgtaaacaaaaatgactaagtaaaaagtatatattccacagtacagataacacataaatgtaaaattcctcgaaggggctcaagggccgaggtcgcgggacaaaagagcggtccagtcaccagggggacaccatggttccttggcctgtttccctgtgccccgagtttactggtgtccaaacgctggggagatctcgccgggtctcccctattaggaggtcggtattaatttgaaataacccagttttaccctgctaa

SEQ ID NO: 504774 - DNA, 1612 bp, Homo sapiens
ggagaacaagttacctcaaggtgtgggcgagatgtgcagggcggaccctggcgacctgacgctgcggaggctcgacgcggcgtatccataccacccagcctgttcgccgctgggaacccgccggcccgcaggtgacccagcgctggaaaaacgccagcgcacgtggcccatggcagcgctggctgctggggcaatggaccacccgctgccctgccttgcacgtcccagtcctccctccctagtgactgcacgggtgctgccccgtgtgccgccgccgtccgcgccttccccgtgaccgtgcgttccagatccctactccgcgccttccggccccatcccggccccacctgctgacgccgacacttgtgcctcttctgcccctgacgaccaccactgctcgtggccacgatgacctacccctttacaccgcaaccaacgtaactcactgcgtcttccccgcaattgcggcctcgacacggctgctccgttgaagcccactaacccccgttcacccgccccccccacactggcgcccaccggccctctccgcactccgatactctacgccgactctgcctcgcgccactctcgggcaccccgcttaggcattccccgggcggccccctgctcccgactcccacccctccccctggcgccgccactccttcgcgctccctacgttccccctactttgcccgggcctgccgcactccgccccccctctctgcgcccccgcactctcggccccgcccgctctcgcgcccgcaccgcgccccgcgcctcgccctcgaccgaccgcgcggcacaccccgggcgccctcccccttctcctcagcccaccttgcccccctgcgcgcgttcctcccggcccctctaccccgctctcgccccccggcccgtgggcagcccgctcgccatcccggcctgtcgcctcacctcccccccgcctctctgcgcctccttccgtccccctctctgcctggcgtcctcacctcttccgcgcacctgcacacctacgaccacacgcgccccccctccctcgcctcgcaccctctacctcctactctaggcacaatgtcacccccacatgagatcaacacatgccagcgagcggcagccattcttacattcgatccacacaacccacatgtcactctcacacgcagccgcctcacccgcctcctctccgacggacatctgcaacacctggcttgccgcacggcacagcccagtccaattacggctactggcgcatcggcccgtagcgactacatatcagcgccgcacacacactccatgcagacagaccactagtcggccatactcacctcatccaccgcacactgtctcgcacacactcacaccctccaccacaccctgtgatccagctctcatgtggatcgtcacacccctccgccgcgacgacgctaccaccagacacctatatccatggacacacggacgtaccacacacccacacctgacatcccaacctcagcgcacaaccctactatacccacgccacgctcgtctatacccaacacagctatcctcccactcacccgacacaccacctacgaaaaccagcaacatccatcctaacacgaccatc

SEQ ID NO: 504775 - DNA, 205 bp, Homo sapiens
  misc_feature (18)..(18): n is a, c, g, or t
cggagggttgtctccacnggcaggttgtactccaccggcaggttgtactccaccggcaggttgtactccaccggcaggttgtaccccaccggcaggttgtactccaccggcaggttgtactccaccggcaggttgtactcgtattgaattcaagtataatattaagtatgcatggacctctagagctaatagtcacctacgtcgc

SEQ ID NO: 504776 - DNA, 267 bp, Homo sapiens
  misc_feature (20)..(20): n is a, c, g, or t
aacgtgtctgactggtgacnaacctggtggactacgctgtgtaccatcacgcctcgcgaactttattgtatttttacgtgtgaaaccgtgtctctactacaatacaaaagactagctgagcactgtgtgggaagcacctgtaatcccagctactcagaaggctgaggtgggagaattgcttgaacccaggaggtggaggttgcagtgagctgagatcgtgccatgctactgcactccaggctgggcagcggagagagactccctgtc

SEQ ID NO: 504777 - DNA, 822 bp, Homo sapiens
taaatgtgcaggctatccaagttcaatagtaaaagctcaaaaatgaatgttctactccatgctgaaggactgaaagctgccttcttcatatttggcactttctggtattctcccctgttttttttaattccctaaaatggtgtggttggagtggaccgccctgcagtgggggggtaacaatggcccactgattttggccctttgaccctgcacaaatgaccttggcttcagccaaactcatttgccatgacaactctttgtactgtgtccgtgccacagatctgtgggctcacttggttcactagtcacggggacacgttggagacggccacattttacatttttctggtgggcaattttttctccaaggcgtggtaagtcagttttctttcttccctactactaaaggggtcccactagttaatcactcctcagaaaattatcggggtgtggcactccacacttgtttctgtgcgcacattggtcgaaaggcgcttaagggccattagtttcacgggtaccttagattaagcccttgatagacttttggccgtgatacgagctcccgggaacaacgcgggtgcgctaaaatactgtgaaaaacgcagctgtaaacgctagtggaccctaaaagacggttcttgtatactggctttctcggcacagactggttttggcacactcggtggcaccgggccctactgtggacccatttattccctttatgcaccaaggaagttctttctcccttatttctatcaagaaacatggcttataacactcccacacgaggattaagtcctgcgctcggcaacgtcgtcc

SEQ ID NO: 504778 - DNA, 382 bp, Homo sapiens
cgtatgggaatactgtgaaaaattgataaataacaggtaagagaaagatattgcgtaggcaattactaggatcattaggcaaaaagtgagtactgtggatctttgaaatatcgacagtcacacagatcatgcttgtccgtacagtattgcgggccagacacttaagtgaaagcagcaagtgttagggtgactttcctacttaaaattttggtccatatccattcaaaacatttgcatcttggtaggctgcatatgcttacctatttgatcccaaaccaaatcttagaatcacttcatttaaaatacttgagcggtattgaaatacttcgaagcagaaccggccatgtgcagccctcatttatgagagaaccctcaggaaact

SEQ ID NO: 504779 - DNA, 1486 bp, Homo sapiens
  misc_feature (164)..(164): n is a, c, g, or t
tcccgctgcgtttcctactcagagaaacagcaagggcggtgtctagagacacggagatgacgggaagcaggaagcggggtcagcagcacacacggtgtgggtccgtgggcgcgtgcaggccaggtccaggaatgcccatgccccgtcaccgtcgtatgatcggnccgccttagtggtgcctgcgtgccgcgtgataagctggatgcgcagagagtcagctgtcagccttgccaggtgttctgcccatgccaatagagcgactgtagtgcgttcacggggggtcgcttcatgagtacctagccatatcctccactgagcctccaagctgtctcgagaacggcctttgtatgggacagtagagggctggtgatgcaaggtgcgcccatgtcgggtgcgagagcattgagcgcggagcgctcatgccatcaaggcgatgctcggtgcagagagcatggaggcgggcatgggagcaccgatgccgtccacgcgtggaaggtggcgcgaggagcgtgctacatgagcagcgcgatcgtacgtgcaagacgttcatatcccccgttccattgcaccacaatggacggacttgtctccgttgccgttccccggacgcgcgttggtagctccgggaggagagaccacttaccgatagttgcccatagtcgttggtaagtcgttccattggttgcctttcggtacctcatagtgggccttggaccccaaggagtggggtcccgaaagcagaccccgaggatcgtcaatagccccaaggtcgcgccaatcacacgtgtctttccgcaaaaaacagttggcaacttgttggttgccaagttttgtggcgaacccaatatgtaagtcgccggcgtggacaattccagtgctccatttggagaaagcccccgttttcttcaattacatcacaaaaggccttgggttccagacataggacccctgggcaaccaagggggcaagggagagggttggtccccttcaaagagcaccccaaaagggttttaaagcacaacaagcgttccattaaggggttttgggcccacagatgtaaaccccacggtattgaacacacctcagggtgggagaacccccatcctttacactgggggggacatactcacaatcctcttctccttatcacccggattaatattatccgccgacaacacgtgtggggctatcacaactataaaagcattgtcacagttttgtgtgttttaaacaagacacaagaacagaggcaatcccaaaagacgtcgcaggcaacgaaaagaaagagtaggaaagaaagagacaagacggaggaagtaaaacaacaaccacccaagagaagggacgggagaggcaatcaaacagagaggggaccgaaggacaggagacacacttgatttataatacacgataacaggaagcagaagaaaagtagagtacaacgcacgaggacgaagagacgcagcacgatggatggaaatagaag

SEQ ID NO: 504780 - DNA, 698 bp, Homo sapiens
gcggggaccttgagtctctgtcggcctgcccctcagcaaaggggaggtgtcgggccctgaggaacgatgtaccctacatggccactctatcgaacctgtgtccccatgttccctgcttttttagtctctagctatttctcgagctaggagtcttggactggagctcgagatcgattagatacagcgactctccagcctgggctacagagtgagactctccaaaaaagaggaataataaataataataagacgtaaatagacaaggtctccaggtctggtcaagctcactggcctacaaagtgatcctcccacctcagcctccacaagcagaccgggactacaggcaaacatcaccatgtaccaagctgtccccagctttctaatactggtctttctcttgccggcacgaacctctaatgaaggaatacgaagccagcgcctgcagtgcagtccacccgaaccctcttctgggcatgcctgtggctctgttgcccatctctctgtgacagcaggaccatttgtgggtgcttcgtgcaactgttctggggcccagaacgggtgctggtccacattcaccaggcacccaacagcacttcaaagagtgggtaaaggagcttgccctcatgggccccccagccttagtgactcaccccacaacccccagccctgtcctgcaaaccctcctagtgggaagcata

SEQ ID NO: 504781 - DNA, 148 bp, Homo sapiens
aggaacagcatgagctcaggaagctctctttcttcacttaccattactaagctctccaagcatagaaatccctgggaatggcgagaataactcccactattttaaaatttatattcagattgtttcgtttcataagacacatcaaaca

SEQ ID NO: 504782 - DNA, 1059 bp, Homo sapiens
  misc_feature (1051)..(1051): n is a, c, g, or t
tggggtcaaccggttccttgacgatcctcgtgttgccctttgccactccctttctaggcgggatccgttccacacgtgacgcaagactatcctactgggagtggacgctccccaatgtcacagtccccaattcgcttctatcggtcgcatctcttcaggacgacttatgaaagacggcgtcacgggatgtttttggagctttggtttatgcaacgtttgcctatgtgcagatgtaagctaaagcaattccgtaggttcaacccagatgtccgttgcgaattctacttggccatcactgtgcacaggcattgaaaaatgaacaagtgttattaatggctgccataaaaagggaggtcgtcgcctgtgtgaggaaagggtaaaataagaggcatcgtttccaagtactctatctaattgtgaattgtcataaagacttgactaggccatgaacttacgttctccatcatcacgtaagtggttaaaggcgttgcaacccctccactgtgctgtgtctccctgtcaccgaagtgaagtgaccgtgccgatatcaacccacggtgggaccacctgtgtctgcagtccggaggggcttatgcaggaagcactcaccccccacacgttccccggccatgagcttcccctacctttcgtcaccacctgagggcatgagcacaaggccatggggcgtgcctggtgagtctgcctgtggttcaggacttagccatagtaggtctccatgtgtgctgctgcccgacatgggatgcgcaggggaggcgtggggacccgcaggagggtgcgttcgggatacaccggatacactgctgctctcattgctctgtgttaccaaatgcgtctatggacatttgtgtgctaaatcctaggaaataacaaagacgggttaaaacccagatgcggtatattcatttgtaatgatgtactaaagtgaagcagtatttaaactgtaaagatttttttcagtgtgttttctcgaattttgccacaacatacgtaggcttcgtattttatttatctttctttttagctcccaggntcagaccc

SEQ ID NO: 504783 - DNA, 946 bp, Homo sapiens
  misc_feature (1)..(1): n is a, c, g, or t
naccttctgtctttctgttttgttgtgcttggttgtctgttggttgttgtttcttgtttgttttttgtcttgttcttatgtgttgttcgtgggtggtttgtgaaaaaaaagaaagtaaccacggcgggacgaaggagaagggggaggctgagaagaagggggggggggggtctttttgatcaagggtttaaacgttttttaaacagtgttttttcaaagggaaattttcgccggcctgtacgaatgttgtagaatgtcgcccctcgggggctttttccccgtgcgtggagacgcacggtgtgctcttcacggggcttctcctttgggggggttagtgtgtctctctctggtaggggggccacattggggccctccgtggggggccctcctttgggggcgcccccccctctggttctccttaagggcgggcatgtttcacgcgggaccactgcggggtcaaagcccctctcaggtaatccggtctattgtgtggccccattcttgccaataagggctcctggcaaaagtttaaggggtcgaattcaagttgtaaacgatcacttgccacaacatgcttaactcttgacggccctagcaacggagggattttttgccccccccccgaaatgtgggagacaaatactgtctccgttctgagaacggtagagcacagccctcgtgtcagaaagcgtcacacctgtgaccctcggttatagagaaacgcccctttgttctccccccttatttgtggagtgcacgacccccctgctccctcacactgggtcatgagttgcacataggcacacccagtgggtcacccgcgtcgccttaatggcgcactttttagatgtcttctggcttattaagtggcaccgcctgtatcgtgctgtatatcaaaaagaggtgtgtgtccacatagggcggcaccaacaactgacaagaaaat

SEQ ID NO: 504784 - DNA, 1276 bp, Homo sapiens
  misc_feature (248)..(248): n is a, c, g, or t
  misc_feature (338)..(338): n is a, c, g, or t
cccctgcgctccagccatggcgatttctcggccgcgctgaccctgaatactcggcgcggttgccctggccccgtctcgctggtagggctttctcgggatacgggcgaccccccggcctgctcggccgtagcgctgacaggaatgcttgtgagagcgcagacggcgccttcatgtatcccgcagagctcgggaggggacagcgaccggagtttcttcagcgcaaccaacgagttttgcaatggagcccnctcgagaagccaactctgactttcttctaatgttcaatgacacttgtttatcctgtgcagaagcctcttcgaatgcccgaggtcctatcntggtgacactaaagctgtggactggtaacggcgccattgcttccaatggatgccgtacgactcatttgtgggagacctgcctttgtgtaccacagaagaatctatacgatgctgtgcaacacgtaacagacacaactgccatccctcctatgactgggcacttggacagcgtttcatccggcacgcaacatggtccgtactcagtcgggaggtgcaattaatacttgatattactacaagcgcgcaaacccgtgcaagattcgtccgattaccattgcatttagacgaaacaattggcctcctgtgaccttgtcgagcggacgtaccggctccaacaacgatcggcatagattcaggggggcagtgagtgctaatgaccaatgtgctgcgcctccttcttgtgtgggcccccaacgtgatcgcgctctagcaccggaacgcatcaattccaatccttccgttgccactgctgccgtcaagcagacttatcctttttgaagcccaccatcgttgtggcctgtgtaagcaggactgcacgcccataaggattgagacgatcccccaacaagttggggcattcgttggggactaacaaaacttggtaaaaccccccgtggccttcattcaccttatcccctgttacccccggtcaaatgaccgaactacttctccggttctgggttggttgccgaccttcttaattggcaaaggcttctttcccaggaacggggccagtccaccccccgaggggccaaatgggaagaaatgccgaggcaatacgagcggttatacgagcctctctaatgcagacttggacagggccaaagaaaaggatgccccgcgggcacccaagtggggccaagagccgcagacacatccttgggggggcttgagatagaaccacattccccttgtgtgacttgtcacagtctccgtca

SEQ ID NO: 504785 - DNA, 246 bp, Homo sapiens
ggtccctctggagctagtggtgaacgtggatcgcgctggtccatgggccccctggattggctggagcccctggtgaatctggacgtgagggggctcctggtgccgaaggtcccctggacgagacggttctcctggcgccaagggtgaccgtggtgagaccggccccgctggacccccttgtgttcctggtgctcctggtgccccttgccccgttggccctgctggcaagagtggtgatcgtggtta

SEQ ID NO: 504786 - DNA, 995 bp, Homo sapiens
ggacccggggtttgctcctggtcgccttcgcctcctagatccctatggccactatgcgtgagggcatctccagtccacgttggccatggctggtgtccagattggtaaatgccggctgggagctctattgtctggatcacggtatccagcccgatggccagatgccaagtgacaagaccatgggggaggagatgagctccttcaaaacaccttcttcagctgggagaccgggcgctggctagctagtgtcccgggcttgtgtgggtagacttggaacccacagtcattgatgaatggttcgcagtggcacgctacgcgtcaggtcttccacgccgtgagcagcctcatcaacaggcgaaggaagatagctggcgaataactatagcccgagggcactacaccatggcaaggagatcattgaccttgtgtgggagctgaattacgtcaagtcgggctgaccagatgctagcggatctatcaggacttcttgtgtatttaccacagctgtggtgggggaagctggttctgggttcagcctgcctgctcatggaagtctctgagtcgattatgggaggaagtccatgctggagttctgcattgacccggtcaacgcaggttgcacaggtgtagttgggcctagagatccatctcactaccatacaacctggagcgacgctgatggtgccgtcatgggtagaccagaggtcatctatgacagtccgcgaaagggccgatatgagggccagctaaggtaacgtaacggtgataaagcagatgtgctccatcgtggtcctggatggggggcccggatgtgcgtggcgagattcgagcagcggggcgaccccgcgcatccctgggaatagccgtgattgtggaacccacggcggttgggggaggaccacggtgtgggccaccatgtgggggccccggaaaattggcggcggcggggcgcaaacacggcgaacaggacaaggggggccagacaactctgggat

SEQ ID NO: 504787 - DNA, 394 bp, Homo sapiens
  misc_feature (102)..(102): n is a, c, g, or t
  misc_feature (214)..(214): n is a, c, g, or t
ccccccaaaacggggggcccctttggggggggggggcccataaaaatttttgggttttttgggaaaaaaaaaaaaaaaaaaaaaaaaggggcttttgggggntatggggtttttccccctttcccccccccccccccccccccccccaggggagggggggggggggggggggggggggccccccccaaaccccggggcccctgggggggggggncccccccccccttggagggaagggggggggatttttttttttttttttttttgggggggggggggggggggggggtttttttaaaccggtccctttttttttgggggggggggggccccccccttttttcaggggggtgggggtttttaaacccctgggaatttttttttttttttttta

SEQ ID NO: 504788 - DNA, 202 bp, Homo sapiens
gcgtcaccgatacaagtagtcagcctggatgttggcggcgatctcggcctcccacttgtccccgttgttgagcaacttctccttagttgtacatgcagctacctcatggtgtctccggtggcagaactcaagagtttggggcccttcgacgactggcatccacgtggaccaggcctccttggcatgaagccgcacgtagatg

SEQ ID NO: 504789 - DNA, 253 bp, Homo sapiens
aaaaagggcccggggggggggggggggggggggggggcttttttttttggggggggttggggaagcccccccccccccggggccctttgggggccccccggggtggggggggtaaaaaccggaacatttgttttgtggccccccccccccccctttggccccgggggttttccggtttcccccccccctccccccccccccccggggtggggggggggggggccccaaacccccttgccccctgttgggggga

SEQ ID NO: 504790 - DNA, 186 bp, Homo sapiens
cgtatggcagccagctgtacatccaccgggaagcctcgtctaacgatctgtgatgtctcggatgccgccactggagcctgcttccaccccagtggctgtgggtcttctctgcactcatctggaatggcctctatgtcctgcctgtcagccacattgaccttgatccccagctcaggccctggcact

SEQ ID NO: 504791 - DNA, 1793 bp, Homo sapiens
  misc_feature (163)..(163): n is a, c, g, or t
  misc_feature (670)..(670): n is a, c, g, or t
ctcagtttatggatatcccattactctttttgtggcagcacaggcaacgtgcatcaacagcaagtcaagcgcatgcatgcaggctgcacagcacaacaggcacagcacccacagcacagcacagcaacacacagcaacacacagcaagcagcaacagcagtcnggcacagcagcaaaccctgcaacattgcacagcatgttggttcctcgcatgcaggcacagcacacacagcacaggcatgcgtgcaccaagcacagcacagcacagcacagcacagcatctcaagtgcacacacagatcacccatccgcatcgacaagcacagcaagactcacaaaccaacaaaccaacaagcaccaatactgggcaccccagcacacatcccgcgcaccgcatcattcacgtcacatgcaggagcagatcacggcaggcaaatctctcaatcacaagacagcttctggacacccaaactcgcactggcgagcacagcaatcccaacctaggcgaccacgacgcacacgccaatcacacacacccagacacaagcacaagggcaccagacacgcgacacaagcccacgcaggaccacctcactaccaatcaagcgtcgcacccaacgaaaacgggtggccagtcgcaatcagacctacgcagattcaatgggttcctngaccacacaacacccgcggacacgacaggcacaccgagcgacacgcaaccaccacaacagtacctaccacacgcaactactggcacaactcgagtcacagcaccaaggacaagagttgcagtaccacaagatcacaagtgagggcaacatcacaaccatgcagagccaacgggcaagaacgatacaaagtccgcccctggcacaagtgacatcacgttgcacaccagccttacccaactaccaacgcaccggcggggcgatcgaggcaacagaacagacccacagaaagcagcaacaaccaccacccacacacctcacacacccctataacaataccacccagatcagaacgcaaatcagaaccgagcacacacccaccaaaaagccagcacaacagtcgtaccggcacagacagctacacctgacacaacggagacacaagacaccaaacagagcacgcacagcaaacaacagggctcacagaacacaccacaccgacgacaacactggcaacacacatgacacagagacaacaagagaagcacaacaacgacgagacgaaaccgaacacgacacgacccaaatatgcacaccggcacaccaacgaatcgagcccaacacaacacaacacgaagactgagaaaacacacacgaacagacacaatccacaaacaacacgcaaccaaaacgagccaaacaaccgcgcgacacaagggacacacaaaacaaaagagccacagaggagtcagcgacaacaaggacacagcacaacacacaggaaccacaaggagacacacaaaagaaacaacacccgagcaacatgacaacaagaaataacaaacggaacgccacagagcacacaaaaaaaaataagaaaacaccggaacaacacaccgaaccaccgcgcacaaggaccaaataagcagcccaaaaacaagacggacacaaagagacaacaagacagagacaagacgacgccacaacaccaaacacacaaacaagagaaaagacgaaaaaagaacacaaacggcaacacaatagacaagacggagcacacagaacaacaacagaaagcaacgatagaacagagcacacagagcacacaccacacacacagagcaag

SEQ ID NO: 504792 - DNA, 798 bp, Homo sapiens
  misc_feature (798)..(798): n is a, c, g, or t
taactaagcttttaatttatctggcatattttccacttttaaaaatgaattaggtctattaggataattaggagttggatcccatcaacactattctggtagcagttaggaatctggagctatttttttttctcatacgattactatagtccagtttaccaaagttttcttaaaaatgtcggataatctggagatgatggcgttaccttaaagggtatagaagggatcacttaattttttggaaaaatgaaataggggtgaagctgaataaagttctacttacggtattaacgggcaacagtggagttccttaagatctgaatggcggtgtatgtacgctgttttcagaaccagtttctaaccagccggtgagatgggaagttttttccccataatggggatgaaacctttcatccaggtatctcggaactcgacggcgtctgtgtggttggtacccttgtgggatgcccgtggctgtgacatcctgaactcttctatgtaccgttgaacttcgcaggtgccgtcacttaccgggtctacgctggcggggggggcaaattctaccacgtcctttattgaaagaataatggctggccaaatattgtgcttccacctgggcggcgaaaacaaaacacccacacgacaacacatcaaaaacaaaaagtgggcggccgcgccaaaaaatttaaacactggggcggcggcccagtaacacagcgccacgggtccgaaaccgcgcaaggcgcttcccaaaacgcgcggcgctgaacccaccgctgggcaagacgccacccgggn

SEQ ID NO: 504793 - DNA, 286 bp, Homo sapiens
ggttaaggaaaatacagttttaatacaagatgtgtgatttagagcccaatcatgtaaataaacatttaaccctatatgtatgtgtgcataagttatacatatatatattatgtgtagaatagcacataatgtacacacaacatgcataagctgtacatgtacatctagtaccacatatattatctttaaaatgtattccaacatggtacgtagctagttcctagggcagatggagctggtggaaaagccataatcaattattggttaccttccttatttctttacc

SEQ ID NO: 504794 - DNA, 136 bp, Homo sapiens
taactgaatattaccttctgtaggaataggtggtaaataagcatctagaaggttgttgtgaatgactctgtgcttgcataaatgcttgaaacctctatatttctgtcgttcataatagttaaaggtcaaatttttc

SEQ ID NO: 504795 - DNA, 779 bp, Homo sapiens
aaaaaaaaaaaaaaaaaaaaaaaaaaaaaaaaaaaaaaaaaagaaaaaaaaaaaaaaaaaaaaagaggggggagaaaaaaaaaaaaacaaaaagaagggacaaaaaaaagaaagaagaaaaaaataaagaaaaaaacagaggacaaaaaatgagaacacgaaaaaagagaatatgaagggggtgtgtgttgatatatgagatgtgggtgggtacgggggggtgtattttctgagtggtgaggggagaggggtgttatagatgaggagagtgtggtagggtgctagtattatgtggggggcgggtttgttgctggtgggttgtttgtttagtgagtatagtggagggggggacttgatagcgtcatttttcgtggtataaagtggtggagtgtagagacggtactgggggcgctgttgtgtgtgggtcggggggaggcgaggtagtaggggtggtggagcgtttacggaggtggggtgtggggtagtcgctgcggtctgttgtgtattacgttcggcgcgggtgcgcgtgagtgtttgttagtgatcagggtgggagcggtgggagtgtggggcgctggacggggggggctgctgggctctgccagccgcgcaccgagcgtcggcgcgcgcgggtgcgcggtgactgcggtgcgggtcggagtggctgggcggaaggggctggggaagaggggagggccgggcgcgaccgaagggcgggacgtggcggagcggctcctgtgaggagcgcggtcaggcgacgctccacagccggggcacga

SEQ ID NO: 504796 - DNA, 403 bp, Homo sapiens
ttgtgataactgtatgatgcacaagctggtacataacatatgatgtgtgggccactatgattatcattagctccctatcattcctaaagtagctattcattctccacaattactttaggagaagctattctttttcatgtatttatatatcaccttcataacttatttgttgaaaaagcagataattattggcatgcctacctatgtgccagctgactacacttagtactgaggattgaaaaataaactgaaaagacattttctgtctttaagaagataaacactgaggagagagagatgagagcaaactgctgcactaaaatgcaataagtttattggtagaaaatgtacaaagtattgtagaggaatgagggactgctttgtagaatgagattatataaag

SEQ ID NO: 504797 - DNA, 980 bp, Homo sapiens
  misc_feature (44)..(44): n is a, c, g, or t
  misc_feature (633)..(633): n is a, c, g, or t
tagggcagcaaatgctgagtgtaagacactcagatatggtgacncactgtgttaaacttgggcatcttgttggccaatatcacgaacgagatcttctcttcgttagcggatttatttgctcttctgtgcgtggctgtatgtagcaaagacaataaagacgatctttaagcaacacactctcttcttacatagatactattcttgtcgtggtaagtactatatcttgtgtgacaagagaactactgagccacgagagtgaccgatcaaatagctaggcgtggcaatcaaggtgtactaataccagtctttgtcgacctgtgtcgcaatctactggcactctgccatggcctctaacttgtctcaattgataacggataagaatagcgatgatgctggacgtgtgtataggggctcgaggtgcacgatgaagacgttaatacatgaacttacgtaacagtgatctggcgcattagatggtctagcactgtgttgagctcttattgacgagactggtttcgtgcttccctcgcacttgaggtgtatgctcctagaaagatcaggtcttatccatcttaaaactgcagtgaactgagcagaagttaacccatcgcatctgtttgtcagttagccatngggctatcacagtagaaggcatttggaccagaataaacgattaccgtgcgacgaaagggtaactcactggtgacgccccggtggatcccggtccaaggacgtttgaaaagacgcacacagtggggcgcgctgggcccattacggtcttcgaccaagggggcaaaaagggggggagaccacggaagaaactcggaggaacaacagaagggcagggaggacctctcacacgtggaacaaagggccccccgcgggaaaggggccttttgatggaaacgtcacaagagaagtttcagaagggcacaaggggagaaagacaacagaggagcagaggggccgaataatagtcg

SEQ ID NO: 504798 - DNA, 150 bp, Homo sapiens
ccgcttatacttcagtaaaaaccgctactaattgcattcacattacacagtatcaaccaaacctggatttgggtttactccaagagttcttgctcctcaccctgttccctattcccatctcacccattgttcagaagtataagcgttgag

SEQ ID NO: 504799 - DNA, 122 bp, Homo sapiens
tatcttcagagcttcccccctcagagctgagatgtgatagccctatttattggtttcctttataaaatcatggtgaaattcaaatcaccatttttttcggttttaaaaatcctttcttcctg

SEQ ID NO: 504800 - DNA, 287 bp, Homo sapiens
aggcggaggttgcagtgagccgagattactccaccacactccagcctgagacagacagggaccttgtctcatttaaaaaaaaaaaaaaaaggtctgaaaccaacagatgttggcaaagatccagcagaaaagggaccgcttgtgggaatttcagcccaccctttttggaaaacagaagggggtttcctcaaggggctaaaaatggaacttcttttccatccagcaatcccactactgggtttctccccaaggggaaggaaatctttttttaaaaagggaacccttgg

SEQ ID NO: 504801 - DNA, 518 bp, Homo sapiens
  misc_feature (268)..(268): n is a, c, g, or t
  misc_feature (463)..(463): n is a, c, g, or t
  misc_feature (473)..(473): n is a, c, g, or t
acaacatggggaaaatggtctctgcttcttacatcctccatagggagggcacatctcccattgacctcaggcccacatttagaatgggtctacagggggaaaagaatagagaatgcctgaccactatccagccattatggagctctctcctatcttaatctcttctcagttttgacctttagaataataatgttaaaaaaaaaagtaaggataataaaacttggttcttttttttggagacagagtcttgctctgtggcccaggctgnaatgcagtggtgccatctcagctcactgcaacctctgcctcctgagttcaagcgattctcatgcctcggactcccgagtagctgggattacaggcttgtaccaattcgccgggctaatgttggtatcttgagtggagacggggtagcatcatgttggccaggcgggtcttgaactcctgacctcaggtgatctgnctgccttggnctcccaaagtactgggataacacgttcgcgaggggtaccgagctc

SEQ ID NO: 504802 - DNA, 92 bp, Homo sapiens
atcgccccggcgatgcccatggacacgaaccaccagatcgggctgaagtattggggggcggtgggcatattcaagaagttttacaccaggat

SEQ ID NO: 504803 - DNA, 435 bp, Homo sapiens
  misc_feature (401)..(401): n is a, c, g, or t
ctagacattttctttgccggattgctgtggtatgctgatgcccactccagttgctagtcaccttggagtttctggtacctggaggtattaccaccaaaggctgcaaaacagtaaaaatggcaacctgcccctccctctgggacctccatcccagggaggtatggactttttgccagcctgaatgcatctgaaggagctggctggagaccccagttgggaggtcacctccagtgaggaggaataggatcagagacttgctttaaaaatcagtctcgccatgttttcatagagcagctctgctgtgctgggtgtctgcttcagccttttgtcacctcagaatctcaaagcgaaaagggtgaaacagctaagtcacccaaagagcaaagatggaggcctgcccntacccttgggagctccaactgaggaagtattcgg

SEQ ID NO: 504804 - DNA, 120 bp, Homo sapiens
cgatcgtgtcggtccggtgttccgtttgtctattcctacaagcattagatgtgttacaaaactgggattccggccaggcgcggtggctcacgcctgtaatcccaacactttggaaggctg

SEQ ID NO: 504805 - DNA, 149 bp, Homo sapiens
ctgacctagaggatcccggaaaggaggaggccagctgctctctccagaatgatctcaaccagcgtggccagtgagcactaattccaagaggcaggccaactggtccttgagaggaggagaagagcagactgctggctgaggaagcactt

SEQ ID NO: 504806 - DNA, 195 bp, Homo sapiens
aggcaccaaggaggccatgaccaccaaggaggcacatggacatccacttccatagcccggccttccagcacccgccgacagaattcatacgagaaggcgacgatagaccggactgtgtgccgggagatccgccacatctcgacgggctgcctgcggatgaaggaccagtgtgacaagcgccgtgagatctgggta

SEQ ID NO: 504807 - DNA, 102 bp, Homo sapiens
acagtggtcacctctccctatcaatactttttttaattctcgcattttttttcatttggggcccaacagtccagtgaaattgtaagcttcaactcaacagga

SEQ ID NO: 504808 - DNA, 619 bp, Homo sapiens
  misc_feature (326)..(326): n is a, c, g, or t
ggcgggatgtcacgctgatgccagtggccccactctgggctgcccagtactgtctacatagctgttacagcttgggcttgacaggcattacgtaggtgtaggagggcttcatcaccggccgtcgctcggacctcctcgccggacctacctactagttccaggttccgaatagggcatgatctcctgtgtgcccttcgtgttgagccctgcttgctttgtcatcgatctctctcatggtgactgatggcgggatgtacgtcttccagcatgctttgacctaagtaacgtcgggccagccgcgaaaactcacctcctgtcatcgtagncagcgtcctgtattagggtaggtgcgatggtggatggacctggggtgatacggagctgaccgcttcaatggacgacattgcctgtatgatcgggtaccgacctttgcccctggagtgaacatggtgctaggtccttcttcaccccgctggtctgcatgggcatcttcatcttcgaacgtatgtgtactacgagccgctggtctacaacaacacctacgtgtacccgtggtggggtgaggccatgggctgggccttcgccctgtcctccatgctgtgcgtgccgctgcacctcc

SEQ ID NO: 504809 - DNA, 278 bp, Homo sapiens
gcttggcacgaggggcaaggtgggtcacgcctgtaatctcagcactttgggatgcctttatgggtggatcacctgagttcaggagttcaagaccagcttggccaacatggctaaacccgtctctactaaagaatacaaaaattagccaggtgttgtggtacatgcctgtactcccagctactcaggaggctgaggcataagaatcattttaaccccggaggtggaggttgcagtgagccgacattgtgctcgcttattccagcctgggctacagagtg

SEQ ID NO: 504810 - DNA, 858 bp, Homo sapiens
gggcgcgcaggaggaagtgcgccgcgcgggacccgtgaggaccgatatccccgagcccactggagctacgtcagtctattcactaatcaaggttgctctggaaagagctaacaggcttctcactacctctatgatgagagcacacggcgtatcgatgaggcaccaagttcacctggcctcagaagaggactctttttgtcctcaattgtgcccaccatatctgcacatgaggagagcctgtcaccgccgtccgtgtcacagcgcctgtggcactcggtccatgtctgtcagagcttgtcgaggaggagagcctggacctgtgctgtagacgcccatagaggacgtcaaggtcgaagttttttcatcccaagaccagttccgggtttccaggtagcctatgtggtgttccagaagccaagtggggtgtcagtcggccttggccctgaagggcctccctggtggtgtccacagatgagccagcctgttgaagagtggcattcacaagtggatcagatgatctacgcagactctgtgcccgagcctgaggccctgagggtggaagtggacacgttcatggaggcatatgaccagaagatcgctgaggaagaagctcaggccacaggcacggaggagggggtccctgaggaggagggctggcgtgcaaggtgacctgacggggcccgggggagctgtgctcgcccgtactgatgtagcacactgagacgggttgctggagagggcaagacggaggtgcatggcgaaatagtagtctgttcaaatgctaggacctgggagcattcgaagagagcaagaatggagggatctatcgcagttggacaaggagttcgaggatggaca

SEQ ID NO: 504811 - DNA, 478 bp, Homo sapiens
  misc_feature (464)..(464): n is a, c, g, or t
ggagtcacacagttgtaaggcagtactatagtctagtaggctggtggatcgagaggaaggcagttaagctactctgaatgggaataaagcatctcagtctgaagggttgggggcagagaaggggccaccgacagtgtagaaattctatttattcccaggtgagggtaggtgggaagagagagaggtcagagaagaattgcgaacaaggcagaggcatcgggactggagcagtatggctggagccggtgtctgcaggatggagagcgtgtgaacatgcggggactggaagcggatctcccaggaagcagttgcaggcggtcatgctacatttgcagggcgacgggcggttgtgaagaacaataaccagaagagagtttgcgtcttcatcagaaagcacctggggcaggtagagttggtgctagcttctccatccatccctgacacccagcccattcatcattcangagaagacaggctg

SEQ ID NO: 504812 - DNA, 1244 bp, Homo sapiens
ggcgtgctcagagacctagtctgtcgctatcaccctttatttggagaaggaacgagagaaggaaattactgatgatgaggcaggaggaagagaaaggtgacgaaagaagaggaagcatacaagtatgatgacagacaacagcgcgcaagagtcgaaggatgtgggttcagatgaggaggcatgacgaggcgggtgaaggcaataggaagaataccaactacgcaagtatcaaacgcatgaaatacattgatcggtgcacacaagcgtactcaagagcaccgcctatttgtgatccagaacaccctgtatgtacagtcgatccagagcaggcacgtactggaggaaattctacgaagagtccgtcactagctgtacgtgggggacacggaccactgagggaggtcaagccactttactgatagaaggtcagttggcacattccagggcaatcgcgtgagtgttacttgccctcgctcggggggcatccccgtatagacccctttaatgtaagtaagcaatgaacgaaaaaacgcaacatatgagtcgaggaactcgtaatgttcgcggccgctggtggtttcatccagtggggcagccgagaccttgttggaatgaatgtttcgaataaacccacgattgtgaatacttccacattgtgtctactacctgctagtgttggtctgcgctatgaccttccgtggcaagggatctttgtactcaccttggacctacattcatctcgcggaagaacactttgcttcccaaggagccagtggagcgcgagaccaagtccttatgaaaaaggtgcattttccggcgtacaaaaagcaatttggtataaaatcacgacggtcggacctctggaaaggctttccttttccttccttgaagcgtggggccacgcttagaagccacggcgaagaaaattctcaccagatgacagacgtctcctaatatgaacgggaaattccctccttaagagagacattccttcaaattgctatgggaaaatttcccgaccgcatagggaccttcccacgttaaatacccggcgggatgacccttggttcttgggagggtgggctcgccgtcttaatccaagtagccctccccacaatgggtgctggggacggacttgaggaattgaagattcttcttgtccccaagttaataggtttttcctccgtctatggacgggaagcaacatccttgaaaggtacccttctataatttaccattgcggg

SEQ ID NO: 504813 - DNA, 148 bp, Homo sapiens
ggtcagtatccctcgggagccgttgacacaacccaaccagaaactgacatctcctcgaccgaggacttctgtgtaaacacgcgcaccagccacccgtgcggtccatactccttaccattctttgcttggctggccaaacaaaaacaat

SEQ ID NO: 504814 - DNA, 1226 bp, Homo sapiens
gtgggggcgttttcgttgcgtggcgtgtttcgtgggctcgttggggtgctttctgtttaccttctacctttcgtgcgtgttctctctgttccctgtgtccgtgtgtgtctctgtccttggtgtccagggactcggtccctcttttattgttgcgtccccgtttgagtttccatgctgtgtcctgtctctcttgttctctatcggtgtccgtcctttggttgtcctcttgtgcttcgcttttctttggtctgatctctgccgtttggtgggtgtcctctgtcggtggcccactgcgtgcctgtccctctaacccgtcggttgcttttgggtctgttcgtctcgtccttgcatccgccctttctctccatttgttgttggttttccaccgcgtggcgttggtttttgttggctacttctatgccttcgtgcttggtttgcgccccatcgtttctgtcggtttcgtcttgggggctttctctgttgttgatctctcggggcacgttctttgattccaaggtgtatgagattcctcgtcgtggtagcccccccccgttctctttcccatgatcggcttgtctgcccttggtggttgtctcggtttacccgctgtgctagctgtgtcacctagcccctgtcccttggtctccagtttctcttgtgggttcctgtagtattgccttaggggacgcttttgaagtgatgtgtatggtgttgcttgacgtggcccaggttttccctgtatatagtcggcgagttcttgaccttctcgcctctcatgccagacgtaagtctttacggcgcacctatgcaccaggatgggccgataagccatccagcatgccttccctgtcaccggctctctctgtccatgcctacctcgggtcctctcgggacttcactttcctgacttcgtttccttgtcagatacttcctggcgtcaggcgcctgcgggtgatggtgggctttagtgagaccgactgtccgtcgtcgggctgccttgctcctccagttcgctgttctggcttctccggtttaccgcacagtgatcctcagcagatgaggccactcgtgccacgaccatgctcatgtggtgtcacccagccgccacaactttgtttcgatgtcactgcctgatcgacatgatatttatattcttgagattttctaccctcactagaagtgtaaacttccatgaaggcacagacttttcttgttctcttactccc

SEQ ID NO: 504815 - DNA, 932 bp, Homo sapiens
gtgctgcacggggtagtgctggcaggatgaaagtagcactatatgcagcagctgtcagaccgagaagcacactcccgagtcctgctttgattgagcgcagttatccaggagctcaagagctcgccgaagaggctctgacgggatggccggaagcggaagggatggtcactggatgttgtggctgctctggaactagctggtgcgtgatgcgcatccctttgcgagaagcgagtcatgcttatacaaccctaggaagtggtgtgcatggggagttatctagtcgtgccgttcgagtgaagaaaccgacagggaaggtctgtgctctggacgactccttctagatctcttgctgcctcgcctctggctcagaagacggaggaatcacattgtcttgaaccataggcctgaggggttgtgacgaggccctgtgattgaccgttggagtacgtacgattgaacagagtactatagccatgcagggtgatccactattgtcatgtgaggtccaagctcagacacgtgatacccgatcgaacacaaagcttcagcgcttcatcatagcctttcgaggggagtctctctcttgatgactatcttttgtaaccaagtcgggaaacgaatggaacagcagtatgtatacctgcctcccctgggcattcgtgacgcatggcttcgctgccggagaggtacggctaagcttctgggagaggagtcgcggaaaagatatcagaatacatggtggctggagaattgcggggctacttccatgtctgatgggtgtttgacaagcgtcaagattatgtcttgtattggcactcacttgtgagtcagatttgttactgggttggagcctcagtggtttaaaggagctgaaattgtcagtcatggggaagggcaacgcaggcaggaagtggaggagatcttaaaaattt

SEQ ID NO: 504816 - DNA, 85 bp, Homo sapiens
ccttccctccatccccatccacacaactttttttgtgtgtgataaactgattttggtttgcaataaaaccttgaaaaataaaaaa

SEQ ID NO: 504817 - DNA, 886 bp, Homo sapiens
  misc_feature (378)..(378): n is a, c, g, or t
  misc_feature (461)..(461): n is a, c, g, or t
  misc_feature (632)..(632): n is a, c, g, or t
  misc_feature (750)..(750): n is a, c, g, or t
  misc_feature (775)..(775): n is a, c, g, or t
  misc_feature (779)..(779): n is a, c, g, or t
  misc_feature (785)..(785): n is a, c, g, or t
ggaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggcaagattccagcatggctgcagggaaccctgctccgcaatgggcctgggatgcacacagttggggagtccagatacaaccattggttcgacggncttgccctgctccacagcttcaccatcagagacggtgaagtctattacaggagcaaatacctgagaagcgatacctacaacancaatattgaggcaaacaggattgtggtgtctgagtttggaacaatggcctatccggaccctgcaaaaacatattttccaaagctttctcctacttgtctcacaccatccccgatttcaccgacaactgcctgatcaacatcatgaagtgcggagaagacttctacgcgacnctcagagaccaattacatcaggaaaatcaacccacagactctggaaaccctggagaaggttgattatcgtaaatacgtggcggtaaatctggcaacgtcacatccccattatgatgangctggaaatgttctaaacatgggcncatncattgnggaaaaggggaagacaaagtatgtgatttttaagatccctgccacagtaccaggtaggccactctggggaattgaataaaacacaaacaaccaaaaaaaaa

SEQ ID NO: 504818 - DNA, 127 bp, Homo sapiens
tgcaggagtaactgggaacagggtcagaggtgtcagagctgtgccccacatctgaaacaccttctcaggtcccggcttcgagacccatcaagccaggaatgttcggttatgggagagtgccttgcat

SEQ ID NO: 504819 - DNA, 134 bp, Homo sapiens
atgactgaaccacagacatgacagtgagcttccagctctgctgctgcgcagcatagtccagatagccacatagatggaacgtggcatcagcctccatcttctcctcaagggacatgatcaccgggccagcattg

SEQ ID NO: 504820 - DNA, 692 bp, Homo sapiens
  misc_feature (130)..(130): n is a, c, g, or t
  misc_feature (692)..(692): n is a, c, g, or t
agttagagaccagcctaggtggtgggtgtctgtaatctcactatgagaactgcctgaatccaggaggcagaggttgcagtgagccaaattcacaccatgcactccagccgtggtgacagagtgagacacntgccacaaaaaaaaaaaaaaaaaaaaacaaccccttttgggaacacttacacacaacgagaccgggccaaatggggtctcaagtcgccacccaagcattgtggagaaggcggtgagagcgcggaagggaatggcccttgaaaccccagggggtgttgcggaacaccgtcctctgggaactattattgggaggcccttgggttcctttccaaaacacaccattttaacaacggcgggtggttcactttagagaaacagggcgaatacctagggagcacgagagcggagaccacactagccgccgttgtctcacatcgtgtaaaggacgccaagggtttccaccaacagggggtgtattcacacttggcgctcgggcttggttgcaggccccgtggtgcactcttttttgtgggtttttcaaaaaacacacataattatattttacatttatcggttcacagaacacttttttaagagaaaccaacagccggttaaagactacagatgggtaacacggcatgggtttttacaacccagtgggtttctatttctaacacactatn

SEQ ID NO: 504821 - DNA, 1293 bp, Homo sapiens
aaggcgagagcggagctccaagcccggcagcccgagaggaagatgaacagccccagccagagcctctgcagagtggaccccgagccgcccccaggtagccaggagcggcctcagcggcagccgcaaactccagtagccgcccgtgctgcccgtggctggggcggagggcagccagagctggggaccaaggctccgcgccacctgcgccacagcctcacacctgaacgctgtcctcccgcagacgagaccggcgggcactgcaaagctgggactcgtctttgaaggaaaaaaaatagcgagtaagaaatccagcaccattcttcactgacccatcccgctgcacctcttgtttcccaagtttttgaaagctggcaactctgacctcggtgtccaaaaatcgacagccactgagaccggctttgagaagccgaagatttggcagtttccagactgagcaggacaaggtgaaagcaggttggaggcgggtccaggacatctgagggctgaccctgggggctcgtgaggctgccaccgctgctgccgctacagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgc

SEQ ID NO: 504822 - DNA, 214 bp, Homo sapiens
gtcttgagcagcggcatgacttcctggcaaatcgcgaggaagtgcgacgggtcgcgaaacatctcgctcaccggaatggtcaagaactgcagcaactgcatgaacgcggccgggtcgtgcaacacgcgctcttgcagtgcggaaatggtcgcgcagtcgaactgacgcaaggcatgggccacacggcgtttgaccgacgcgcccgagtagtcgc

SEQ ID NO: 504823 - DNA, 214 bp, Homo sapiens
agcatccatttacttgatgaggatgagcgtcagcgactgcataaagcacacctgctgaaaccgtatttgaccacgcgtcaccaggaaatcgacgcgtggaatcagcaattagatgcgcctgaatcggtattgaatcaccgccaaatgaccaatattggcaccttccgcgcttatctgaacgaatatttgcgtcatcacccgcgtattcgcaaag

SEQ ID NO: 504824 - DNA, 887 bp, Homo sapiens
cggtctgtatgttgcgctgttttgtgttgtcccccgtagttttttcggtggaggtggctgttgggaccccctttggtcaagcgggtggttgttcggatgttttggttggcccttcaggtgacgtgcgcatgtctggtgttaaacgacccgggggctctttgtgtgagtcagtctccaatgatgggggtgcgcccacgggtgcgattgccgcttcgctgttgttgggccccggcttgatccccgggccccgctctagggtggatgtcccccgcgccggccccgtgtgacactcgttgggggacgttgggtccgttgtttaagaagcagtattttttgccctgaatgcgcccacacacaaggtcagtgttcacctatactttctactcccgttccgagccgcaaaagtgccgcccccccttggtggaagagtgcccccaagtatgttgctcgcacacaataggggtagtacaccgcacattagacgaccggcggttagtaaagagataggaccacaaaacatcctgtgcgcacacagtggtcaccctcgtacgcccacagaaacttggtttgatgatacgttgcacctttaccgccgtgtaccgaccccgatccacatatccccggtggtggttataaagtcttatgtaaacaaccacaatgtagggatgcggcgctagaaatacccctcctcggggcatgggcatatccgcccccataatgaggtgatccccctcttaaatgaagcctccttaatatttgacaccttgctaacaaaaacaaccatttctaacagctcaccaaaggcaccacttattcatttgcataattcggataaagcctttaaaagcgaaattcccccccaaaataaatataaatgcaaacataac

SEQ ID NO: 504825 - DNA, 106 bp, Homo sapiens
tgcctctacacaatgtatccgtgttggctctggaagcggctgcagttgcggtagggcatctgttcccgcctgcccggccactagctgcgctccctggaggaggagc

SEQ ID NO: 504826 - DNA, 381 bp, Homo sapiens
atgtcatatcaacaatgtgaggtccattttggagcaaaacccttcaaataccccccctctatggaatttagcccttttaatggctacgccttcctaacagctgaagaaaaaatccttttgcccaggccccggcgtcttgctctgtttaagccagtcaggatcccagaaaactgctgttccctttgttgtgatgaggtagcagaccccccattgaagccctgtgggcccagtgacctgtgcatggattgtgccctgcagctggagacctgccccttgtgtcgtaaaaaaataggatttagaatccgaccgatttttcatatttcctgacccatgtgaaaaggcctcgtgggcttttttttactccattcccgcccatgttta

SEQ ID NO: 504827 - DNA, 850 bp, Homo sapiens
  misc_feature (39)..(39): n is a, c, g, or t
  misc_feature (72)..(72): n is a, c, g, or t
  misc_feature (78)..(78): n is a, c, g, or t
  misc_feature (101)..(101): n is a, c, g, or t
  misc_feature (122)..(122): n is a, c, g, or t
  misc_feature (149)..(149): n is a, c, g, or t
  misc_feature (175)..(175): n is a, c, g, or t
  misc_feature (178)..(178): n is a, c, g, or t
  misc_feature (197)..(197): n is a, c, g, or t
  misc_feature (216)..(216): n is a, c, g, or t
  misc_feature (224)..(224): n is a, c, g, or t
  misc_feature (271)..(271): n is a, c, g, or t
  misc_feature (275)..(275): n is a, c, g, or t
  misc_feature (288)..(288): n is a, c, g, or t
  misc_feature (322)..(322): n is a, c, g, or t
  misc_feature (328)..(328): n is a, c, g, or t
  misc_feature (330)..(330): n is a, c, g, or t
  misc_feature (340)..(340): n is a, c, g, or t
  misc_feature (359)..(359): n is a, c, g, or t
  misc_feature (374)..(374): n is a, c, g, or t
  misc_feature (376)..(376): n is a, c, g, or t
  misc_feature (451)..(451): n is a, c, g, or t
  misc_feature (460)..(460): n is a, c, g, or t
  misc_feature (547)..(547): n is a, c, g, or t
  misc_feature (570)..(570): n is a, c, g, or t
  misc_feature (582)..(583): n is a, c, g, or t
  misc_feature (640)..(640): n is a, c, g, or t
  misc_feature (651)..(651): n is a, c, g, or t
  misc_feature (657)..(657): n is a, c, g, or t
  misc_feature (661)..(662): n is a, c, g, or t
tgtaatcaccaatagtaaatgaagatgtttatgaactgncattagaagctttctaaactgcgctgtgtgatntgttcnatctagcctaggggaggacattncctagagggggagggactgtntgggttcaggggcatggcctggagggntggtgggcagcactgtcaggcacagnttnccctgctgttggctttctnttttggttattaagacttntgtattanctttctttgctacctgtcaccccaggggctcctgagtataggctttncagnccctgggcagtgnccttgagttgttttttgacacactaacctgggcnactctntnagcattagcntctgacctggagcaagcangcccgaccccccccncnaaacagcttagtgttattctggcatttggtaaaagctggcttaatctgtttaatgtttatcagtacattttaaanaggggcatngaaattaactcccaccaccagggcttttatgggggatgccagggcctttaaaacactagccaaactctaattaattctcaaatcacngccaggagttcttgctcctggcngcaggcccaggnnccaagatctccttcttggggttacaaacagcagtaaggaagaggaatatatagcaantcagggcctgngaattntggnncaatccgttcttagggactggatacttctggctggctgagtatagtactagctgcctccccaccaggttccgagtagtgtctaagactctgtctctccagccttaggttagcctggaagtttagatgtggcctcccctaaactgttttacactaaacagctttttctaagggagagacaagggggaga

SEQ ID NO: 504828 - DNA, 920 bp, Homo sapiens
taaccagcccaacacacaaatcgactagtcgagctgcgtgtaatcggccgaggctggtgagtcccgggcagccgtcctgctagcgccgactcctgcgcctgccattggtctcctcacatgcggaaacacagcttgtgagtgcatgtcagctgttagcaagtggttttgagtacattctgggcttggctgtatctatctagtgcctgtttgtgcgtctgtttctttcttccgatgcttccccattttccttctgtcctttattctcctgctccttgtattcccacgtcacgcacagtggggttcctcgagaggacgcgtgaggtgggccgccggtgcgcggggcgttaggcgctgcggctgctgcgtcatttttacctttgctttctcgtttacctttagacagctggccgcaatctccagtgcgtagcctttcagttccctcagtgcttctcttctgacctgcaatgttgaagttctgtaattgctggggccttccaacaaagaaccagagtgtcacttgacagagggaagcagacagagtaccctgattggtattcagctgatgatgggagtatagagacattcaggagggcacctaggttgttcacaacgtaggaataaggaagtactctgcagggatcctttccaattcctattgtagagggagtcctgtgtccatgaccccctcccgagtgggactgtccacagctcgataggctcacacgagaacccgtagaggctgaacatggggggctatggagagcggtcagggagtcctacggcgaaagatgcagtgatgcttgcttgctttccccgtgtgtgtgtcccagctagtgcactcctttcgccgcgcgtggtgcccgctgcctctctggccttgggtgcgccgcatgggccgcgggttccttgtctacctgagc

SEQ ID NO: 504829 - DNA, 705 bp, Homo sapiens
  misc_feature (141)..(141): n is a, c, g, or t
gaacacctatggcctttgaagtagtgttgggtcaggagactgtctcctcctccggaggaatactgaagacaggaggctgtcacatcgtctctgacatggagagtggcttccggccatccgtaggggaagacacagagctcntgagcccccttctagattcaaggttggcgttttacggggatggaggaggtagccaccaaaagggaatgatttgcaggccaccagaaatgtgcctgaggtcccacctgtggaccctccattttggatcctgttccctttcaatgccagtactcttttttctttttttctttctttcttttttttttttttaaaacgggagttttcttctggttggcccaggctggcagtgcagtgggcatgatctcagctcactggcaactggattcaagcgattctccggtctcagcctcctgagtacgctggggataacaggcgcccgccaccatgcccagctaattctggtgatttctaagtgaacaacgggggttccaccatgttgggtcagtctgagctcgagctcgggacctcgggtgatccacccatctaagcctcccaaagtgcgtgggattaccagatgtgagccaccgaacctggcccagaactcttagaaagtagaatcctcagggttgaacagagtttcagggatttcgacaggttatggcagaagtactactgggtccctac

SEQ ID NO: 504830 - DNA, 962 bp, Homo sapiens
  misc_feature (1)..(1): n is a, c, g, or t
  misc_feature (103)..(103): n is a, c, g, or t
  misc_feature (105)..(105): n is a, c, g, or t
  misc_feature (173)..(173): n is a, c, g, or t
  misc_feature (175)..(175): n is a, c, g, or t
  misc_feature (179)..(179): n is a, c, g, or t
  misc_feature (183)..(183): n is a, c, g, or t
  misc_feature (286)..(287): n is a, c, g, or t
  misc_feature (292)..(292): n is a, c, g, or t
  misc_feature (294)..(297): n is a, c, g, or t
  misc_feature (299)..(301): n is a, c, g, or t
  misc_feature (303)..(303): n is a, c, g, or t
  misc_feature (306)..(306): n is a, c, g, or t
  misc_feature (330)..(330): n is a, c, g, or t
  misc_feature (378)..(379): n is a, c, g, or t
  misc_feature (386)..(386): n is a, c, g, or t
  misc_feature (388)..(389): n is a, c, g, or t
  misc_feature (391)..(392): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (431)..(432): n is a, c, g, or t
  misc_feature (921)..(921): n is a, c, g, or t
ngtccggaattcccgggatcagcgccgtgctgcccgtccatgtgccctggggcctctgcgagcttgcccgcctcattggctttctactcctggtggccaaggntnttttcaagcagtgtagtaactcatctggtcgtctgtaccgcctccccagtgccgagacaatgaaggananatcnctgnggcggctctcctgtgtcaccaagtcggcggcctcctccttctattccatcattgtatcagtcttctttctatttatatagacaccaccaccagcacagagcannttttntnnnntnnnancgntgatgtggtcttagaggcctgcanagacttctgggacggagctgacatctaccctctctcgggatctgacannaagaaantnntnnacttctaccagcgntnctncctgtctgggtattgctctnncttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtnccgagatgatgcagaagggctcctcctcatggaggaggagg

SEQ ID NO: 504831 - DNA, 711 bp, Homo sapiens
agtccgctgggaatactgcaggatgctgtccgtcgcgtgctgcggcgggtccgcgcccttcctcggcggcgaccggagtggctctccagaaatgcttcggagttcagtctttcattgctgcacggagacttccatgcctctaactactcatcttcgaagagatacttggtgactgctggagatgttccgtctattcgttggaagtagcgtatctcttggagcgtgatacctctgtctggatcttgaagaataggtgcggccgtgtcttataaagatattggtgatggtattgccgcgcgttacagtggtgcgtgagtgacagtcgttcaacgcagaagaaatggtaggaggttttcttcagggcttagaaggggtatgtccttgaacttggaacctgacaactgtttggatgtttgtcagtgttatggaaagtgataaagctacattaagcggaacggatgatatacgtgaagaggacaggagccattgtggacgttccagttggtgaggagctgttgggtcgtgtagcttgatgcccttggtaatgctattgatggaaaggcgtccaattggttccaagacgcgtaggcgagttggtctgaaagccccggtatcattcctcgaatttcagtgcgggaaccaatgccgacctggcattaaggctgtggatagctggtgccaatggcgtggtcagcgtgacctgatatggtg

SEQ ID NO: 504832 - DNA, 174 bp, Homo sapiens
gatggcgatgagtttcgagtggccgtggcagtatcgctttccacccttctctacgttacaacgaatgttggacactcggcagacgcagctggccgcctggtgctcgctgggtctgtccttctgccgcctggcacaaacagtccagcatgacggtgatggaagctcaggagagcc

SEQ ID NO: 504833 - DNA, 167 bp, Homo sapiens
tagacaagatggccagatggtatgccatggtggcataagtggcaccatatacgagtacggagcccttcaccattgatggggaggagtacatccccttcaatgcagtatgctggcaatacgtcctctttgtcaatcgtggccagcctactgtaggccatgaggggcca

SEQ ID NO: 504834 - DNA, 336 bp, Homo sapiens
gtaaaccaccaaatctgattacctctacagacttacctattctgcatatttcatacaaatagaatcatataatatgtgacctcttgtgtctggtttcttttacttgacataaatgttttttgaggtttgtccatgttgtagcatgtatcatctgtacttcatacctttttatggcagagtaatattccactgtatggatacaccaccatttatttaatcattcatccaatggaagaaataggctgctgcctgccacctactggctattgtgaatagtgctgcaacaaacatgcacgtttaggtacttttttttttttggaaacggaaacaggataa

SEQ ID NO: 504835 - DNA, 119 bp, Homo sapiens
aataaaactctctctgtctcccagcaggagtgagatggcgagatctcggctcattgcaacctccagttcaagcgattctcctgcctcagccccccgagtagatgggactgtaggcatgc

SEQ ID NO: 504836 - DNA, 313 bp, Homo sapiens
ccaccattgagtctgtcttcccaccacactatattgttcccaaagtatcaaacattattttttgtttttgagatggggtctcactctgttacccaggctagagtgcagtggcatgatcatggctcactgcagcttcagtcaacctcctgggctcatgtgatcctccccccccagcctcccaagtagctaggaccacagacatgtgccaccatgccctactaaaattttaattcttttcgcagagacagggtcccactctgcccagggtgatctcgaactcctgacctcatgtgatcctcccaccccagccccc

SEQ ID NO: 504837 - DNA, 308 bp, Homo sapiens
tggtaagtaggctgtcctgttctgagagtgggttgagtctggagtggctgagcaggggcagcatgagaggagatccataggttgccgcaggtccaggtcatgcagtgacccgtgagccccgatgaagagcttgagttttcattccaagagcagtgggaagcccctgcaagctcaggcacaggagaggtgtgacccgaggtacacctaagaaagatcactgcataggcagcatggagcatgagtcccctggagctggaggcaatgcaggcagggtggataggaggcaccgtggtcatccaggagaggca

SEQ ID NO: 504838 - DNA, 481 bp, Homo sapiens
  misc_feature (11)..(11): n is a, c, g, or t
  misc_feature (97)..(97): n is a, c, g, or t
  misc_feature (99)..(99): n is a, c, g, or t
  misc_feature (114)..(114): n is a, c, g, or t
  misc_feature (127)..(127): n is a, c, g, or t
  misc_feature (160)..(160): n is a, c, g, or t
  misc_feature (198)..(199): n is a, c, g, or t
  misc_feature (216)..(220): n is a, c, g, or t
  misc_feature (223)..(223): n is a, c, g, or t
  misc_feature (227)..(227): n is a, c, g, or t
  misc_feature (229)..(229): n is a, c, g, or t
  misc_feature (250)..(250): n is a, c, g, or t
  misc_feature (252)..(252): n is a, c, g, or t
  misc_feature (255)..(255): n is a, c, g, or t
  misc_feature (262)..(263): n is a, c, g, or t
  misc_feature (270)..(270): n is a, c, g, or t
  misc_feature (285)..(285): n is a, c, g, or t
  misc_feature (302)..(302): n is a, c, g, or t
  misc_feature (323)..(323): n is a, c, g, or t
  misc_feature (327)..(327): n is a, c, g, or t
  misc_feature (337)..(337): n is a, c, g, or t
  misc_feature (361)..(361): n is a, c, g, or t
  misc_feature (388)..(388): n is a, c, g, or t
  misc_feature (426)..(426): n is a, c, g, or t
aagagcaaggncccgtcccagccatccaacactctgtccttccctgccccaggatggacacccaacatgtggagaagttgctcttgaagctgctcantnggcctcgttgaagcnggtcaccattgtnttgtgcagtgtctccttgtaggactcggttgangtgaccccgtaggagctgccccgtgcacccaggccggnnccccgcacccgtgtttnnnnntcnatangngttacaatgccctgttttttntngcnaagggcnntgccctnttttcagcccatggnctgcagcatccgactgnaaatgttgtaaatgcccagcncgtnccgagtaggntgctcgaagtctaaagaggctgtngatatgccgccgtactttctctttttnggttttgggggttcggggatgccatatttttttttgcntttagctgcacggtcccggtattttatttgctccatgttatttttttctagtgct

SEQ ID NO: 504839 - DNA, 839 bp, Homo sapiens
gcctcttcctgatgaccccaactcagaattcactgtttaccaaacacctcggtcataataatgtcattagtttctccatttttattttctgaactgtacattcacaacttatgtttctttgagattcaatagatattgggggaaaaacgccttttttaggaaaattatagtgaaaattgacagtgatggcataatttcttgtctgaatgctgcctccatttatcataggtccttccaggcaactcaaacactgtaagtgaaatatgggagctatagtctttctattattctcttcttttcctttgttttcataattcatactgcagtctgtcaggcaaatcagcacacagcctgatagtactttactaaaatgactgcattcttggattccttcagtctatggttcaagtcactaaagattcatttcgtagagtccttatgacgaaacagcagtatgaatcttgacggtttctgccagtcttattggccacagctctctgacttggtgtctgctgccaggctggtacttcattactctgtctccctgtctgctttacaacttaggaatcaacatacattttcacaccatacatttttacattggtaccgtcaggactcagtactttcgacttatattgatgactccggccgcatactaccatctctgggtcttgccctaccctaattgttgtaagcaaattattcgcgtccacgcgggtggctcttcctctccaatgggcatcattcttcactctgatgtaagcaaagcttacatcatgaaaacgcgattgctgcagtgtcaccgtgcaactacgacaccacacactacacacagcgac

SEQ ID NO: 504840 - DNA, 310 bp, Homo sapiens
ggtacagagtgtgaatccccatatccttggataagatcttcttgctcatcttcctctttactagacttctagcgcttcccataaaggctagcttggccttatcttcccactcttcttccgtgaggtctgttggctgtcaggagggggaggcgcaaggcgaatgtttcctcatttcgagacattagctcgctgcttttctatctctctctttctggcacttctagactgtgctcttcattcttgagttgaaatccgctgacgaaaactcacaggcttcctattttcatccacctcataatcctcctcattc

SEQ ID NO: 504841 - DNA, 307 bp, Homo sapiens
tttccggatgggggggaatcccccccaaaatatgtatgtgtgggcctgcttagattactaaatttcatagttaattttttgtttcccccggggctcctaatgtgtggggcccccggaaggcctttctgtagtccgtccttttggtttttttttataccccttttttttttttaggggattagttatgaagataatattttttttttgttaattgctactttgttttttatgcatgctttgtaattttattttttttagtttttgatttgggttatattcccctttttattaaccgttttagggggga

SEQ ID NO: 504842 - DNA, 539 bp, Homo sapiens
tttttttttgattacttgtactgacgtgtattttctaattttctataattacattgtaaatctgtgtaattttaaaaatgaggccgttcatcattggagaaaacacgacacgtacgcttaagggcagacttaaggctcttaacatttttaaagcaaccaaaagaggcaaaatgtagactttaaaacacaaaaatgtgcttttctgagtgtggcacagactccaagcccacaacgtctgaggaagcgtacgggatcagaaccagcagctccgttcacagccaaactcgccttcaaaaggcaaggagatggcgcgcaagctcagcccctgaaatcacacacgcggggttgaacgtgagtaactcagcccatcgttccgcactgtgaatctgctccaatacctgcagagacaggtccagctcccactacgagggcccaccgaccaacacggtacaccgagggtgaaaaagccacgaccaggcccgcctggaaaacaccatcagctcctagaaatgccacttccttccttcttccgccgtttt

SEQ ID NO: 504843 - DNA, 1200 bp, Homo sapiens
aagttcatgaaacctgggaaggtggtgcttgacctggctggacgctactccggcacgcaaagctgtcatcgtgaagaacattgcatgatggctcctcacgcatcgcccctacagcccatgcctctggctggcctgcacatcgacccgctacccccgcccacagctgaccgccctcccactggcgccacaccacagacaccactcgcccaacaccactcactccgactaacacactcctctcctgtgaaacgctgctactacacctacaacctcacccctacactcgccccacacaggctacctcctgcctcgcgactatctccccctcgcgccccaccacacctgctccgcctcaactcacccgcctgctccccctccgccaccactcccgtgccctctcctcccccggccctccgcccccgccccgcgccccccgccccaccgcgcctcccaccctcccgcaacccacgcagccctcacccaccgcactacgcccccccccccacccccaccgtgcgcctcccctctcccccaccacccccctgccgccgctctctccccgcccttgcccctctgctccccctgcactccattctcccacccactctacttcgccaggcagcccgcgccagcggcggccagccgccttaagccgcccgccgcgcccgcccccacctcccccgcacacacagccccatcccgcgtgcgcgccgcccccccgcccccgcccctctgcacgcgccccacactcccccccagccacacgcgcatgcccacccaccaccctcacacccccacacgacacacaacacacccacgcgcactctctacctgcccacacaccaacacctgagcacatctaacacacaaattcacaaacgcataacctcctaccgctcacccgtcacctacaccacacccagtcccctaccacccccactatatcacacttcaacttttcacggtcgcgcgcgcgctcagacgcgcgcggcacacctcaatataacaccacccctacccccccccaaccccaccaaccaacacaccacctccaccacccctcaacaccctatccactccacacactcacaccaccacccccccccaacccaaccccctccacacccccccccacccaacaccaacaccccccaccaccaccaccaaccacccccaccaccccctcccccactcacatca

SEQ ID NO: 504844 - DNA, 783 bp, Homo sapiens
aagttgtgactgctcttgtctttggcgctaacggcggctggctggccttgtgtaagactccagaactccccacttgccgcgttctcgccgtcgcaggctcccgtgacgatggtgccccgcctgctgctgcgcgccttggccccgtgggcccctgcggttggtcctggagagcccccatgtcaggcccccttcatgctgccgcgctcgctgtggccacggtccgatgtaccgtgcatgcgcaaatatcggtgcccactcgatgcactagccatggactgcctgccccaggcgtgctctattcccaattttgaggacacccatttaggagaatacctcatgtgcacagaagccctcatctttgaagtgattggcccaggttcaggagcaaccacgaatcaatttccgcaaacggagtttgtgcacaaaactcgggactgggagatacatgaacttgcattagagcaggacttggtatgctcgtggacaacagcaggaattagacattaccaaggcatactatttttggagaacccctggcctatgagtatgtacctattctgcctcggagactccgtgggatcctgaacgttttaattccattgtatggctttcattccttgacccaagagatctgagtataagtgaccagctcacccggggtcagcaacagtgacctgtttcttgccatccggctttctgaaggacaggctccggggctggccttctggagcctgaagttttccccttaaaccctcaaaagtggcctatcccttttcgagatcc

SEQ ID NO: 504845 - DNA, 705 bp, Homo sapiens
  misc_feature (340)..(340): n is a, c, g, or t
ggggcttttacctacttacacgagcgagagggcgctgtatatccatcatcaggactctgaccagccaccaaatacccccagagcctcgctcttgtagctcatgctataatcccgacatctctgatcccacaaatatagactgatcatatgccagcccatgtccccaccatttctcgaaagattcaggtgtattcaatgagactacatgctctggcttgcaatgattatcccagacatctactataggcataacgaaactaatggttcgcctatagatttaacacccagactgagagtaaagtgttcaattgaacagcgtcttgatgcgcgtacacacagncgagttaacctcttgatgaatacttgaaaggacatccaaataaaggccttactggttcatatcgccgtatcgtgtcggaacttgcaatagactctccaaagggttctagcgcgaacactggaaaaaccctagcgtaaccaacctgttgtggtcgcctcgatccaccttctctagatggagtaaataaagaggccggcaccatcagccttccttgacctattcaccctaaatggataaggtaacaagtaaccgtaagatgtcgtcaacttcgcggttaagtaaaccctagcgatcccaattttaaaccaataggccaacatccgcataatcccatgtgtgttaaaagaaaagagcggcgtacggtt

SEQ ID NO: 504846 - DNA, 159 bp, Homo sapiens
  misc_feature (33)..(33): n is a, c, g, or t
ccctagtttagaagttcaatagcagttaacaanggtaaagtgttttttatttatttttgagataaggtctggttctgtcggccaggctgcagtgaataagtgtgatcttagcttactgcaaccctctgcctcccaggctccaagcaattcttacgggga

SEQ ID NO: 504847 - DNA, 195 bp, Homo sapiens
ggccagtggtatggaaatgcacaacaaattggccagtatatgcctaatgggttggcaagttcctgcatatgggatgtatggccaggcatggaaccagccatggatttaatcagacacagtcttctgcacatggatggaccaattatgagtcaccgcctcaggcaaatgcagcatgtgcccatcagctctggtatc

SEQ ID NO: 504848 - DNA, 1131 bp, Homo sapiens
gaaggatcgcaggcgagattacgatggcgaggctcgcgcgccctgacacccgaccatggtccccgagtgcccaccacggtctggcccggcacagccatgatcaaggcgatccgtaagtcttcaagcaacgcacgggcacgccgcggactctccaagcttctaccaggccctacagtgagagatacacaacagcgacatcatcagggagactttccattttggtatctaagagagaatgcacacactgcttcgctaactctccctagcaaggcacggactcatcacattggcacggatctgacacacaacactgcactatactacgacatctatcgcaacgtccctactacagctcttctgtgctggactctcttttcacgcaccgctgacaccttgccccacctccacacgcactctacactcccaacgctacctctgcctggacaacccacttagcaccacaatgtttaagacacgcctgctcccgctgcaggcctgggatcttggactattaacacacatgcctcacgaccccaccagccgcttcacccaaaaccagctcaccattaggcccaccaccaccttgccgccggcctgcggaggcgcacagtgcgctacctctgcgaagaacacaacaagtacatcgacattgaagaatttgtataccaccaaagcattcgaactggaccaccaccacactacacggcctggcacaaccacttcctcgcacacgcagtgggcatctaagtcacgaccaatgacctcccgaagaccccaggttgcgctaggccattcacaacgcagatcggtcacagagcaaagtactcagaacgtcctctctcctgcagaaaaaatcgccctacgaaccatacatacaaaccactatggcatgacacataccagtagcacctacaacgagtacgcccacacaccaccagccaccatcagtcggaacacacacccaacatcgcacccacacagaggcccgccaaacacaagcgacaaaaacacccacgggcaccaccagaaggcacccacgacacgatcacccacagtaaccccgaagcaacgaacgcacgacactcagtccgcagacaacagacacacaccacaccccgaccccaggcacat

SEQ ID NO: 504849 - DNA, 198 bp, Homo sapiens
cttccgggagctggagcacagatgcacgccactacgctgggctagtaacagtgcacctggaccacttagaagtaaaagctgctggccaggttaccttgcatagaatttaagggttcaagaattgaggattattttcaacctgagaatctcaaggtcaaagccttttagtttgtttcttccttgagacactataggaag

SEQ ID NO: 504850 - DNA, 162 bp, Homo sapiens
tcgtccgtcatttaacgtatgcacataattggagggcattggattacgcaataccaaaagttaatcgtacaacgttcggccatgccccacgttccgggcatcatgttatattatttaccccagtttgtgcattggggccatttagtatgactagccagcggc

SEQ ID NO: 504851 - DNA, 862 bp, Homo sapiens
ggaatcggtgcgccggtgccgtcgtgcttgatgagtaggcttgactagtagtcgtatggctgaggttctggttacccccggctgtatgggcatcgaggatgtacctgccgtaaccagctgtggcattcgaggtgcgtgtgttacctccagcctcaccaaaccatcagctcgcctgcctatagtgaagatgaccacgaacctgaaagagcccgccgtggcatcccagccttcctgatggccgcttccatctgtccgccccgtaatctctatcgagcctcgcgacccatggtttgccagctgagagagccaaaggagaagtcctctcggaaggtagccgagccaggagctgatgggaacccctgatggctacctgctagcctccacaccagtagcgagacaggcatctccccagaacctggggacccctggcttgctgcagcgccacagatctcactccctgcgtgcactcattagtgggccaacatatcctgtccgtccagcagtatacaccaaggatcagatgtctcacctgttcaatgtggcacacacactgcgtattgatggtgcgaaggagcggagcctcgaatcctgaaggggaaggtcatggctccatgttctatgaagtgagcacacggaccagcagctcctttgcatgcagccatggcccggctgggaggtgctgtgctcagcttctcggaagccacatcggtccggtccagaaagggggaaatcgctggctgactccgtggcagaccatgagctggttatgcgaacggtcggtccgtgctccgggaccccccagctggaagcgtggagcttggccgccaaccttgccggaggcccgtgatcaggccggggatgg

SEQ ID NO: 504852 - DNA, 297 bp, Homo sapiens
catcccccgtcgcggcaggcatggtggcaggcacctgtaatcccagctacttttgagtctgaggtaggagaattgcatgaacctgggaggtggaggttgcagtgagctgagactccaccattacactccagcctgggtaacagagtaagactccatctcagaaaggaaaaataaaaaaaaaaatgggtcccttccttgactcctctggcccttaaggaggagttttaaattttgggcccaagttcaaagaaacccaaacactgggcctttcctgtggggcccaaaaaactttcttcc

SEQ ID NO: 504853 - DNA, 835 bp, Homo sapiens
gagacgttcttcgccgagagtcgtcggggtttcctgcttcaacagtgcttgtgactggaacccggcgctcgttccccaccccggtcggccgcccatagccagccctccgtcacctcttcagcgcaccctcggactgccccaaggcccccgtcgcctgctccagctgccttagcaggcctacccagtccgccgccagccgccatctcacttagtctgccgccattgacggaccgacgtccgaccatcgcagagtgcgccataaactaccacgcaggaactccagaggaccgccattcaacgcgcctcagatcaaccttgcgagcatctacagcactccatacgttataccatgtaccaatgtcattgactaacgtttggacccgcagatcgactcgtgagcattctgaaaggaaacatttggcccatcatcacgttgtcatgtcagccaaagtcttcgactgcaggcagcacggcgaaccactgactcgagcacaacgtgcatagaacagcttgccagcaacacaagcacgcagcgctagcgccagcaactccttacactatccagcgcactattcacacgcacacacccagtacttgttgcattgacgctgcgcgacgagtctgggccttgaacttgcaacttgagcagtagtgccattcaccattcttggcaaaaaaacaactgctgacattccagctcgacatacctcggcaaccttgcaacataacttgggcccacatggaccaagaaaattgaccccgccaatacagatgctgacattcacattgcagacaccaattaaccttgcactgcagcatggtggaaaagccacta

SEQ ID NO: 504854 - DNA, 459 bp, Homo sapiens
gtcggttccggtgtcattactagacattttaatccctgtctgtattgttgcttgtatatatgtctgtatttattttgagacggagtctttgctcttgttgcccaggctagagtgcaatggtgcggctcggctcactgcaacctccacctcctgggttcaagcgattcattctcctgcctcagcctcccaagtagctaggactacaggtgcccaccatcatgcctggttaatttttgtgtttttagtagagatggggtttcaccattttgggcaggctggttgagaactcctgacctcaagtcatccgaccgtctctgcctcccaaagtgctgggattacaggtgtgagccactgaaacacagcctgaatttctccattcttcccacacaccctcctcaggttctccttcctgaccactgacccttcttttctttctacttttttatgggaagggcacac

SEQ ID NO: 504855 - DNA, 102 bp, Homo sapiens
ctgggcactctttctgctggtcttccctggaggactgccgttactacttttgtggtgcccaggaaatttggggtccttaagccaaaaagcctgtgtcctgag

SEQ ID NO: 504856 - DNA, 251 bp, Homo sapiens
cttacggtgcgtcaggctcaaacaggcatcgagttgctatgcaccgcctaggactgtgccgggctatcacattggccaagtaatcatgtccagtccgcaccaagctgcagaaccaggagcatgtgattgaggccctgctcctgcgccaagttcaagattcctggccgccagaagatccacatctcatagaagtggcgctctcaccaatgttcacatgctgagtaaaatttgacatgacatggttgttggaa

SEQ ID NO: 504857 - DNA, 464 bp, Homo sapiens
ctgctgcgcctctaatcgtgagatacaatggcggatgactgctgaccatctcatcagtagcctggattgacaggtgcaatcttccacatcagtctgcgctggccctatgagcctgcgtgactcacgctccggctccctcttagaggctgttagagatcttactgcaggatctccattagaatacatctcccattaccaggtctttcttgattgacagaatcctgctccgtggctgcttcgcattttgctcgcttgcctgtaatgatcctggtctctgcattgctattctctgctggaaggtcgattatggtgttgctttcttgcacgaactcttctttatgtttgcgcctcctttcccaatgatattcttgtgcacctgtttgaagatcggaacagaaattgattatctcttttccaccagatctggcagcatattctgcctgtatattgtgcgttttttccca

SEQ ID NO: 504858 - DNA, 1300 bp, Homo sapiens
ggtgcctgagcccaaccgatgcgtggcggaccgacggggagagagaagtgcgccagagctgcgcgctgcgctggccccgatgcatgcagtcgttgcctgccagtggatgcagcttgctgatcgcgctggggcctgccggatccagcagttctcgctggcctgggcctgggcattatctgctggtgtgggccgcgtgcctgccccctgtgaacctgaccctggcgcgccagattgcctgtgaacctggatgctgtggtggtgctgctggcctgacacgtagtaacctccggaaggctccaatgtgtgctgcagtcctgaggctctgtgtgctgcgtgggggtgcttgcttggacacctgtgcagtgaagctgtgtgaaggctgtgcctgtggaggagtagccctattgggcacattgacgaagactcgtctgatgcctgtgaaccggcttctgatagcgagcagggaagtaccttggttgtcgaggcggaggacacggacgcacattttggggcgtttggggaccaagaggcaaagaggaaacaccaatttcattacgccgatatgggaggaactagcaaaaggtgggaatggcacctagacccgtcaccggggggtcctgtccaagggaatagcgcgccggtagacaagttcccacgagcaatgagagtgaggttaagcccacaaggagtcatacgacggggagtcagggttcattctggggtgcccaaaggcggatagacacaactgatttatagtggcggaaaagcgatttttaagttaggcacaccaaaagggaacaagtctataaagattatatagggagaatcggaaaggtgtccgcggagcactgcaagggggtaaggcgcgggaaggagttatgtagaagttaggtcgcgtattagttccagagtaagtttgtccgtggtgatttggggaagggtgttggaattttagattttggaggttagccaagctggccagggagagggagatccaaaaggtaggaagcgaaaatagccggggaatggttataccgaaggatacagtatagatattttaggtatcagcttatagcgatagattggaacgtggggcgttaaatctagaacaaccaggagggtggtttagttggaaagtggaagcgttgggtgattatacggaggcgataagaaaggggaggaacaaagagaaggagcacgattggaaagccgaagagattgatgcaagtggtataagtatgaacaatttacagaggagacaaggggagagaagggcatcggttacagcggagaagcacag

SEQ ID NO: 504859 - DNA, 803 bp, Homo sapiens
  misc_feature (5)..(5): n is a, c, g, or t
  misc_feature (71)..(71): n is a, c, g, or t
  misc_feature (123)..(123): n is a, c, g, or t
  misc_feature (138)..(138): n is a, c, g, or t
  misc_feature (141)..(141): n is a, c, g, or t
  misc_feature (166)..(166): n is a, c, g, or t
  misc_feature (181)..(181): n is a, c, g, or t
  misc_feature (185)..(185): n is a, c, g, or t
  misc_feature (189)..(189): n is a, c, g, or t
  misc_feature (195)..(195): n is a, c, g, or t
  misc_feature (199)..(199): n is a, c, g, or t
  misc_feature (203)..(203): n is a, c, g, or t
  misc_feature (207)..(207): n is a, c, g, or t
  misc_feature (209)..(209): n is a, c, g, or t
  misc_feature (217)..(217): n is a, c, g, or t
  misc_feature (219)..(219): n is a, c, g, or t
  misc_feature (232)..(232): n is a, c, g, or t
  misc_feature (296)..(296): n is a, c, g, or t
  misc_feature (328)..(328): n is a, c, g, or t
  misc_feature (374)..(374): n is a, c, g, or t
  misc_feature (441)..(441): n is a, c, g, or t
  misc_feature (480)..(480): n is a, c, g, or t
  misc_feature (530)..(530): n is a, c, g, or t
  misc_feature (540)..(540): n is a, c, g, or t
  misc_feature (579)..(579): n is a, c, g, or t
  misc_feature (597)..(597): n is a, c, g, or t
  misc_feature (606)..(606): n is a, c, g, or t
  misc_feature (632)..(632): n is a, c, g, or t
  misc_feature (796)..(796): n is a, c, g, or t
aaatnatctctggtttcacgggggagataaaacctagggctgctgtgaatgtgccctctcaggtccctganttggccccaggtagagctgtaagagatcaggaagagggcctccctgcctganggcgatgatcctggnggnaacgtgtggtgcagaaagagaagtngaggtagtgaaaggnagtnaggncttggngggntggnccananctccagcngngtcgagtattgangattggggggtcaggggttggggggggagggggtcccaactggggagcgggtgggggctctgcngccagagctctcttctctcggtcactgagggnggcaaatcgccgctgctcttctcgttcacgctcctcctggtcctgntgcctctgctgctgttcctcccgttgccgccgggctgccttctgctcccttttccgtgtagcctgcngtgcctccatttctggtgtcaatggtcctggcacctggnggatttcaaatataagaccctataagttatctttggtaaaactgcaagangtagaaaggntctagccaggatctgtgatgccttcccactctgcttgtncttcctattccagagtgnggctgagcnttgtgtgtaatcgtgaggcatctggnattcttctccatgaaaccttcggaactcattacgtgttgatttgtcagccgcaacagtataaggtggccgggcccgagagtccctaggtgcaaaaactccaaaaatgggtttaacttgcctcctgcctttcccaacatcacccaaccagaccaaggggatattnccaagta

SEQ ID NO: 504860 - DNA, 407 bp, Homo sapiens
  misc_feature (12)..(12): n is a, c, g, or t
  misc_feature (39)..(39): n is a, c, g, or t
  misc_feature (77)..(77): n is a, c, g, or t
  misc_feature (115)..(115): n is a, c, g, or t
  misc_feature (130)..(130): n is a, c, g, or t
  misc_feature (141)..(141): n is a, c, g, or t
  misc_feature (172)..(172): n is a, c, g, or t
  misc_feature (257)..(257): n is a, c, g, or t
  misc_feature (341)..(341): n is a, c, g, or t
  misc_feature (372)..(372): n is a, c, g, or t
  misc_feature (378)..(378): n is a, c, g, or t
ccagaaaacgangcatctgcccagtgttgaacatctganctcctcgcgtgagtgcacccgcgtgagactgtctgctnctgtttattatggctgtgccctgtgattacagtgcacncgcaaagggctgtantgtcctgaaanatgatgcctgtctttattagggttcctgaantggttcaggagcttccattaacttcgcctgtggatgacttcaggcagcctcgttacagcagcggtggtaactttgagacaccttncaaaaagagcacctgcaaagggaagagcaggaaggttcaaagagaacagagcaagatcactatgagacagactacacaactggnggcgagtcctgtgattgagctggaggaggantggatnagggaatttccacctattcatttcagatt

SEQ ID NO: 504861 - DNA, 85 bp, Homo sapiens
ggatttgctggtgcagtacaactaggcttaatagggacatgtgtattttatcacaattttaaaacatttaacatttttataatga

SEQ ID NO: 504862 - DNA, 220 bp, Homo sapiens
gtcgtcctgctcactagctctgcagcctcagtgtgttgtccttgacactggggtgtgcgcgtctatcgcatgtgccgcggttgagagtgtgcgctcttgtccccgtgatctgggtccgcgcactcagttcgctgttggcagggaataagccacagagggaatctgtcgggagtgttactatccacacggggtcgagttcacagcagccggctccggggaa

SEQ ID NO: 504863 - DNA, 138 bp, Homo sapiens
ctgactgagttctgattagtgaaaacattcttgtgcaatgctttctgccaaacaaccccccccccccccgtccaacggatttcactctagctggctgcaatacgaatgccccctggctgtccctcttcaatcatcttt

SEQ ID NO: 504864 - DNA, 88 bp, Homo sapiens
tctccttttttcctcattaaaaaaaaaaagtccctgtggagtgtacttatttattttttgtttaaagggaagtaaaatgcgaaaaaaa

SEQ ID NO: 504865 - DNA, 908 bp, Homo sapiens
ggagaactagtccgagtttttttcgttgtttttaaaaccttatccttataagccatgcctgtgtggggttgacagtgagggtaactaatgacttgtgggttgatggtaaatcatggggctgtaccaatggtccagttccagggttaaaatccctgacgccaggtcttcatagcggaggcaaaatgtttccatggttatcttaatacctaaactaattagttcctctctaatagggtagatacgaatgggtcccacttggggtgtagaggagtatcagtagatatcgttaggagacttcttaataccggtacgttggactgttgtcttgagctttaggcacgagctttcactaaaaacttatcgagcgaagctagccattataaagaagcctctaccataatcagcggtcagtataaaactaccacaaggaaacatcctcactacataaacacaggtgattctatctatccacataaagtagctccaaacaagagcccctcgttccacacatacatttcaggggaatattcacacaagtgttgaacatattttctaccaacagggagagaaattcaacacgacgacgagagtcatcatagttagcagggaccacaagatatgacacaaatcacaaagcaacgtcaacagggaactcctgttatcatcttggggctacaaaacacaaggaggctacataacaacaatgtgtctactgttgctcacggcacttgtggtagcgactctatctaaataatctaatattaaagaaatctatctaccagccaaagaagttagttgttaggggtactacctatagctaagaaagcagtcgagtgagtagtcgttacgcactccatagataagacagccgcgttcgttacctctcatgatggcagtacaaggactca

SEQ ID NO: 504866 - DNA, 145 bp, Homo sapiens
cattcattgcagcaaggtcatcaggggttcagtccttgctgtatattatgcttgtgtataatttttcatctttcccttgcggtactatatctattgtgccaggtttcaatattctatctgcctatactttatttagggtaaattg

SEQ ID NO: 504867 - DNA, 667 bp, Homo sapiens
  misc_feature (112)..(112): n is a, c, g, or t
cgaaaaccccagcccttctcccattggcaggctacttggccccaccaagtagcctgccactctactgtccctggtacgacggcactctggcgcagggcatgcgcagtactgncatccgtcgctctcctgctgcgtgctgggttgtgcctttgcatgcaggtgctctgctcgaaattctgtgcagatttgatccagatttgattcacagaaggctgagcgagtggaacgtctaggctggagactgtatcggtatgactgcgctctggggcggcagccctgggtcaggcggcgagagagcactgtgcgccgttgtgctgtgggccgcgcgcgctgcgtgctcgcctggcgaccccggggaccgtgaggtgctgcgtttgctccgcccgctgcactgtggctgcagctgctgcccctgtggcctccaggagatggaagtacaggctccaccaggcaccaccattggccacgtgctacagacctggattccttcctccccaagttctccatccaggatgccgatcgccagacagtcttgcgagtggtgtggccctgctggacctgtggctgtggccagacccactttgaggtgagactcgggatgactccgagtgtgggcccatcacgtggggggctgtccggacccctccgtgcgatgacttgggctacg

SEQ ID NO: 504868 - DNA, 118 bp, Homo sapiens
atcctagagatccccggcacccacggaatcgagaaagagctatcaatctgtcaatcctgtccgtggtgcggatgactagcgaggtgccgatgaatagcgaggtgccgatgaatagcga

SEQ ID NO: 504869 - DNA, 204 bp, Homo sapiens
ttgtaacaggcacttttgatcttcaagaggtgctgtttcatagaagcgcagcttcacagtgctgcgtttaccagctttgcactggagagctgtgcccacccttaaccccactacttcttagctgacctgctaaggtacaacttctacctgcccttcttcttcttcttcgggcccatcataaccttgaatgcctccagtctaggt

SEQ ID NO: 504870 - DNA, 166 bp, Homo sapiens
  misc_feature (81)..(81): n is a, c, g, or t
  misc_feature (105)..(105): n is a, c, g, or t
  misc_feature (130)..(130): n is a, c, g, or t
  misc_feature (149)..(149): n is a, c, g, or t
taagagatggggtcttgctctgtcacccaggctggagtacagtggcgagatcacagctcactgcagcctcaaactcttggnctcaagtgaacctcccaccttggnctccccaagtgctgggattctgggngtgagccactgtgcccggnctgaggcaagtaaatct

SEQ ID NO: 504871 - DNA, 339 bp, Homo sapiens
  misc_feature (203)..(203): n is a, c, g, or t
  misc_feature (245)..(245): n is a, c, g, or t
  misc_feature (247)..(247): n is a, c, g, or t
  misc_feature (296)..(296): n is a, c, g, or t
  misc_feature (300)..(300): n is a, c, g, or t
  misc_feature (306)..(306): n is a, c, g, or t
gcccttttcccggccctcattaagcccgggcatttttagtggtttcacctggaggcaaaagggaggggacaaaggccctgccacgtcccgctgcctcctgttttttggaggtattaaaacagggtgttaatgggaaggaggggagcctttggggggccacccggggcttggacttatgcagggaggccaggtccccccccccnttttgtttttgggtccctgctcccctttgggggggggggggngngttttaattttttttatggaaaaattgccaaaaaaaaaataaagagagnggtntttaantgcaataaacgggccccatgtggcccccgccta

SEQ ID NO: 504872 - DNA, 150 bp, Homo sapiens
agttatcacgcagttatgaccggacttactgggaattcctcgttcatgggggaacataaaatttggcgaaattctccccccccccccgggggaattccccatagatggtcaggtcggctgcggtagggtaaaggcaacaggctgagggta

SEQ ID NO: 504873 - DNA, 154 bp, Homo sapiens
tcactcatcattccttcttttgttcattacattatttaatacataagatccgtgatagtagccaggcactcaggaaatagtaaaaactggacatgtgatattactgccctatgtgtagcgcacattatagtggaaaacaaaatcacttgtttct

SEQ ID NO: 504874 - DNA, 321 bp, Homo sapiens
gatctagaggatcctataaagacgaacaaaaggggagcgggtcacagtgatttactcgggcacctagaagccactgatgccctccatcagagcggcactgaatcatgcgcaggaatgtctcagactatgctcgattgtccttcctgaagcagtagagcagcccgggggtccttgagcagcgcgtcatggttgtgcgagttggtgtcaaactagctgtaggtctggttgaggatctgcccagtccggcggcaagtcgcattccagcctccccatcagcgttaggatgccttacgtctaggtcctttaggaggtgatagtcat

SEQ ID NO: 504875 - DNA, 1088 bp, Homo sapiens
  misc_feature (296)..(296): n is a, c, g, or t
gatcaccatggccggctgggaccctgtacacgtatcctgaagactggagggccttcaaggactctcatcggtggtcagtacagcggggctcaagtccgagtgctctccgcaccatcccactaccattttagggcaaagcaaccgcacccctgaatttcgtccgcaaatttccctgccgggaaggtcccacgcattatgagcggtgatgatcggatatctagtgtgtattggagagcgacgccattgcctactatgtgagacaatgaggagctgcggggaagtactccagaggcagnagcccaggtggtgcagtgggtgagctttgctgattccgatatagtgcccccagccagtacctgggtgttccccaccttgggcatcatgcaccacaacaaacaggccactgagaatgcaaaggaggtaacgtgaggcgaattctggggctgcgtgagtagtgcttacttgtaagactgaggacttttctggttgaggcgtaacagagatgacattggctgactatctacaagttgatctgctagcccttgttgtggcttctataagtcaggttctagcatccttctttccgccaggcctttcccaataccaaccagctggttcctcacctgcattaaccagccccagttccgggctgtcttgggcgaagtgacaactgtgtgagatagatggcccagttctgatgctaaatagagtttgctagatgaccctaatctaataaatggactacaccacggaaacgatgaagggttcacgggaagagaagcagaagccccacgtgctgaagcggaagtgaggagaaaataggcggctgccccatgtctcctgatggaggagatggtatgaactgtgagcagggcgctggcttgcttgaagacccaaagtcgcatggaccccattcgaatcaccttgccaaggagtccttggtgttggatgactttgagcggccagtactccattgaggacactctcttctgtggcatggcataatctgggacactttgattaggccggtggtcctggggtactcaagttcgttctgaaatcactcaactttgagtgaacctcaggat

SEQ ID NO: 504876 - DNA, 110 bp, Homo sapiens
  misc_feature (9)..(9): n is a, c, g, or t
cagaggatnccgccgcgcggcgcgccgaatgcctatgccgggcatgcgccccagatgtcggcagcatgttgacgatggccccgccgtgctggcgcatgtgctgcacatag

SEQ ID NO: 504877 - DNA, 965 bp, Homo sapiens
gctctcaggttagacatcaatagggaagccatctacggaaataatgagaaaaattctcataatataataaataaaattcaggagcacaataaaaatcacttataagacaaaagaactaggaaatcatagacctgaatgagagaaagacgaagagacaccaagcatagacataaaaaaggggttggggctgggcgcaggggctcacacctgtaatcccagcactgtgggaggccaagatgggtggatcacttgaggtcaggagttcgagaccagccgtgtccaacatggtgaaaccccggctctactagaaatatcaaaggttagctgggtgcattggcacatgcctgtaatcccagctacttgggaggctgaggcaggagaatcacttgaacctgggagatggaggttgcagtgagccaagatcataccgctgcacttccaagccctgtggttataccagacgtgagacgtgtcttcagatcaaaatagacaactcgcaatacaacgtactcccacaggagagttgcggaacgcacgacaaccgccaggtagcttagtccaactctccctaagacacggcggtcccacttggggcccaccgagccacagcgcgggaccacagcgcgccctgaaagcagccgcgcctcccctcaacggcaaagaagattccccaaagggcacccacacagcgactatcatgacgcaggccacggggcccccacacagagcgctggagaatcccccgacaggcgtcccccatatcaacgccacgccgggaagcacctagaaccctggggggcgccaccactgcgggctcgggacaaacaaaaatcggcaagcaaccccaatgccaagaggacgtcggcgccaccaccctacgcgcgcgcagcaaccacgcaccgcgaatccgggcctccccgaggggaactcgaccgcggacaccaagacgcggacggcggggcacc

SEQ ID NO: 504878 - DNA, 2025 bp, Homo sapiens
  misc_feature (990)..(990): n is a, c, g, or t
cataatgggcatcaagcacagaccacccacagcctaagttattgagcatcatccctctactattgggttaaccaaatcaaccgacaacgcttagtgttggcgtgcttcccgcaatgctgtgtgcctcgcgaccccgcgtaacaagacccaccatccgttaagtacataacttacctgtgcatcgtccataccccatcgacaagtcgagtggcagagcggagacgcacggactgagtccgagctgtaagctgcagcgtaagtcgaccgggaatacagacaacatgcctcaacgcctccgttcgatcagtaggctttacagtttcgtactcacttaagccagagaatcgtacgcgttttagaataggaatagcagccaatctacagcaaaagccccaatcagggaaatctcaattcgagtgactattctactgagtgcgtgtcctgtccggacataaccccagacaatcatcatagatcgggcacgctaaactcgtgtgggggcggtcaataacgaagttgcgatcacctcaggatttaggatgtgtcaataacgctagccaccagcgaaatgttgcagcgcttcgcgataacggacagaggcgaggagggaagtaaccctgttgcccgtaaatgtttcctttacgcgaagccgctgttaaggatcaggagtcctgcacgcttattcgcgcggctgatgatcccatgcataattatcgggacgaagcgttgaacacgtctatattaccccagggcgttccgatacacaagatgacaaagctgctaccaatggagaggagacttacaaggcgatacagggtaccgtatgttgtgccgtgaaccatgtagcggatacgaccgtggcgttgccagccttgtcgcgctccacaaggcgcacagccgtaaagttccaaaatggagacgagttccgcttgatggaaaggatccactcaacaacacgagagagactcgttggtacacgttgaatttggncacgccataaggagcacctaatgaagatctggacccagaagcttcagaggcccgtacagacctctgcaagttaacggccttgtcgatagagggaaattcaattcccttgtcaattctgatgaagcggggacatacggtcacatccagaggttgatcaagcatggcaatcggttaccgccgcgatgaacgcaataggaacgcccgaagtggggttcacgtgaaaagtgtggcgcgccccaaacattgcgggactaggggggggctaccaaagcaattaacagaattaactcgtcgagacacacgaggcgacaaggcgtaaccagttccagcacaacagcaaaacgcggtcagacaggcgacaggggcgaacatacacagaggggccacaacttaagacgttgaccggaccccagtccgaagcaaatcaacccactgtgccagtccaaagagacccccccgcaggaaaccaacaaaacacaacaaacatagaacagaaataagcacccgagttgtccccttggggtagcacaacaattcccacgtaactggacgcgccgacgcactgaagcggcagagcacacagaggggaatcacctacatagctggggcacataacgcggagcgaaaccagcacgaaaccgcttatgagcagaggccggagcacaaaatggggcgaatagaatacctatgcacaaaagcacaagcggccacaacaatgtgatccacttcggttagcacaccagggccaaaagctggcaatcgcagagaacacacgccgggagacgactaacacggcgggagacagagacagaagaccatagacaaagtagaaatggggcccacgggaagcttagacagaccgaccagaagacaaaactagtgcgaggaaaacagaaaatcgaaaagaaagaacaacgagcgcgacagcatgacgcagatagacaaccccctacgaagggagcgaacaaagccacgaacccgcgagcagagtcagctagagagagcacaaccaagacatatagaacaaacacgcag

SEQ ID NO: 504879 - DNA, 791 bp, Homo sapiens
  misc_feature (226)..(226): n is a, c, g, or t
tcctactcatcataggtgacttcattactgtatcggcctgagctttgttattgcttagcgtaacgtgagggttcatacgtgttatccaactgatatatagaggccccagggattgtaggtccgatacgggagaatatacccttcggtgacgctattcatcgctttgaccacacggcgctctaagtgatcgtagtgtacatacgcacataccaacctctgcaatggngaatacgacacgtgactcgcaagaactgtatactcgtcttgcaagcagtctgctgcatggtcctcatattggtataacactccctgttctcttacaccgtaggtgcctgtgaccgtggtcatgtgtgagccaagtacattcactagacatcgtattacattgacgggtactacgttgtatttcacttcgccagtatgtcctatcaataggagctgtagtgtgccatcataggaggcttcattcactgatttcccctatgctcaggctatagcctagatcaaactctacgccaaaagtccatttcagtatcatattcatcggcgtaaatctagctttcttccccacaacatttgtactcaggctatccgtgaatgccccgacgttatctcggacataccccgatgcatacaccacatgacaacatcctatcatctataggctcattcatttctctaacagcagtactattattacattgttcgtgattgagaaggcttcgtttcgaagcgaaaagtctaatagtagaagaatctttcaaaaactggagtgactattggattgcccc

SEQ ID NO: 504880 - DNA, 907 bp, Homo sapiens
cgcagttggggacaacaataattgcggggggcccagcaaaaacacaaatgggggggggatgacaccccgccgcctgtagcggtggaaacaaacgcgggggcacaaattaagggcagaccgcgggggtgccccaaaatgccgcaaggtaattggggccacacacaagcatagcctgccgcgttgatgcgcccgcctgtcggcagacccggcttaaaaaaggggagttgctgttaaaaacgagcgcgtcgtgtggcacccacgaagcacggaaccaccgtatgttgtcagcgaaaggcacacgagccccccgcgctaccatctgggccgcgataaaatccgggaggatagggctcaccctcccgccagtaaaatggcccggtggccccccccccttgcttccccgcgaggtgtattgtccacgcacaaccaagttgtccacccaccgggcggggtttcttccccagaagagggcctattgaaaatattattgcttgtgacgccggccccgaaagccccccggcagacaaattctgtgggagcaccaccccggcggcctgtttctgggtttgttataacacacacacacgcggcttatgagtcagtcgatgttaccccacgaacgacaacaatgttctccctcagaatggcgagatcacataagagttccaacaacataacatttgcatgttgcgcccccgccgagataatgagacagtcttgctgtcccccccagaatggaacatcgtacacgccacgctactcctttagaaaacatagcttccgtggtacaaaatgtagtcgcgatgttggtgacaacgcacgaaattcaaacggcggtcgaggaatcccgccccggacaaaattgacttacggtgccggtttagagcggacccccgcaaacaaaaca

SEQ ID NO: 504881 - DNA, 1562 bp, Homo sapiens
  misc_feature (535)..(535): n is a, c, g, or t
ggacatgtactctcggttaggagcggatcactcaatctacgccgggtcctcgctgtgatcagactacagttattccagcaaacgaggacagcaccaacaatgagaagacgtagtgcttgcgtttgaggaggctgatggatggtaagatggcattaaaaacgataacgctagggcgatactctgggcgtgtgtggctcaggcctgtatagtcccacgtcacgtttgaggagtgccataggtggagtaggagtcatcgaggatcaggagcatggacgagcagctcgtgagccaacactggtgaaaccctgtctcatacatacaagaacttagcaacaaaaattagtctagagagcactggtcgtgctgagcgtcagccatgttagtttgccactagtctatctgctggtggatgcgtctcgcatgatcagagtagtagatggccaatgagacccgtggaacgccggaagggttcgacaaagttgacgccagcaagggtacttgacccaacattggcgaactccaagccgatgggggnctgaacccacgaaaggccgtaggtacttgcccgatcttgtaaaatagcatgacaaaaagagagaagagctgtggagtgtcatgttagagtcacggagtctgagttcacacgtgatcacgaggtgaagaaagggcgacgcatgaggaagtaatcctgtgggcaaacgcattagtctcacattcgaagagacggacgcacaagggaggtgagttgttcatgggggccattgggactccctgtgccacctggggggtgggcagacaaagacgaggtaactcacttgacatgcgccccagagcgtagttcgcgcgtgggcaaccaaaggagccatggtaaattccccccaagggcgaatcttgttgtggagggaagtggccctgattggtttgagacctggagtatgtcccaacccgtagaagggtcaatggcgacggtttattggaaggacccagaggcctttgggcgcccacaactgtagggttgagaaaagccccgcccattattctctaagttaaaacgaatttgctgggatataattgaaggcccaagcggttgtttggttgtgcaagggccgcccgtggtatattcccccaggcgacttacttcgggggaaggaggctttgagaggcacagggaagaatactctgtgccgtggtaaccccccaatgggaagtgcggggcacaattgtgtacaggcaaggcgccgaagaaatgtgggcgcccaagtggaaagcttcccgacccgggggaccagtcgagaacggggggaatttcacgcctcgagaccaaggaataccacctacacacaaaaggacgacagccgagaaagcgaccataatatatgacggggtgcggcagacacaacagcgggacacaagctaacacggggcacagtgggtgacaagaggtggtgtatcccagccgcgcagctttgtgtgtagtcgcacagaggggggaaacgctgcgggcgacgcgccccataagaagagggatgcgatcacattgcagcaagccagggtaaccggtt

SEQ ID NO: 504882 - DNA, 418 bp, Homo sapiens
cggcacgaggcagacttcactaagtgcaatcatttctagcttttgatttaaagtgagagacatgccactcttcctttcacttcaaaactgagaggccattgtaggtttattgattggcctagttttaatattattgtgtctcagggaatagggaggcctgaggagaaggagagagatggagaaatgactgataaatgtgtgttctgactgctccattgatcagctaagtttgctgtcttctacgggtgtggttcatggcaccccgaaacaattacaatagtaacatcaaagatcactgagcacctgtcacataacagatattattataataatgaattgtgattattaccaaaatgtgacacagagacacgaagtgagcgcttgctgttggatagatgccacaaactttaaatttgta

SEQ ID NO: 504883 - DNA, 115 bp, Homo sapiens
aggacttggaggaaaaatcccctgggctttccctaaccctttgacaaactccccccccccagttgatggctttccgtaataaaaaaattggggtttcctttttaaaaaaaaaaaa

SEQ ID NO: 504884 - DNA, 439 bp, Homo sapiens
agctccgggcctgtgagttaggaaatagaggttccaagaccctttcccaaagcccaggtgagagggggtccctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctgggca

SEQ ID NO: 504885 - DNA, 151 bp, Homo sapiens
  misc_feature (5)..(5): n is a, c, g, or t
gttantaaaagatatcctactccagaagaaaaagaggaggacacatcaaaaggtattgaggggcaattttcactgatagtaaacaaccccatacctcctggtgtgggaagctccacagactggaaactaactggttcagaccgctcttacc

SEQ ID NO: 504886 - DNA, 354 bp, Homo sapiens
cgagctgggagtgtggtagccctcagtgagtctggtatcctgatggtcccatcagctggtgtgagttgctgtgccctaagacccacactaaagaattccggtaagtagcccgagtactaacccgtattcttgcagacctaagaagccactttttaccctatggaagggggtaagctgttcctgagtatatactatctttgatgctgctgtctttatttcatacacctgcgtcgctctttttccacttccagaaaaatcttctcagtttatctgctgtagatggaacatgtttctgtgaacctatcagtggatttcattctcttgagtaataaatcttatctttacaaggctaat

SEQ ID NO: 504887 - DNA, 1163 bp, Homo sapiens
  misc_feature (8)..(8): n is a, c, g, or t
  misc_feature (46)..(46): n is a, c, g, or t
  misc_feature (49)..(50): n is a, c, g, or t
  misc_feature (52)..(53): n is a, c, g, or t
  misc_feature (59)..(60): n is a, c, g, or t
gtttcgtntagagcccagggaggcaacgcctcttcatagatgcctnatnncnnccctcnncacggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctgggca

SEQ ID NO: 504888 - DNA, 261 bp, Homo sapiens
tccgaggatctcccgcagatggaatcatataacgcaatgttcatgcagtcacggaagacatatggcatgctgtagaacatggtgtgtatcaatacaagacagtcagggaccatatacggaagggcttggtaagcagcatctagtttccagactttctgcttaaaagctgtgtatgagtaattccaggacttttaggcaaatatatgacatgatagtattattttttacttaaagagaaagtcactgtggtgacagatcaga

SEQ ID NO: 504889 - DNA, 1002 bp, Homo sapiens
gggcctctgggaagaagccaggaggaagcctggcactggggaagggagataaggagcaagggagataactccactgtccttcagcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtaggtcaaaagcaccatcctcgtactgttgtcactatgagcttaagaaatttgataccataaaatggtaaagacttgagttctgtgagatcattccccggagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctgggca

SEQ ID NO: 504890 - DNA, 384 bp, Homo sapiens
cagctggaagatggcgcacccggtttgctacaacatccaaaaaaagtccaccttgcacctggtgttcggtctcagaggtgggatgcaaatcttcgtgaagaccctgactggtaagaccatcaccctcgaggtggagcccagtgaccccatcgagaatgtcaaggcaaagatccaagataaggaaggcatccctcctgaccagcaaaggttgatttttgctgggaaacagctggaagatggacgccccctgtttgactacaacatccagaaaaagtcccctttgcccttggtcctgcgctttagggggggggtttaagtttccccttttaagggttcaacaaatttcattgccctttcctttcaataaaggtggtgccttcccca

SEQ ID NO: 504891 - DNA, 1066 bp, Homo sapiens
  misc_feature (8)..(8): n is a, c, g, or t
  misc_feature (46)..(46): n is a, c, g, or t
  misc_feature (49)..(50): n is a, c, g, or t
  misc_feature (52)..(53): n is a, c, g, or t
  misc_feature (59)..(60): n is a, c, g, or t
gtttcgtntagagcccagggaggcaacgcctcttcatagatgcctnatnncnnccctcnncacggatgagatcttcctgacccccaacctctccctgcccctgtgggagtggaggccagactggttggaagacatggaggtcagccacacccagcggctgggaagggggatgcctccctggccccctgactctcagatctcttcccagagaagtcagctccactgtcgtatgcccaaggctggtgcttctcctgtagattactcctgaaccgtgtccctgagacttcccagacgggaatcagaaccacttctcctgtccacccacaagacctgggctgtggtgtgtgggtcttggcctgtgtttctctgcagctggggtccaccttcccaagcctccagagagttctccctccacgattgtgaaaacaaatgaaaacaaaattagagcaaagctgacctggagccctcagggagcaaaacatcatctccacctgactcctagccactgctttctcctctgtgccatccactcccaccaccaggttgttttggcctgaggagcagccctgcctgctgctcttcccccaccatttggatcacaggaagtggaggagccagaggtgcctttgtggaggacagcagtggctgctgggagagggctgtggaggaaggagcttctcggagccccctctcagccttacctgggcccctcctctagagaagagctcaactctctcccaacctcaccatggaaagaaaataattatgaatgccactgaggcactgaggccctacctcatgccaaacaaagggttcaaggctgggtctagcgaggatgctgaaggaagggaggtatgagaccgtagagcaccatttttaggggagcacctggagagatggcaagaatttcctgagttaggcagggatcaggcattcattgacactcagggagtgtcacacatttctgttctgcaattaaagggagaatgaggttcatccaccaaattttaagcagaatataggaagggcaggggtggggagtttcagggtctgctggtcctgggca

SEQ ID NO: 504892 - DNA, 130 bp, Homo sapiens
attcgcggccgtgtctaccttccactccatgcgcggctccgacggggtgggagagcatcacgtcctggcgcatgctaagcaggctcatctggctgggcgcgtactccaggggcgacttctgctgtatcac

SEQ ID NO: 504893 - DNA, 788 bp, Homo sapiens
  misc_feature (11)..(11): n is a, c, g, or t
  misc_feature (19)..(19): n is a, c, g, or t
  misc_feature (788)..(788): n is a, c, g, or t
tgtgtggcagncttggccnatgcttgtagatacaacctctggcactattttcatgtctcccccattccacagccacgtgtctgaacacatttgcttttagaatggcatttatgatctcaatgccctcttgctgcaggccttccatcctagggtgttccctgtacttaaaataaacggaacggaagtctctgacttgaatgaaaccaaacggaaggagcgtcacagcccctctgcacagttcccacgatgactgctgtgcctcccacacaacgagccttttgactgactccagcaataggacgggactgtcgttacacgaggagagctaccggcatacagacgcatcccaatcgcattaatcggaacatcttgccacaggataacagaatttccattgctgtgcggatgcctgtctgctacacatggtatatggcaagcgagagaacctattttttgatagcctttattcccaatctcctttttttgcccatattcctgctgccatgcgattgcggctgaacatcaatcttgcccatgcccttgatccatattgaattcttttcacttcaagcatagttgtgccattaacaaaatcatcatacgaaacgacctatataattttaattatgaacctccgtgtcctagccgtggacttctccgggccgtttactctagggaggggctacttcttgatactccgctaacgcatcaggtaagatcttaccattcgcttgaacagacctaaatcatttgatcccaggtccttttctcttttaccagtatacggn

SEQ ID NO: 504894 - DNA, 780 bp, Homo sapiens
agagaggccccatgaagtctgattgaagctgcgatggagcagatgattttcttcccactgaaggaaactctttctcattgcgcagccaaagacgggtagtgccactgtcctctcttcactcctgagatactgttctggaagcgggtgtcattcctctctagtaacctcttctcttcgtctgaagtgtgtgaactatctcctagtgtttaagatttggcagtgtactcgccatgtatgtcagcatagaaaaggaaaggttgaccttatctcctgtatgtctgatagaaacttaaaagaaatgtgcattgggtttcatagccccagcagagaaaatcctcttcactcgatagggtgtgctgctgtggacaggagggcgcaaaaagaacctctacatatgaagggcaacacgtgtaactatctgacactgtgcatgatgcccaaaagagcaaagttgtagtgcatgcatccctggttcatttccccatgcgatacacagtgtcgtaggtgagtcccacggctgaccttgcaggtgattcaccgcaaaacgcatgccagctgcgtcctgccgcacaatgctgggccgcatctgtaagtgcgcccagacgccaagcaggccctgaagaaaatgatgggggtgggcagggacccgtcaaagggcgaatctggcctccgacagtccgcggaacgcggtagacaaatggttaaaacctgcaagcggtgcacataacccgcgcttttggccacacacagggaggggcacaaaccccaggggggcgacac

SEQ ID NO: 504895 - DNA, 103 bp, Homo sapiens
  misc_feature (15)..(15): n is a, c, g, or t
  misc_feature (44)..(44): n is a, c, g, or t
  misc_feature (80)..(80): n is a, c, g, or t
accgtctgtggtggngcacgttgttggggttctggggtatcacnccggctggtgtggtttcctggatgtgcgaacgccgnggctgcatgcgttggtgtgtggt

SEQ ID NO: 504896 - DNA, 137 bp, Homo sapiens
gttgtgccgacattacatacatatccatctagataggtggttatactattggcctagtgatggaatcgtgccatttatcaagttttatacatcaaaaagctttggaagttcaccagaccgtccattatttcacctct

SEQ ID NO: 504897 - DNA, 222 bp, Homo sapiens
gcccaccactaacttcataaactttcttaaaacattatgagatttaatggggataattattttttcagctcctcaccaattgtattttatgttgcagccgaggacaattctttttcttccaatgtggcccaggtatagccaagaagttgggacaccccttttttagactcaactgacccgcaaagtgctgggagtctttcttgagggtatcttagcgatagt

SEQ ID NO: 504898 - DNA, 1400 bp, Homo sapiens
  misc_feature (241)..(241): n is a, c, g, or t
cctgggggagtaaagtgttgtgtgtgctagacgacccagacacatatccgcccccggggtgttcctcttgggagatgagtggttctcctctctccccctatagttttgttcgcaggatgtcctcttgtttttgtgggttggttgtgcggcccctcccccttgtgaacctgcggcttttgtgtcgccacagcgtgtcatgttagtggagacacccacccacacgcgcgtttgggttgagaanatggtgtggttccttcggcgtttacacacatgtgtcccgacgcagcccaagaaagtgggtccgagtgtggtctgccgagtccactccattgggacgcggcgacacaagaagtcattttttctttgtggggaaacacacagaaaaatatgtggtgttgctgtcacaccaaaagagtgtttatgtctcccccccccccctgcgcgaatgttaataacacttgttggcgttctctcttcctctgatgtattgtgatcccgtgggttctcggggaagttctccccccgcttggccgcgcacacataccacaccgaggcgtctttattgtgaaacgacccagggttttacgaccaagaggtgctaccgcattgggatagacttgtgggggaatattttgggcgctcccagatgtatcttgtggtgagagtgtttccctgcgctgtttgtggcccccccaagatttctcggttttcttttggcacacctctcgggatagtgcgctctgccccaccactgccacacccacacaacttgtgtgtgagattcttctttgtgcgcggtgcgcggtctttcatcacatctgggagagtgttgtctctgtgagacgcacacagaggcacacagagtattttctgtctccacagatggcgtctattctgtgatagggacaccacagagtgggcgctgtgttattctatatatgcgcgcgcggtgtttacagagcgggatattactcttggaagtaacacgtgtgggagaccccagccgcaagagagttcacacacaagagttttgtgagagaatagagcttgtcttgtggtctctctcagagtgtctggtctcagacccacgcgcacccagagaccctttgtgtgtgtgcgccacactgataccgaggcgtgatagggaaagaatactccaggacaccaatccaggatagccaaagactgtaaagaagagattgtacaccaaatattctgtggggtgggatttggaagcttttaaacatcctggtgggatatccaccatccaaataacccgattccagattttgtccattgtttttagataaatttagttcccatttgtgaaaagggttactttcatacctcccttatgtcaccagaaatccaccatggaaaataaaggttccctaaagcgt

SEQ ID NO: 504899 - DNA, 202 bp, Homo sapiens
ctgtgttacgtagtagacgggtctttccgcgtcttcgttcggtcagctcaaaagactatttttctagcgacttatgttcatttcattttagctttatccattcgtttattcggtatggaccagaaacgggacaggaccaattgaattttctgaatcacactttcctgtttatgtataacatctttctcactgatgtgaatgc

SEQ ID NO: 504900 - DNA, 166 bp, Homo sapiens
taaaatgaaaaaaattcatctgctttgtgggatgcatacttggcagtagctcgtttggctgatgctcaatatcaaagcatagtcaactacaagaagtctactgcatatcaaacaaagcaagagttaatgcagagttccaaagaagaagcaaagaaactcaaatcta

SEQ ID NO: 504901 - DNA, 144 bp, Homo sapiens
gcggccgcctactactactactgctcgaattcaagcttctaacgatgtacggggacatgattgtgccactgcacattagcctgagtgacagagagaggccttgtctcaaaaagaaagagagaaagagagaagagagagaaaaaa

SEQ ID NO: 504902 - DNA, 190 bp, Homo sapiens
  misc_feature (16)..(17): n is a, c, g, or t
  misc_feature (184)..(184): n is a, c, g, or t
aagacagggcctctgnntgatgtcacccaggcatggagtgcattggtgcaatcacaactctttgcagcctcaaactcctgggctcaagcgatccccccgccccagcgtgccatgtagcaggactacagatcctacagatgcacatcaccatgcctagctttttttttttttttttttttttttntttttt

SEQ ID NO: 504903 - DNA, 145 bp, Homo sapiens
gatagtgttgagtagttagacaccccaccttcagcttgtacctgaaagcttatctcgtataaataatcactgtaattgaggggaagtatgtcctgtgctaaggatctcaacctgcatcccgaggaaatcagtatagtatgctaat

SEQ ID NO: 504904 - DNA, 118 bp, Homo sapiens
gtttgcggaagctagcctgaatagggagagagtccagtgtgtgcatgtagcagtcgatcgagttcggtgaactttggattgggtaacctctttggtatagagggctgatagctcgaac

SEQ ID NO: 504905 - DNA, 1305 bp, Homo sapiens
agcggccgtgttggaggggggctgagggaggagactgttgctgatctttggatgttctggttagtctaagaaggagagtatgaggcgagctccggcccggtgtgctggcctgggcttcagtggtgcccagtgcagccgctgactgccacctgacatctaactgctgcagcccatggatggccctggcagcgcggattggtgcctggttgctggctcgtggttgttgaaactgggtgtcacacatcacggaatcatccacaataagacctaggcaagagaagaaaaggacaacgacatacacaacgaccaagggacacacgcgaagaaggaaaagggctcagcgcaagatgcacaatataaaaaagaacaacatagaatagttgggaaacaataagaaccaaaagaaacaccacatagggacgcgagaaagcaacgcagaagtaaagcacagggcgattaagtgctgagaagcgatgtgcgcttcccccgtcaggagcgatatggcagactgtacgctagctagtagtatacggcagtgtgcatcttaacagacgatattagaaaggaataatagacataaataatggtagcgatgagaatatagaaggggctagtaacagtaaatagactagctcagaagcggcgaacgtctgaccgcacatggcatagcatccatataagcattgaagagaggcggagatccaacaagatgagggatagagacgagatgaagaaaggaatgacagacaggtgcgccggcaacacagaacaaggacagagctgaaaggagagacgacgaaaagcgccacgagagagcgacaggccaccagactacgatgacaaacgacacggacacagacagcacggcgcagagcatgaaatcgacaaaacaagctttgacgcagagaatgggtgcgtgactggtgaccatccgtgcgtgatggagcatcgagagcgaatcgtgaaaactcgagggaacagagacctcactctgaggatgaggagatgtacggatagagagtgttgagaaggaggatgagatggggaatcagggatagggagggcagtgattgcagggtcaggatgggagaagagagaagcctcatagagtagagagcgctataggggaaggccggtcgcgaagagcgaaggagagaggaggtcgcaagactgagctaacaggaagcagagcgatagggtaaagtctaggcgggacgctggagtaggcggtgacaaaagtagggggtgaacgaccggcagagcggcagccggacgagagggaggtcgctgcgcgcagttgagctc

SEQ ID NO: 504906 - DNA, 180 bp, Homo sapiens
cggttaaacagagaaaacagtaccgcagctgaagaagctaatgtgaggattctcaaagaccatgtacctcgcccattatacatgctcctaggaatcatctttgatgtggtaacatgccaagcttttatgtcatagtatggtcttatatgttcaatgcaatagccatagtagtaagtcctg

SEQ ID NO: 504907 - DNA, 254 bp, Homo sapiens
cttgttcagaaagcaaggggaaccaggcacgtcttacctagccggaacaggaggaagagagagaaagggggaggtgttacacacttttaaacaaccagatctcgtgacaagtcactcactatcataagaacagcaagggcgaagcccacccccatgatccagtcacctcccaccaggcccctcctccaacactggggattattgtttggccttagatttggagcgggaccaaaatccaaaccatgtcacataga

SEQ ID NO: 504908 - DNA, 168 bp, Homo sapiens
cctccctatgacacatcaagtcacttgtttttccttgtgctaattctattgctatcctatttcacatcctgaaatgagaaccaaaaataactgaggaaagataaacgctgttagacttgatagatttaaagatactgatattatgcgataacataattacctatatta

SEQ ID NO: 504909 - DNA, 581 bp, Homo sapiens
ccgtaccagttcgaggagactctctgtgatactggacaagtgattcgatgtgcaccgggatatagtagctttcatccgcctcttgaaagggtaccaccactaggaaagtccatttcagatgttggtaggttcaacgaaagttggaatgctgggactgttgagttgggcaagagttctgcagtacctggctcagagctacaatgcatttagtatattacagcagctgacatgatgactttttgcgagccttcgccaggtgctggagtttttctgttaattggccgcactaggtcataaaagatctcatgaacatttagtgttgattttgcagaagattccaagcatacactgtggtgcatctacttcaacttgctttctataagaatcttctatcgtaggagtcgtattttgctaggaaaattccttgagcagacttgtacagtcgaagcagactttccaatgcgtcctgagccacgaacgattagctgatactcacgcatgaggcacgcttgtcgaaacctagtacctctcacgctgtcagcgggtccctgcagtcagcgtgagagtctccgaggaagtgg

SEQ ID NO: 504910 - DNA, 898 bp, Homo sapiens
  misc_feature (290)..(290): n is a, c, g, or t
gagcctaattataacacatcatccgtctactattctttagccgaatcagcaaatggctattaggtgtccccgaagcatctgttggtccgtgaacctcgctgaagtaagagcactgccttgtcactaaatacataacatgacctggacgtccataccccatcgactaatgcatggaagatgccagaatggccgattttaggtccgagtctggtaaacaaggtatcctacgtaaaaaagagaagtcttcaccgtcgtcagtatcaggtaaatctccctttacgaagtcgtcncttgagatttataacgattcacgaggccacagaactaatcatattttatagtcctcgttcgaaaccatcactgtatccccgaccatgtggtgtatcatcacccgatgaggcaatgcagtcagaacgccgtgaatcgcaggcagcagtacttcgctagttctacacacctagtaggctcccttcccctactcatcgcacgtaattgacactcacggacaccctaggctcagctaaagattctactactcagtctcactgccaagaatatcaaactcctgagacaattaattagtatgactagcttagacaagtagctttaatagtaaagatacctctttaggggggttcacttatgaatcgcttataggccaatgttggattgcccccattcgctggggtcaaatagttttgcaggaggtagtcttttaaaaaaagggggatggataaaaagctcccaatatgttaatcctggagaaaattggatatcctttttggaaccatagggagtataaaagggtgggttagaaaggagaaaagctgggtgtttaacatgtgggagggtttaccggggggggggtatagggaacttttttggaaaaaggattttg

SEQ ID NO: 504911 - DNA, 625 bp, Homo sapiens
ggccgtcggcataaagcctctgtgtttttcgtcccgcccgtatctgttgtgttcttttgtcgccccgtcatgcgtgacgttcttttactaaccgggcgggtctcggtcccctcctggacgggtaccacacaacggggccccccagggggcgggaccctatacgggtgtacccgcgtttcgctgcgggacctattttcacaagtccctacacatcggtcccgccccgtttttcttggacacacgcggcccttggagaacccctctgtgccgtgggccaccgaggtgtgtttttcccggtggtagccccccctttgtgagaagatatatgtccgcctcaccagacgcgtcttgttcgactctctaggatgtcccccccacaatgggtgtgtttcacacggagccatattcccgggagctgtttacaccacgcccacgttttttccgccgcaccccgacgccgggggttattaccgggcccaaatctttgaaaacttttggaagacaaacagcccaccatttctatatcgccgccgctgtgcttaaggagtgtgtttcccccaattttttaaaaggggcccctttttcccctttcccccccctttaccccctttggggccaaaaaaaa

SEQ ID NO: 504912 - DNA, 185 bp, Homo sapiens
gggttaccgagtcacgaagttcgtatatcatggcacatagtctgtttcgcgtgctgcttagaactccatgcgtctgtatatgttactcgtactgttgcatgcccctcgcggtttaatatctatatctttaagaaaatacttgatattataaacagagtaaaagacatgatatagtagtgattact

SEQ ID NO: 504913 - DNA, 188 bp, Homo sapiens
tctcgacgtgcttcagcagtgggcatagccattttcagatagagtgaaaattgtgtgctttaactttttatggctactcttttagttaaatttggttgacattttatagattgaaaacaattttaaagggtctaagtcagtttttcatgatgaggattccagtctgctattatgaagccacgtcgtga

SEQ ID NO: 504914 - DNA, 664 bp, Homo sapiens
tatccgaaggttatttgttgacccccactaaggtctttatcgaacaaattttgttgacaaaccctgggggaccattttttgaaattggcccaccaaaaaagccaggtcaatcgtccttgcaagttacagtttggtgttcaagttagttcgctatgctactaggagtaagtccccttattttagctacgaaaatcaataatctacccagacaagatgtagtattttgggataattgatttccataatactgcatcccaaaagaagttgtattgttttttacaaaagacagtgtatttgacatcacagtcagatgcacaattcattatgtcaattcccgttgtgtcgctttttgtgatgaaacagggccatattaccccttttcgaccccatgtatctcagtcccccatggagctgggctaagtaaataggaattggtttctcgcttaaggcaattagacactttggaagatggcataacctgtctcacttgaacttaagcgtctggctgtaattcccagtgctcttttctcctctcagtatgcaggttccctaccataggagccaccagttctcatgggtggcactcagtctctcttctctccagctgactaaactttttttatggaccagttattttttcctatgctaatagaataaaggcagt

SEQ ID NO: 504915 - DNA, 145 bp, Homo sapiens
ttttcatcagagaaatgctacactcagagcactgtcatccggtgaaaactgaaagcctgtccttggacaacggctgatctacaggattgcagggaggctctgcctcgagagaggtctggttccccacagggagcccagcacccag

SEQ ID NO: 504916 - DNA, 221 bp, Homo sapiens
ggctggctagggctagggaagcatctatagcatcatagatacactgccacttagtaagcattgtcatttgtggagacagactctagactctttggcctagagttgaagtgcactggcgtattctcagtgtcacggaaaagtcgaacctcccaggtgcaatataatcctggtgcctcagcctcggtcatggcggggattacgggcacgcaccaccaagccgg

SEQ ID NO: 504917 - DNA, 991 bp, Homo sapiens
ggtcgcacttgtgcacgggcgcgccgttccgccgctgcttggggcttttccgttcatcttcaccgcccgttcttggcattgggtcgtgttcgcgtctcgacacccgacagggcccgtctcccgagggcgcctcggtcgccgcatgaggcacagggcggctcggcgggttgacgggcgcgtccctagcatcgcaaacgttcagggcctggttcaaagcctgacggaagtttccgctcaacattgattcattcacagaaaactaagcactgggcacggcccggagatacggcagctaccgagcgaagccgctgcccggccggagcgcattcccggccattccacagcctccgccccgagccccgtggagacccgctccagcgagcagggcggacggggaggtccacacccaagtccagatccaaggcggcgcgaggacctcggagccctgagacgcagggagggccccgcaaggtcccggggctggaggggagccagggccaggagagggatcaggcgacgacccgtttggcccggggccccaggacctgtgcaaggacctgagcttcgacctcggcaagggcgagaacttggagaacctcccgcaggggagggacgggaccgaatgagctcaaggacatccctgggggcagcctgaaacagccagcgggcaagattggcaggggagacttcgcagatagagaggggcaagcagaggcctgttgtggccatgatgggttgaaccctgttcttggaatctgcacactgaggcgggaggaacggggctgtcacccccgggagggtcacgtcatgaagatgtgggacccagagcacatgcgaaaaaagagcccatgctgtttcccctgtcttgttctcctcctccctcctccctcccttcttggcgtcaaaaagaaaaaaacaggaacgagaaaacgacacactcaagatgacagcaagaagaccaagaacaacaaacgaagagaaaacgagcgcc

SEQ ID NO: 504918 - DNA, 221 bp, Homo sapiens
cctcactaacgattcgagtaatgaattggcagaagctcagctttgtgaaatagctcccgtttttcttcttgtggaccctacttagttccgtgggctcccatagggacctgattaatttctgccaatcagaacccatccctaacacatcagatgatagtggctttgactagggaagcagaggttgagcgaaaaaaccccaccaggtatggtttgagagtcta

SEQ ID NO: 504919 - DNA, 200 bp, Homo sapiens
ctctctctcctctctctctctctctctctctctctctctctcccaagcatcccccgttccaagtgaagttcaccctctaaaatcaccacggtcaaaagggacaaagcatcaaagcacgagcaatgagttcaaaacgttagcctagccacacccccacgggaaacagcagtgattaaccctttagcaataaacgaaagttt

SEQ ID NO: 504920 - DNA, 1060 bp, Homo sapiens
cacttgcgtgctggggaggtctgctacatgggattgtccgccctccattgatccttctggtcacgatatctccgcgtgttgttatgtgaagttaacttcagtctgcgagcttgcagaacaccacttatgtacaagacgctccattggagtacacgatagcatatatattggtataccatcacggtatgaatgttcggtgccaggagtctaccgtgcaatgtggctgtaggtgacgaaggctggcgggagctgcatgtggagcattgtgatgtgatgagtatattcagccttgttggtgtgcgagagtggcacgtggccaagcgtagggatgaagaccgttttagtcaggtccatcttttggtgtggaattgtgtttctgccgatgggaagacaaacttatgggacgctttgtagaacctgagtatttttcggttgtaccagtgtttgtagtttgagcttttaggtttattggagctagcaattattggttttggcaagtttggccagactgacttcagataagtaatgtgtatccagggacaatttgtaagaaacctgtacacagtgtttattgtggttaggaagcaatttcccaatgtatcctgataagaatatgtgcatcaagccagcctgaccgtacatggtgaaaccccatctgtactaaacactaaaaataagttagcactggtcatggtggtgtacgcctgtaatcccagtgacttgggtaggtctgaggccaggagaatcgcttgaaacccgggaggcggaggttgcagtgagctatagattcgcgccactgtactccagcctgggcaacagcgagactccatctcaaataaataaggaaatgtgtatcaagaacatgattattccaggggtatctttctaattcagatcatcaaactggattgatatagaagagttggctttaaaatgtttgcaaatgtcggtgttttttttaatactggaagaagaaatattctgttgtgtctcactacagtgctagacgatctctgtgcacagagctgattcaggcagtggctgtcgcgtgtcggggagt

SEQ ID NO: 504921 - DNA, 810 bp, Homo sapiens
ctacatagtaagttaccacatcataatcggaggactagatgaaccttctaggttaacgcaccacatctacaacgattatcgttcacagcccatgcttttgtaataatcttcttcatactaatacccatcagtaatcggatgcttaggcaactgactagattcccctaataatcggtgccccgcgatatggcgtctccccgacgattaaacaacataagcttcggtgactcttacctcccttctctcctttactcctgctcgcatcttgcttatagttggtaggcctggagcagcgaacgagtgttgatacacgtctgaccctcccttgagctaggcatactaaaaataaaaacacacacaaaaagtacaacggagcataatctaacccgagcactatctcagatatacaacatataaaagaggatcggtgatcgactgctcttatggcatcaagcgactgcactcccgacatatccgttgggcctactcctatgcagggtactctgccacagtctggcctctcactcgaagtctattaaacgtctagatatacccaatttgcttggcagaaggagaattacttatactctggacgcacatcactatataacgagctgaacatctgacagctgctgaaatcctacgctgaccattagcactgaactcctatggaagctgactaaagctccgacttcaaacccagccaggtatgccaacactttgagggatgcagctccacaatgtataggaagaagccaaaaagaatactacaagaagatgctacacccaagacaaaaactcataaccccg

SEQ ID NO: 504922 - DNA, 422 bp, Homo sapiens
tagtcacgaggtgatacaaggtggcggaagatcacagttgtaagatcttgaagtgagaccaggagacgaacccgaaattcaggtcgtgtagggaggctcacgcctgtaatcccagcactttgggagactgtggtgggcagattgcctgaggtcaggagttcaagaccggcctggacaacatgatgaaaccctgtctctactaaaaactacaaaaattagctgggcgagtgtcgtgggtgcctgtaatcccagatactcgggaggctgaagcaggagaatggcttgaacctgggacggcagaggctgcagtgagccgagattgtgccattgcattccagcctgggaaacagagtgaggctccatctgacagaaaccatcaagaccagaggtttataatctagtaactaactgtcttctatgtg

SEQ ID NO: 504923 - DNA, 661 bp, Homo sapiens
tatcgaatcgagcatcactggtcttgtcagtgtgctttcatagcaatgaaaaactaaatacccttcgtttactagcttaatcctgattatcgagctgcccaaaatgaaggacaaaatgtggtgagtagaactggcttttctccaacaaatctcagcatattgttattattttatatggatagattggaattttaatagcaaatttgaagactaggggctcagagagattttctgagtagagcctatggttcacaggtaaaagatgatatggcttagattatgagaagatattcaattatgggtgcttgggaagagttctgcaacttggaggccattgttggtggagtgctaaaggcagctggcatctgagcagatatggtgggtctaggtttagttttatttacccttttttcttctgtaaagaagaaagcttcatggtgacaacatggcttctttattcaatcaaaaattcagaaattcaggacaatttgatgtgatgcagacaaaatctctggatgttgggctagattttaaaaagtttaaagagcaattacctagatatccggcgtatctagatacggctgtaatcaatttcttaggagttagcattcctttgaaatggtagtatattaccctcattcaaattaccttgacgacgatg

SEQ ID NO: 504924 - DNA, 173 bp, Homo sapiens
agtattacagatgcttcgacgcaggaggatcgcatgtgtcacgcgcacgagtctccttcgctccgtactgcggccgtccgactccggtgttcgcgcttccggtcccggtcttgtcttgctccgttccctggagcgctcctgtctccttgtcgcgaatccgtggtgttcgccat

SEQ ID NO: 504925 - DNA, 121 bp, Homo sapiens
ctagagtgatccccataatcttccagtgtgcaccacacgcacttttccctctctctgtctgcactggggtggcatgatcccaggactgcaactccaagtgtctggattccccttactgact

SEQ ID NO: 504926 - DNA, 1059 bp, Homo sapiens
cttaaagtccccagctgcattagcctctaacgagagtgttactctatcttttgaagatttgaagtcaggtaatcctctctagctatgaaagttctaggtgacatcttcctccaatataagacctattttatctacattgataagtgttttgtgtagccactttcatcaaatatcttatctagatcttctagttgacttgttatagcttccatatcagtacttgctgcttcacctttcactgctatgtgacaacgatgacttctgtccttaaacttcatgaaccaacctcttttagcttcagatttcttcctcagcttcttcacctttgtcagccttcatggaattgaagagagttagggccttgctctggattagactttggcttaggaaatattgtggctgtttcattcttctatctagaccatcaaactttatccatatcctagcaacaaggctgtttcactttcttatcattcatgtattccctgaagaggcacttttaatttccttaaggaacttttcctttgcatttacaatttggctctttggcccaagaggcctagtttttgatctgtcttggcttttgatatgccatcctcactaagtttataatcagttctagattctgatttagagtgagagacttgagattcttccttttacttgaacacttagaggccatgtagggttatcattaactgaccttatttcagtattcacatcgacaatgtctcagggaatagggagccgagaaagagacggagaagaaccaggggaacagcctgttaggtggtgctgccagaacacacactttatgattcagttcgggcattaggtaatcgggcgtgaatttggtggtgaccccaaaatgtattgacacaacagtaccattcaaaattacactgatcaccttctcatacacaatcgcacctaataggcatcactaattgtgaaatgtgctacgaaattacacagacacattataatgtgagccctgtcctggaacacatgtacacccattgacttgctcagaagggggtgacacaaaaactttatgga

SEQ ID NO: 504927 - DNA, 1083 bp, Homo sapiens
tcccaggggatgagttttaaatgtgaggcaaaatcagtccacaatacaaaatctaaaaatcacacccattttccccaccgggcccccggggaggggggaagcgtgggggttcctttggccttgcagggttgtggggaggacggcagaggagggcctataaaggggagaaggaacacagaggccacagaggcctggctggaggtatcctgctgcccccgtgcccgtgtcctggagctgcccttggccctcctgtgtgtgcccctcttaccgggtgtgcacgcctgtgttggtggcgcccaagcccccaatctgtgtcgtggctcgtggcccctgaagaaggcctcgggccaccgagcttgctctcattttctcttttctttcttccaagcccctttcgaatgctgaatgccctctgtgttccccctctttgggatctcgttgtcacgtgccgcgtggactccttttaggattttggacctccttcattaaccgtgaacctttcttcgtgttccactttctctccccttgtggcccgagggcccacccgggtaccggggaaaccccggattgcaggcgggggagccccagggttacttcgagagggcgcaggcgctgtagacgcacattcgcttgtgaagagatgtgtgcgccatgtgatctgacaagatgtgggcttatgcgcccacagggggcggaacaaaaacttgttagcgcgctgtgcacaaacgctgtggggtgtcatagacaagtctacgcgtttgaggagggataatcccttaccttcacagagcgcgtgaattgcctccaaagagcgcacaggaaaggcaaaggggccacaagggacaagtactcccccttgagaaacgtggacagaccgtgtctctccacaaggttcccacacgcagatgtggccaaacgtttgcttgtgccatcacaaagagccgcttcatcctcgcaggaaaaattcctgtggggaaaaaacacaacatatcaatttgggagtgccttcagaaaggagcaccttgggcccactgtgttaacccattcacaattgtggtgcccaaaattaccccgagtaaaaac

SEQ ID NO: 504928 - DNA, 225 bp, Homo sapiens
cagcccctggtgtgattcaccggcacattcatgtacccataacggtgctcattgcacacgtggacggagaccccagcagcctggcaggcatggcgctggagaagctgagtatcttcgtcaagaccgtgacggagggtggtgcggcccatcgtgactggcaggatccagtgtgaatgatctcctggtggaggttggatggaacacgtctggtgggagtgacccaga

SEQ ID NO: 504929 - DNA, 1255 bp, Homo sapiens
ggcgcgtctcgggtgctgtcggctgcgtccggagattcaaaccgtagatccagctggaaggaaccatggacaactgtgagcgtagcttctattgcgatcaaaccagatggggtccagcgtccggtcttgtgggatgagcattatcaagcgcttattgcacgcgaagagaaggattccgccgttgtggggtctgcaacattcatgtccagcgtgtccgacagatattctccaaggagactactatcgttgagctgtaaggaccagctcctattctttgccggccgtggtgtgaagagtacatgcactctagcggtccgcgatagttggaccagtggctctgtggaggggactgaatgtgtgagatgaaagacaggagccgaaggtacataagactcgcggcgtagacgcaagacctgacagatctccaaaccgtgggaaccactcctgtggagaactgtctgactatacaaaggtaaggacaaggaaacacttataccatggggacgtgaatttctggtaggagagtgcaccatgaaatggtagatacgtgacgtctggtagtgtgtatacaacctctgtaggaagctggctagaagttaacaccgaggcctgttgtctcagggaagctggaatacttactagaattgacccggagagggcaagaccacatttgctaatcaccatcccatgttctccgtccgtgtcccattggggccaggtagagactcgatggcttgataggaaaagtctagtgtcattttaccatggaaacctgtcaatcgatcaaatttgggaacgcgagagacctcatttgtgaaggctcgttgtagagtttctcccctggtaacgaggagattaacctatcacacccgaagtcgagttctgaactttttaaaacttgggcttttccccatttccccaagtccccatttgaagtaaacaaggaaaacaacaaattaaactttcactagtatgtcccctcagttggcttacgataaggctatcataaaaacagccgcaaggcgaggcacgacggattgtacctatggtacgccaaacggacaaaaagcagccatttgtaactccaacaagacaagacgtgggggggcggccccaccaacatattggacaagatagttgtggacgttacagtcgggcgactgacaacgaaacgttaagatctcgtcagacaacatccagagagaaaccattgtcgatcgacagatagacaaagagtgcgacgagcgcaacctag

SEQ ID NO: 504930 - DNA, 138 bp, Homo sapiens
agtaagattgcggacattcagactgagcgtgcctaccacatagcagccgaccatctttcaacacaagaagagcggtcctgctgggagaaactggcaacggagaagctcccgcggttactacaagtaacatcgcctctg

SEQ ID NO: 504931 - DNA, 284 bp, Homo sapiens
ctccccgagcttatggagtagtcaagagacagcagaagcgtatggcatgctggggggcagtgtgagggaagatgaggctccagcggagatgggaagatgagcagttagagggagcagagttggtgtggacatgtgtcccagtacaatgaaacggcatgtacaaatgatgcaacaacgacagggcacaggcctgtggagtgtgcaatgacaagtgagacaggaggaagtgggcagggcgcagaatcaaagagctctatccaccctagaatgtgttctccggggct

SEQ ID NO: 504932 - DNA, 942 bp, Homo sapiens
taagcacggggcagttttattaaccattcaagtccagtagcatctgggtaagaattggggacagaatggggattggaaaagtgaacagatattcagcatctaacagttcaaaagaagccactacatactcttttcacaaattatgttttcacaagagccaatacaggtactagccattaacccagtacaccaaggggtactggaatgtaagaaaaagaacaccaaaaaaaaaaaaaaaaaaaaaaaaaaaaaaaaaaaaaaaaaaaaaaaaaaaaaaaaaaaaaaaaaaaaaagggggggcggcgagcaaaaaaaacaccccccggggggcacaaaccgacggccacccacggaataaagaaaaaagggggccccaaaagggaggggaacaaataaaaacaacaacagcagcgaggcgccgccaaataaacacaaagcacaagagaaaaaacacaaacaaagaacaacaatatgagaaaaaacacacaaaacagcgggagaacaacaaaaaggagacaaacacaacacacaaggaaatagaacaacccagagaggagaaaaaaaaaaccacaaaacgggataaaacggagttgcaccaccacagcccaccgtcacggcgggagagaacgaaattgagagacaagagaaaataagaccaacacacagaaacattaaacacggggggaggcgactgtagaatatagagacacacgcgagaggcaggaacgacgacgcaaaagcagagacaagaagagagaaacaagagaacaaagagagaagaagaacagaggagacagaagcacaagacaacaaagcaaaaggaagaaagagaaaagagaaaagacaaaaagaaaaaaacataacaagaaagcgaaaaaagaaggaaaagaacaaaaacacgaacaagaaaaagaaacagagggagaaaaaaaacacagaaag

SEQ ID NO: 504933 - DNA, 269 bp, Homo sapiens
  misc_feature (15)..(15): n is a, c, g, or t
  misc_feature (169)..(169): n is a, c, g, or t
  misc_feature (193)..(193): n is a, c, g, or t
  misc_feature (201)..(201): n is a, c, g, or t
  misc_feature (216)..(216): n is a, c, g, or t
  misc_feature (249)..(249): n is a, c, g, or t
ccatgcccagctaanttttaaattattttttgtagagacagtgcctcactgtgttgcccaggagttcaagaccagcctggtcagtatggcaagacctcacctctactttaaaaaaaaaaaatagcagggtgtagtgttacatgcctgtagccccaattactcaggaggntgagccgggaggattgctttgagnccaggagntcgaggctacagcgngctataatcgagccactgcactccagcctgggnaaccgagggagaccttgtct

SEQ ID NO: 504934 - DNA, 317 bp, Homo sapiens
atacctattctacattatgcttgtgtggcagtgtccccagtcttctatgcaaatatcttttcctgtagccggcatggctcatctgaaacacaagctttcaccaacccgcctggttaatactgggagcagggttaagcaatcatgttcatgctagtacatcaactctggtataaacgattgcaatcttgcatgacttacttcggagaataatgtatcttttgcttctaaggttacaagttaatcacatttctcttaattatttttctgtggttactgtcataccctttaatctattgtagattataagctctctaata

SEQ ID NO: 504935 - DNA, 783 bp, Homo sapiens
  misc_feature (51)..(51): n is a, c, g, or t
  misc_feature (79)..(80): n is a, c, g, or t
  misc_feature (116)..(116): n is a, c, g, or t
caagagaccctaagttgctcctatttaggcgtgccttcagatgctattctnctgctgcagtaataaataagtggtgcanntaattctaagccaaatcgcccttctctgccagattntcttgtcattggatggaaatctggccaacagcagggccttatcgcatattctacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagccgcaagcatcattgcagaaaccatgaccaaaaccaaagaggatgttgaaagccaaaataaagcagcaggtccggagcctcaggccttggatgagttcaccagtctgctgattgcggatgacactcgtgtggtggtagacctgctcaagctgtcagtgtgcagccgggccggggacaggggcagggatgtgctctccgcggtgctttccggcatggggaccgcctacccacaggtggcagatatgctgttggagctctgtgtcaccgagttggaggatgtggccacagactcgcagagcggccgc

SEQ ID NO: 504936 - DNA, 970 bp, Homo sapiens
gtgatctatgttagcgtcgcctggatcctataaggtcatacttgagcttggccctggtaatgaggcgggagaatcaggtctaagcagcgaaagatcctaggatgggccaagtcgaatcagatctgtagatgagatagggtagtatctgaacattcctgtgtatagccgcagcaaggctcctcccgtgtctatgatggatgtcatctcctgagagatcaccgactaggagagcccaaacactcctcctgttatactgaccatggatggatctcaagataggacctatcgtttatgtatgcccctgagatgtcaagttaagtgctaccacctgtgctgaatacctggatggtggagtcccgtgaattacttgcaggcatactgatggtgggcaggtggaaggcagtgtttgtgtataagagcaaaggaaatgcgcgcgttggaaccatactgaggtattgcgttttacgatcgtgcttctttctcgtgggaactagcctcaacattctttgtcgaggaggagcgtcagaacacgttctcttgccaagtggcagttcgtggagtccacgctgagcgatctgatgtgccataaatgtacggaaggtggtcgagcaggccgactacttgcgctgcgtgccttaaaacaggattgcgggacatcgattccctcagggcatgcttgccacagtgtctgtggattacagcggcgtgttgggtccgcgcatagggttggtgaaatatccattgaggaaaataaacatcttaggtcacgatccaatgaatgctgcaagcattctctccttggaaaaaatggggtggcgctttggggatagtacctcggggtaaaggtgaaaaagatggctcagtgggggtaagggttgaaaaggttttaaggagggctatgtcaaaatggtgataaggaaatttgggtagcttgcaaattaatggttgcatgtgggcctaagagccggat

SEQ ID NO: 504937 - DNA, 591 bp, Homo sapiens
  misc_feature (51)..(51): n is a, c, g, or t
  misc_feature (79)..(80): n is a, c, g, or t
  misc_feature (116)..(116): n is a, c, g, or t
caagagaccctaagttgctcctatttaggcgtgccttcagatgctattctnctgctgcagtaataaataagtggtgcanntaattctaagccaaatcgcccttctctgccagattntcttgtcattggatggaaatctggccaacagcagggccttatcgcatattctacagcattgcaaatcatgtatgccagagatgctgttgtcggggccctgatgccggccgccatgatcgccccggtggagtgcccctcgttctcctcggcggccccttccgacgcatctgcgatggctagtcccatgaatggagaagaatgcatgctggctgttgatatcgaagacagactgagtccaaatccatggcaagaaaagagagagattgtttcctctgaggacgcagtgaccccctctgcagtgactccgtcggccccctcagcctccgctcggccttttatcccagtgacggatgacctgggagccgcaagcatcattgcagaaaccatgaccaaaaccaaagaggtggcagatatgctgttggagctctgtgtcaccgagttggaggatgtggccacagactcgcagagcggccgc

SEQ ID NO: 504938 - DNA, 134 bp, Homo sapiens
  misc_feature (26)..(26): n is a, c, g, or t
tgttagacgtcggcatgctatgtttnagctatgtgggacgccatgagtgcagacgtctgtgatgtatatatacgatggggctcatcggagtactatcgattgtcacgtcagagtcgcagtcgctgttctaggaa

SEQ ID NO: 504939 - DNA, 680 bp, Homo sapiens
tgcacgctccccgaccccaagttacacgcacatacgccggtgaagctcggatgatcagcgcagaccgtgacgacctgtggccggcagtggtggtccataccccttcgacacgggatgcagtacggcgcatgagtgactgcagtccagggcggcaaaggacgctgacatcaatgtcaccatcgggtcacacgctcggactcggttgaagatgggacacgatgtccttgctatgacgaatgaagcggggggcacaagggcacgttcttaacaatgggcgtgcagtggtcacaaacgtgcctgtcggggcatggggggcgccctacgtgctggtcctgtacgatcgagctcaagaaggtgatccaaggtccgcggcctcctccagcacacacacagcacagccaggggaacgcagagagaaccagcgtgagaatcactgcaaccgtgcggaccagtcaaccttgcgagaaattccagttgtctgttttcccagccgcatcctgccgtgtagatcggctcggggaaggactcctagaaaaggggcagcattgcgatccaaccatcggcagccagattccgtgtcttgatcagcggggtgggagggaagccgtggcgtccctgcgtggggcccatgggtgagacactccagtactgagacctagagtcaatacgcttgtagagca

SEQ ID NO: 504940 - DNA, 379 bp, Homo sapiens
atctagaggatccttgttactggcatttcaggtaagctttaatatcagcaaaaaaatgattttataaaagtaattctcaggatctctaggacagccagcaaacaagaattagaggttacaggccaggcacagtggcttacgcctgttattcccaacactttgggaggccgaggcagacggatcacctgaggtcaggagttggatgctagcctggccaacatagtgaaaacccgtctctactacaaaaattagctgggcatggttggcgcatgcctgtaatcccagctacttgggaggctatagcaggagagtcgcttgaacccgggaggcggaggttgtagtgagccaagaccgagccactgtactccagcctgagcaa

SEQ ID NO: 504941 - DNA, 296 bp, Homo sapiens
ctcccctttaatgggcacagaaatttgtggagatttttatttttacaaatgcttcctgatgatgactaatatctagggaaaagtttgtgtcaacaacggaaagttatctggaacataactttcagtttcctctgcagtttataagtgctgaactactgatcatcctagagattacccactgaacagtcttctctaatccagttgtacaataggaaagtctttttaacatttggtttgataaaatgttatccgaagaaatactttacttgcctattataatttctgtgcccatttca

SEQ ID NO: 504942 - DNA, 207 bp, Homo sapiens
gatctagaggatcgcggaaaaacagaatccagtctgggcaccaagggggggaagatcacttgaggccaagagttcaagaccagcctggccaacatggcaaaactcagtctctactaaaaaatacaaaactctgcggggcgtggtggcaggcgccagtaatcccagccactcaggagactgaggcaggagaaactttaacccgggagg

SEQ ID NO: 504943 - DNA, 1009 bp, Homo sapiens
  misc_feature (408)..(408): n is a, c, g, or t
  misc_feature (1009)..(1009): n is a, c, g, or t
tctatgtctagatctttattaaataagatcgatcctatattcagcacattatcttaatataataatagtatatagttcattaaacaatattaagaggactatttagctggcagacgctctagttaggcgaatatgtctcttgtgaatggcaagttgtattgcgtcacgacttgactagcgtatcattctatacaccaatttaggcacacttcttacctagacatcatcaagagagtgttgtcagtacaccaccgtatgtgagtacgcctcggtatgttggagacgttagaactcacgtatattgtcattcacacacgcgagcgttgatctgtaagtatagcatataagaccaaaccaactctagagagcgacatacgtcttatgtattaaggtagactagtagacaanacaatgggaataattcgagacgcagtatgttccaagtcacacctagatatttacttctctgtgaccatacttgcgatgcacctctctcttcttggtacaagcatagacaagagcgtgcgtggcgctcctattggtccgaaaaaatatacactgcgagtatacttcaccgctggataatattcccaactggcgatccgtagaaagaacattatttgagagcatcttcaagtcagggtggctcaaatgtagcctattaacacagcaccgtgtcagcatggatatttacgggccttctttaatagacacggataggagaaataaagcgcaacgtttttatctcggccctctatttaccattctttgtccccccttgttgaaatgctcactcccggaatttcccctttggcactagataaaacgagtgaggcttcgtggatattgagataataggtccccacttgttgccaccgctgtttcattgagcaaaaactgaaacatttttaattggctcctgggagggagtaccacgaccaatttttccggcgttttcttaacattttatttccacaaataatggcggcgttgccggggaagaacatgn

SEQ ID NO: 504944 - DNA, 190 bp, Homo sapiens
catgttccaatatgattccacccatggcaaatccatggctccgtacaggctgacaacggggaagcttgtcatcaatggaaattccatcaccatgttccaggagcgagatcccttcaaaatcaagtggagcgatgtggccctgagtacagtcgtggaggccactggcgcttcaccaccatgatgaaggctg

SEQ ID NO: 504945 - DNA, 110 bp, Homo sapiens
attcagcaaatagctatcataactccctcaaataaagccctgatccgcccagagagctacaggtctgctcccgacgggcctcgggcatgaaccgtccacacagggccgtg

SEQ ID NO: 504946 - DNA, 949 bp, Homo sapiens
aaaaaaaattagctggctcacgcttgtagtcccaactacttgggaggctgagggaggagaatgcttgagccgagatcgcaccatgcactccagccctggtcgatgagagtgtaaaccctgtcacaaaaacaaatacaggaaaaaaaacataaaaaaaaacattgtgtcgcggggcggcccttggcgcaccctcgaaaaagcactttaaaacaccaatccgcgatggaggcgagcggggggccccatgaacgatgatacgtgcgcaacctgtgtgaaaaacagatggcacacctagaggaacaacggggtgcaagcgacaatagtggcgcgggcgttactacccacaataataaaaaacagcccgcgggggaaacaacagcgcgcatgctatggagaaaaaaaaacatcacaagaggagatatagcaggagagaaaaaagcggtgagacatagatcaaaagcggcggcctcaaaacgcagcagcaacacactaataaaaatagcacgcgccgccgcggcggggcaaaagaccacgacccgaaagcagagaaaagaacacacagacgacaaaaccacacaagagcaatgaagcagaccaacagagcacagaaggacgaggaaccacagcagaaacaccacaacgacaacgacaagagggcgaccacacgcagcgagacgccgacacacgacgtagcaggacacaagaaagaacgaagagcgagcagacgacggagggagcgaacaagacggaaggcccagcaacaaaacaaaaggagaaggaaccggagcccacagcacatccagcccgacgaaatcgctacacaaggacggaagcgaaaacaacacacaaacaaaaagaacaccagtgccacacgagacagcacacgagaaagcaagagagaaaagaaggcgcaaagcgacagcacacccgcagccagaggagaccagcc

SEQ ID NO: 504947 - DNA, 282 bp, Homo sapiens
  misc_feature (30)..(30): n is a, c, g, or t
acaggtcgaggtatacccaacttgtataangtaagtgatcgcgcggcactaggaaggaggagacgacagtgcctggttactacgaatggcctgcagcaccggggtgataccactagtatctacgagacgtgcctgccacctgcggatgtgcagctccagactaatatgtaaccctatatagatgacggtgtataacttatgcgacgctatgtgacgtaaatacattgagtacattagactagtatatccttgttgatagaacatatgtataatcacagcata

SEQ ID NO: 504948 - DNA, 403 bp, Homo sapiens
  misc_feature (11)..(11): n is a, c, g, or t
ttaaatcagcnatcattaagtgaaaactgaaagcctgcattgttgtgccgtttacaagctgttcactgtatcagtggtgtgtcatatttttttttttgccatccttgttcctgtgcgagttatgtcatattttttactgttaagtacttatgcatgaataagtataagaaaataactgcttattggtagcatatacattcagtcaggaatgatggtgacatcaaccaaccacaaattacccacatgagtggctgagataatgacacctttgctttctgatggttcaaggtatgcaaacttggtctcaatgcacaaaattattaaaaataatgttatataaagttaccttcaagctatgtgcataaggtatatatgaaacaagtgaatttgtgtttaaacttgg

SEQ ID NO: 504949 - DNA, 220 bp, Homo sapiens
gaggatcccccgttcctgcttacttgaaaataaagagtcagaaattcagttacccgtctctctgcagaccggaagcaggtacttacctattattatgccaactaaacacattcacagtatatttattagaagacaagtgatatatggagacaccatgtgaaatccattctaaagaacatttcagagttttatcagctttctttcaagaagcaggaactgg

SEQ ID NO: 504950 - DNA, 1695 bp, Homo sapiens
  misc_feature (846)..(846): n is a, c, g, or t
  misc_feature (888)..(888): n is a, c, g, or t
  misc_feature (1421)..(1421): n is a, c, g, or t
cggtgacactttctgtgtagcgggaacaacagccgaggcgggggacacgcagcagttttttcctccgaccccgcgggtctctcggggggatgttattctcacatgtggcacacacctggtttctctctcgcgggcacccaacagtgtgtgttactcgggaagatgtttgcttgagcaagctttcccacctggggtgctccactcctcctctcgtgttttctctcccccccggcgagtgtgggtgcttgtggtgcgcccgtccacccgtgctgtgccccttgtgagtttgttcacgctttttgcaccccactgtgttcgccctataatggttcgtgaccgtggttcccccacccggtgttgcccccgtgcaaagtgcgtggcaacacaccccccccggagagttggttccaaagtgtggctaacgcgggatagttcggggcctccctttccgtgggggggaccgccttcgccttcttttttgaggtgttttcctcactgaagaaccgcgggaacaccttcgaacggggggcacaacaccctggtgagcccccggccctctttgttgagaagaggagtctccccctcccccgaggggggttgccagccccctgttgtcggagaccctggggggggccgcgcccccctcctcccaacgattgggggcggaaaagagggagcgcccctcttggttttctccacaagaggggaccacacccctccttgggtcgcgccgctggtggaacacctcttcttcgttgggggtcgctcgcgctattatccacgacggcagctggtgtttcacacccagagagagtgtccactcttttcgcggggcctatttttgtntcctcgccggcggcccaccatgggaggacacacaccattgtngggagaaagacgccccctgtcctacacggtgtggcgacacatggctgttgtcagcgttatactctccctcgaggggtctccccacaggagcctcctctcctccgcggtgttatcctctcgcgcccccgccggttgtctctctacaatatcctctcggggagaccacccacgatttctctcgcgcccgcagagggtgtcccacacactcgccttgtctctcccgcctctctctctcgcgagagggagagtctcgggcgcccctcgagacaacgcagcagactctgggtggacacccctgtagaacactggctctctcgggcacacgcttgggctcttcacacacccccacagagaatttttgtctgggtgttcgcctggggctcgccacagcgcggttcacacacagagagagtcttgtcctccccgcagagagaagtatacctcgagactttggggcacttcccgcgccacaggagagcccacacccacgggcgacccacccaccctttcgcctctgtgagaccacgcactanctggcgcgtgggcacacccgagggaactggagaagaaagggggacaccctcttttcctgccacttggtgggcccacgaaggccctgcccctggcctttacacacacacagaaagaaccacttgagccccttggcgggtgtaacccaccccacatgtcacacagtgttctgttgtcactggcgcgagggtggagcggcacacctggtatctgaggccccccccctgtccccacaccccctggattaactccctagcttccccccaccgcccaata

SEQ ID NO: 504951 - DNA, 889 bp, Homo sapiens
  misc_feature (887)..(887): n is a, c, g, or t
tatttttaatgcttctgtagaatatgacctattaaaagaaaatcctaaactcaaatttaaattatccaaattttaggcaaattattatttctcaatatgcgaacacagtatttagaacacaatattagaaacacaattctaactaaagataaataaggagaaaacatttaggattttgcagataagtcaacagaaagtgcctgctttacactcatgagtaaaagcactccagacatttttataattgcaagatttttatgcttttttttttttttttttcccaaactctggtgctctgcgggtgactaattgtgctggaaaaattttccaaaggccttacacttaagtccggggttttcccaatagtatcttttgttcctgggaaaggccacttccgaaaagtttactttccactgggagggctgccttaaagtatatctccttatctatgaccaatttctttggggtacttcagaagttttcagtacacccccttagagaatagcttatgagttttttcacactcctgagcatggctgtgttcagaactgatctagtgaatccatacatgagctggactagtgatacttggacgagtaaatgggaccgccatgtcctggttctgtttattccaacgcttctcttttacactatttctagtaccccaattggagggtccaggaagaaattctgggcaatgggttaagactaggtaccctgtttcgggagcgggggtctttaccaaacgcaatgttcttccttcacaaaaaaaaaaattgcggccggcaaattaaattgggggcgaagaaagacagttagaacgacagggtcacaaggggctaacaattgttaagctcacccactcaactgagaaaaaaaaaaaggcntg

SEQ ID NO: 504952 - DNA, 201 bp, Homo sapiens
attagtactcataaattaagtaaataagcccaaacgcttttcaagttcacagggcattagtaatctgtggtaaatgaagatagtttaaaatttggggtaaaataaaatagaaacatttctgaatttaatttagatattttctgggtctatttgttagacaggttacactatctctgctatttttttaggacctaactgatg

SEQ ID NO: 504953 - DNA, 228 bp, Homo sapiens
ctgggatacagctttggtgatctttgccgaaatgactttgggagatgctgaaatcacacttagggtctgagactgtcacttctgtggcccttctgtctcctgctgtgtggttcagcagtctgggaactggtgaaggccggagggccggcgagggagggtgtcatcacagaacaattgatgggcgcttcggagcgggtctttcattctcttcacccccactgtgtggaa

SEQ ID NO: 504954 - DNA, 190 bp, Homo sapiens
ctcactccaggtaaatcatcccggggggcattaataacctagccggtgtccctggttaaaacacctatgacaccagcctacacatacgcacagcgctctgaggtgatttatgtgaaaatagacaatacaagacataaaaaagatataacggtaaacctcacgtagggctagctatatagacactagtcag

SEQ ID NO: 504955 - DNA, 269 bp, Homo sapiens
cctctgggctcttcaggtgggaccaggctcaggccctgactcaggtgtgctctgtgctgtggtggggttgggggaggagtgagcatccccttccaggttgggtgtggcggcagcagcagcagcagcagcaggaaaccaaggggaggtgagatgtgagacatccctcccagctttagtccactgccaaaaatcagaagccagccctggtccccaccaatttccagggagagaaatgagaccaggccaggcacggtggctcagtgcttgta

SEQ ID NO: 504956 - DNA, 649 bp, Homo sapiens
  misc_feature (540)..(540): n is a, c, g, or t
atttataaggcccttcaaatttgtggcttcctttctcatacttctcaagtataatgaaagggggagaaaaaccccaccatcaacacaaaagaaggctataaagactgtgcaccttttaacaagtcaatttgtcatcagtccctgggcctagtcttttttttttttttttttttttttttaattttaaaactacctgaggtttaaaattccttcaaccctagctacttttattctactttttatttaaacaaaaagagggggaggatcttaaggaaactaattttctatacaaaggctttaaagtccatggactatacttatcccatttatcatcccaagtggtgctttaaccctaccataccctggctattaaaataaaaagatttttggacattaaaattattaatatatcactaataatccaccacacatttaaatatttacacacattaccataatttgtgcaacatcttataaacaatatcatttccatagtaatctaaggcttcaccaacctggcccactatatctacactttangttcattttaataattatactttccttctctttatcattttggaaatttataaatatcactttcttacataccttcattcacagatatatctagcttttaccttttgcg

SEQ ID NO: 504957 - DNA, 135 bp, Homo sapiens
aatgtaaaactggataaaaaaattattttggcaggtcagccctttcccttttttcccctaaatttttttttaaaaaacccatggaacccttttaactttccagggcactttgccattaaagtcttttcccattga

SEQ ID NO: 504958 - DNA, 584 bp, Homo sapiens
tgtgtttattcgatgccacccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatcgataaacaacggtgtttatcgatgccacccattgacaagttttgtgaatctttgtcatcaca

SEQ ID NO: 504959 - DNA, 176 bp, Homo sapiens
atggaagttatgcagcagcaagccaaggaatagctaggattgccagcaaacccccagaagctaggaagaggcccagaaggcttctgcacaggtgtcaaagggagcatggctctgctgacaccttgctttggatttctggcctccagaactgtgaggcaatacatttctactattct

SEQ ID NO: 504960 - DNA, 418 bp, Homo sapiens
agaatttgtaaaagttcgtatgctttgcctctcaactgcattaacatgccacaggctcagactgtttttgtgtaaaggatgtcaaagaacggcactttttctaaagagaagtttgatattttgtatgcttgttaagaaagtacagtattggaaattaaaggtggacaactgataattgacatactcctcaattatcagttgtccacctttaattgaggagtatgtcaattaattttttatgtatattacctgtttacttgtacaacttactgtacaaattacatgcagcttcattttcaaatgaatccttaaaataaggaaatctttttaggaaaacatttaatttttgtatttttgattttaaaggcatgagttatgtcaattttcagtgtattaatgaagattttaacttttcatc

SEQ ID NO: 504961 - DNA, 330 bp, Homo sapiens
  misc_feature (96)..(96): n is a, c, g, or t
ctccactgcgccattctgacctcaagaagtcagttaggcatggctgtaatatttcttttcactcccaggtataccaaattgtaagtgcaccggatncaaaatcaccccttctgcaagaaagcctctttgcaaccgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacaccttccgagtgtgtgctctatccccaccactgtgctcgtga

SEQ ID NO: 504962 - DNA, 702 bp, Homo sapiens
  misc_feature (500)..(500): n is a, c, g, or t
  misc_feature (694)..(694): n is a, c, g, or t
acgagctcgtgccgaattcggcacgagccgagtcctatgattacacgcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagttctgagaatcagagacagaacataaaaggcctggaaaacattctcanaagaactgcacatgtgtgacatggctttcatgccttctactgctgtgacctgtcagaacatgcttgtatgctggaggagatgagtagctacactctggctaactgctttatacttgatgacttgttctgggagaccagctgtacatgaacgacagtgatggaacacagggcatgactctactcatgcgagctangagtaata

SEQ ID NO: 504963 - DNA, 133 bp, Homo sapiens
  misc_feature (89)..(89): n is a, c, g, or t
  misc_feature (118)..(118): n is a, c, g, or t
gggagaaaccagaaagtcttgaaaagatcctgagactccaacaggatgggccaccagccacctcctccaactcaacaacattctataantgataactccctgagcctcaagacacctnccgagtgtgtgctca

SEQ ID NO: 504964 - DNA, 896 bp, Homo sapiens
  misc_feature (18)..(18): n is a, c, g, or t
ctccacccgacggggtgntaatatcaagacacctgccttccaccctcagcggatgatctcaagacaccttccgagcgtcagctcactccccttccaccctcagctccaccctcagcagatgataatatcaagatacctgctgagcgtctgcggattccgcttccaccatcagcccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccccgtcggagagcgggccaggctcatcttccacgcctcaggcggatgataatctacaagacagccttccgaggcgtcagcgtcactcgccacttcacaccgctccagactcacaagaccgtcagacagatgatagagtagtcaacgacacctggccagacgcggatctgcggggaggccggcttccaaccgctcgaggcggatggacaatcgtcagagaacaccattccgagacgtcagagggacacatcccacattgcaacccgctcgagccttaccagcccgtcaagacagaatagataagtaactcgaggaaccaacctggcacggagcgatctgagagggaggccgaatgtaccaggccatacaggccaggagtgacgtaaatcgtcaagagaacaaccctgcccaaaagcatagccacgagagaaggcatgaggggacggcaccgaacgcaacggacaacaccccaaagggaaggacagaagggcgggaagaaacatgagaaccagccatcccggacgcgcacaaga

SEQ ID NO: 504965 - DNA, 383 bp, Homo sapiens
  misc_feature (287)..(287): n is a, c, g, or t
  misc_feature (321)..(321): n is a, c, g, or t
  misc_feature (329)..(329): n is a, c, g, or t
  misc_feature (338)..(338): n is a, c, g, or t
  misc_feature (365)..(365): n is a, c, g, or t
  misc_feature (370)..(370): n is a, c, g, or t
cacagacatgaagagaacacaaactccacacagataatggccccgggctaagaatccatttttttcttgtcaacattataagaaagcgacattgagcataaagacattatttgaggacctgccgtactatgtacttagagagataggcattctatcttgagttccttttttttctcccttcttgaaggaagattaaattgcatctgagatggctcttgaaattgatcggggttcaagctgacttgcatactctttggggaaaggaatttaggaagggatgtgtatgnagggaagttcttatggattaagcctgtttcctgnacttggantagatggangcaaatgttttttcactattctgggangcatncgcatttctgggg

SEQ ID NO: 504966 - DNA, 346 bp, Homo sapiens
  misc_feature (68)..(68): n is a, c, g, or t
  misc_feature (301)..(302): n is a, c, g, or t
cattaggatgaaatgagacccatgagggtagggcccctcatgaatagggttaagagggtaaattttgncccaggcacagtggctcatgcctgtaatctcagaacttttgggaggccgaggcagggggatcacaaggtcaggagatcgagaccatcctggccaacatggtgaaaccccatctatactaaaaatacaaaaattagctgggtgtggtggcgcacgcctatagtcccagctactggggaggctgaggcaggagaattgcttgaacccaggaggcagagattgcagtgaacagagnntcggccactgcactccaacttggtgacagagtgagaccccttca

SEQ ID NO: 504967 - DNA, 189 bp, Homo sapiens
ttatcccccctctaaacaggaagttcatactactcaagtcctccagtggactactggctgctacagtttcctggtgagtgggggtggacctgggcagcactctgggagtgccagtccagagggcccagctggtgctgggtggagctgttctagagaatcgcttgaacccagtgaggcggtggttgcagt

SEQ ID NO: 504968 - DNA, 1968 bp, Homo sapiens
  misc_feature (1455)..(1455): n is a, c, g, or t
gctactctggtattgaagcacaatcaataaagggtcctaaagaagatgcactgccgaacatattgcctgggccatgtatgttgcaggttgccgagtggtatcaaaggtgtgcatcgataaagctcgcaaaggcaggtttaagccacaaagagtctcaaagggctggtcaggccgacaagcgtcgatcgaacttgccgtgacattgtgccacctccaagcgtgggcaagcggtgctcggatgtcacctgtatatttgtcccacatcggtcggcttcaatggcttgaatgcctgtgttccatatgtgcacaaaggacacaaagggcaccatagggggcaatgtgctctagagtgagtcgaggacgcaaagaggcccgaagggcatgcgaagaacgcgcgagcatgtcgaggctacccaaggcgttctagtgccgtcgccccacaaacggttaaccccctgagtgtccccccccttggacgagagaggaggcctttccgggcagggtgagcaatcactccttacatgaggcgagacccattgcagtgtgaccaggcacagggacacttagagctgacagagatctacacaccctgagactctctcgagacgccattgtggggggccataaaacacaattccttggcaaattgggtggggcccttgggggcggtttcccccttcccccttgttttggcctttaattttttggttaaccgaaaagaattaaaaaaccccttgggaaaggggccacgtgcacacacacagactatactacacaataaaacacaacagaaaataactctcgcgagggagagcgcctatctcttaaagttcttaacgcaggaggtgtgccggcgacaagacacacagagagacgggctaaagagtggacaaacgtgtggggcccctacatgtgggcacaaaataagcggacgtgaataccactgtgagagcccacgaggagtatttctcgtgttgggtataccaacagagtgtggaggcgagacagctgcgaagccagcaggggaactctccccacataaagtaggagaaccaggcacccgaaaatagaacacttgccgagaatcaacagcgcacagagaggtaaaaaagcccatgggaccatagtaaaagacagatacagcagagcacaacaaacaagcagagcaagcaacaagcagcagcaggatcccaggaacacaacgaatactgacagaaacaaatacactagacaagcaacgacgtggagcaaatacaactcaaccacagagcctattgtcacacaccaacaaacaaaaccacagctactaggctatcatctagcagcagctcaaccagaacttaacaaccatactaaacagctagaaatcacacacataacagatcaccactcaacactacactcaactagcattaccttcaaacactatcaacacacgcagcacaacacaacacnatcaacaactactacacagctcactcacacacatacactcaggatagacacatcagcaaacctgcacaggataacaaactagactgcacctgcagacgaagagcatagcgaatagcagatagcagaggaacgagcgaaaggtctggaaagagaccgcagcgagagacagcatgaagcatgcaggcgatcgacgacagacagcagggtcagacgaggagcgagagcgacggagataggagaacgagacgacagcgagacgcacagagaatctagaaggacgcagataacgagttgaactgcagaagcgacgagcagtgagacgcgagcagcacgaaagatacagagatgcggcataacgagaaacgatcacgagagtactcgcctgatctgatgatagagagcgagatcgagagtaagacgaagacacgaaagagagtgaagcgggagagatgagagcagagcacgccaggacgtcagacgaagacgagatcgaacaggatgcatcatatgaac

SEQ ID NO: 504969 - DNA, 316 bp, Homo sapiens
  misc_feature (150)..(150): n is a, c, g, or t
  misc_feature (286)..(286): n is a, c, g, or t
catcgttggcactcagagagaacttcagccggtaacttgcagcaaaccggccagccgctggacttggcggtcaacggtaagggtttcttccacatcctgcaactcaacaacattctataactgataactccctgagcctcaagacacctnccgagcgtctgcgggggccgcttccaccctcagcggatgataatctcaagacaccttccgagcgtcagctcactccccttccaccctcagctccaccctcagcagatgataatatcaagacgagcgtctgcggggncgcttccaccgcatacgcacaggcagtctg

SEQ ID NO: 504970 - DNA, 969 bp, Homo sapiens
atcccccccgaggcagacgactaacatcaaaacaccatcccagcacccccggcgagcgtctgcgggggccgcttccaccctcagcggatgataatctcaagacaccttccgagcgtcagctcactccccttccaccctcagcccaccctcagcagatgataatatcaagacacctgccgagcgtctgcgggggcccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccatccaacccgtcagcagaatagataagtatcaagacaactggccgagcgtctccgtcggagagcgggccaggctcatcttccacgcctcaggcggatgataatctacaagacagccttccgaggcgtcagcgtcactcgccacttcacaccgctccagactcacaagaccgtcagacagatgatagagtagtcaacgacacctggccagacgcggatctgcggggaggccggcttccaaccgctcgaggcggatggacaatcgtcagagaacaccattccgagacgtcagagggacacatcccacattgcaacccgctcgagccttaccagcccgtcaagacagaatagataagtaactcgaggaaccaacctggcacggagcgatctgagagggaggccgaatgtaccaggccatacaggccaggagtgacgtaaatcgtcaagagaacaaccctgcccaaaagcatagccacgagagaaggcatgaggggacggcaccgaacgcaacggacaacaccccaaagggaaggacagaagggcgggaagaaacatgagaaccagccatcccggacgcgcacaaga

SEQ ID NO: 504971 - DNA, 482 bp, Homo sapiens
  misc_feature (63)..(63): n is a, c, g, or t
  misc_feature (74)..(74): n is a, c, g, or t
  misc_feature (268)..(268): n is a, c, g, or t
  misc_feature (271)..(271): n is a, c, g, or t
gacgtgtggcttcagcatcgtcattctgcgtcacgcctggccccagcttcagtgcagacactntccagctgcanctcacctcagctctaccctcagctccaccctcagcagatgataatctcaagacacgtgccgagcgtctgctccatccccttccaccctcagcggatgataatctcaagacacgtcagctcactccccttccaccctcagctccaccctcagcagatgataatatcaagacacctccgagcgtctgcggggccgntcnaccctcagcggatgattcattctcaagacaccttccgagcgtcagctcagtccccttccagcctcagctccagcctctgccgatgatcctatcgagagtcctgccgagcgtctgcgggggtcgcttccatcctcagcggatgatcttctcaagacaccttccgagcgtcagctcactccccttccaccctcagctcctgcctctgccgata

SEQ ID NO: 504972 - DNA, 658 bp, Homo sapiens
tgagacaggtctcagttaatttagaaggtttattttgccaaggttgaggaccctgtgacacagcctcaggaggtcctgatgatatgtgcccaaggtggtccaagcacaggttggttttatacattttagggagacatgagacatcagtatatgtaagatgttccttggttctgttgggaacggcaggacaacttgaagcagggagggggcttcgaggtcccaggtaggtgagagacaaacacttggattcttttgagtttctgattagcctttccaaaggaggcaatcagatacgcatttatctcagtgagcggagggatggctttgaacagaatgagaggcaggtttgccctaagcagttcccagcttgacttttccctttagcttagtgatttctggggccccaagatttattttcctttcacaggggccatgttatgtagaagccaggctgagaaggaatctgattccttatattgggttatatttttttctgaaataaatgttagcttttattttccctccaagctgcaagagccattgaactctgacttctgtgcttctcacatttaaagcctcctgatttgagtacttagtacctgccaagacattagcaggtaggagttactattcccacctgacagtcaaggaaaggcca

SEQ ID NO: 504973 - DNA, 491 bp, Homo sapiens
  misc_feature (11)..(11): n is a, c, g, or t
  misc_feature (446)..(446): n is a, c, g, or t
aagacacctgncgagcgtgcggggagcgtctgcgggggccggcttccaccctcagcggatgataatctcaagacaccttccgagcgtcagctcactccccttccaccctcagctccttccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcgatgatantctcaaacacacggggggatgagcacacagtaccgagctcgatga

SEQ ID NO: 504974 - DNA, 371 bp, Homo sapiens
cagtgttattaaaacaggactggtataccaggtatacttacgttaatgagtctagtcttcatgactactcaccacagatcattggctgagagtacaatgatcatgcaaagattcttttatgttgctttgtgtttgtgtattagaatcattgtacgttgtataccttttgtccttttttactcgatttaaaaattttcaacaggtatttatctgaagtactgggtacaggccagtttttttgttttttgttgttgttgttttttgaactaccaccacagtcatgcaaatgaatatgagctgttgaattaattaccctatcttctacatctcttctacttcccatcacgctggcctacagcacatgccgggga

SEQ ID NO: 504975 - DNA, 214 bp, Homo sapiens
  misc_feature (168)..(168): n is a, c, g, or t
atgaggtctagaggagtcccaagtgtgcgagatttcgttccaccatcagccgatgataatctcaagacaccttccgagcgtcagctcactccccttccaccctcagctccaccctcagcagatgataatatcaagacacctgccgagcgtctgcggggccgcttccancctgagcgatgataatctccagagggatcctctaagtcacctcagc

SEQ ID NO: 504976 - DNA, 718 bp, Homo sapiens
ggcatgcagtgacggcgccgactctctgccctgccatgcggctgggtggtgccacaagatgcctcacgcgtgccgtgagttggcgtgccgcatggaggccgctctccttcagtaatatgtaacaccagtcgaggtctgccgtccatcggggggcgagccttccctgatgtgccaacgcccagccgttcgccttctggaatcacctagaactccagccgcgtgccagtctgtggacgttggttctgccgcgtgcgtcgtgtcgcgagcaatgcttcgcacctgcccagttctggccaccccctggccctcgcgtttcccgtctcgtgttgtaagttgggctgacaacgatggcacgccgagcgtttggcggcgtcggtagctttgacctgctctcctagcgggttgcgcaatggcatgccacttgtggaccatgggctgatggcgtctctcaaggaccgcatccgttctggaagggttgcgcacaggacttcgtcgccagggggaggtcgttcattgggcgcgcaaactgggcgcagtacatcgcagggcgaagtctggacattctcgttaataccactcccctcgacgattgtcgctgtgcgggcaggatgtgcgctagggattccacacacggcccaccatgcagcgccgttggccccctgtatgttgcggaacatccttgcggtgtcccatggttccccgtgggattgcgcccttc

SEQ ID NO: 504977 - DNA, 104 bp, Homo sapiens
tgtggacatttccacgagttgccactttatgaatctgtatgccatatgcctggcctattgcatacatgattcataaatgtgggtgactctgtggaaatgtccac

SEQ ID NO: 504978 - DNA, 82 bp, Homo sapiens
cggaggccggcgtcggctgttgcagcctgctgcgcgcccagggtcccgcgggttttcgggcgcagggtggcgcccgcggcag

SEQ ID NO: 504979 - DNA, 479 bp, Homo sapiens
  misc_feature (362)..(362): n is a, c, g, or t
aagaggtgacttagacaccctcaccttgaagtttccacatattttctatccatagtatttgtatacttcacacgaagacttattagtggataaatataataaactccttcctattgaaataaaatttgagaagaacatggtatgtgccagccaaagcccaaattcaaatgaacccttctgtgaaggggaagaatcagtcttgttgagagaaagtaatttagatgcagaaggaatcccagctgcctagaaatccccgttgccaacagcaggcgaaaggaaccacccatgggagggaatgtcgcagggcagcggcaggtcgggcggcagtgcagcagccgtgagaacgcaggactcacacttcngggctgtgtcgccaacattggcaaccagtcgtcacctgccaacagcgccacccacttgggggagcatggatggtattggtcgggctctatccagctgtttgttagcagtgagtacaa

SEQ ID NO: 504980 - DNA, 171 bp, Homo sapiens
tacgatacttagacgggtgctcctctgtgtgctgtgatgtgctgcggatatgtgtgtgtgctgcgtccgtgtgtgtagctgtgttcatgcatgtgctgtgtgttgtgtgtgtgtagctgcggggatgcataacagtatgagtgtttttacggatgggaattgacgatgtaa

SEQ ID NO: 504981 - DNA, 387 bp, Homo sapiens
gcattctggactccctggatttatgcaaaaactgggatactttctcaaaacactctaatataagcagagcttatgttctttatcccccagaacatcagcaagcaaaatgcctgaacatcccaaaaaactgttgccatgacctttgcccttgactggtccacttttgcttcgactggaccacttccatttttggtagccattgctttgattgtgctttgtcttcaggatggcattggtaaagccatgttttggctcctgttacagttctttgaagaaatgcttcaggatcttgatcccttgtttaaatttctatggaaagctctgctcctgtctgcagttaatctgggtgcaacagttttgtcacccatcaagtgaaaagtttgttgg

SEQ ID NO: 504982 - DNA, 236 bp, Homo sapiens
aacatgaggcaggtatttacatagtagacgtactaggtctgcgaagtgctcaggtaggtcatctgcatggtataaatgctttaggtgccctgcctctgatgctgtctacacggggatggttagtaggtgaaggcctctgtgtacgcgtgcacaggtgttaacctaaggatgtctcgggccattagacatctgtgcacttaaaagttaaaaatggacatttgcatagaacatatctg

SEQ ID NO: 504983 - DNA, 287 bp, Homo sapiens
ctttcacaggctcaatgtattatttatatactcatctgaactttcaaaagaagttaaagtgggagatattctcatacaggcaaaagataatgatattccaatctattgttcaagttgtatggtctccgagtataagatcatggtgctatataacccgatatctggcaaaacagttgcgtcagtagcgtgcttaagtggctcatgccaatgaaataccaatcgtctacatgtcgtactccgatcatttcagtcgacgtcgaaggacaatccctactccgccgtttttt

SEQ ID NO: 504984 - DNA, 180 bp, Homo sapiens
agctggtcgaggactgattgagactgggagcttgaggctgcagtaagctatgatggtgtcactgcactccagtctgggtgacagagcaagactcgtctcagaataataataataataataattataatgaaataaattaatactagcgcatgtgattctgggactattctcccaggaatg

SEQ ID NO: 504985 - DNA, 292 bp, Homo sapiens
gttttgggacataatatgtgacagcaataggttaagaaaagcaaagcagagaaattgaagatttgtgtcaacactggcttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaa

SEQ ID NO: 504986 - DNA, 135 bp, Homo sapiens
tgcctaagtgtgtatgctccgcacaacgcaggcagagagactcgtaaaaggaggataccccacagatagaaagggccaggctgaaattcaggagcctggatcttggccacttccgcctaaccagactgggcaacc

SEQ ID NO: 504987 - DNA, 139 bp, Homo sapiens
tgcgtacattcctcatcatcagttgtggggctgtggctgtgagtggcgcctgtcccgaggccctgggatggccaggctccagcagcagcagcagtggcagtgacagcctcatggccccaggagccagttcagcaagtga

SEQ ID NO: 504988 - DNA, 428 bp, Homo sapiens
  misc_feature (190)..(190): n is a, c, g, or t
actttaccatgaaaactacttgttcttcccatttgaaggtctattctgttgagtaaattgaaccataattcaaatcgagtgtcccagaaaaaaagacttgggctccctgtttggagtctggcaggcttcgagcacggagccagtggccaggctcaacctgtgtgtccccttccaaggctttgcattctgntcaccgcttcaccagcagcaggctagagactgcctgcctgggcttgacttttgtttggggggttattggccagggcttttgaacaggaatgtcccacagaagtaccagacattatttatataaggatgaacgcttttttttaacagtaccctttcagaaatttctaactactttgtaactgcatgattaacttggtgataaaagcagttattaaaagtctaccttttccgaaaaaaat

SEQ ID NO: 504989 - DNA, 1282 bp, Homo sapiens
tataacgcgggggggggggtcttattgggggcccccccccttgggtggcgcgcccgagaggggggggggaaagagagggggggggtgtgggagagagagaggggcgccgcggggggggggggccgcgaagaagggggctctccggggggaaaaaaacccccaggagggcaccgcccgggggtttcttttcttttatgagaggaggggccaaaaatagagacccccgtcgggttctctctttctcccccggagggtggggcgacgcgaggggggtggtgggccccgggggtcggggttcctctttaaggggggccacagagcgacacacagagagggagccgccgccgcggagaggacctcgaagagataccgcggaggagagagtggagggagaggtggtgtgccaaaagattactgcgggggagagccacggagcgtcacacccccccctaagcgatgtgtggggcggccccacaccggggagagcaggggtggtggtgcggagggaggaacacaccccccacgcgggaggcacaccttttctgggggggggaggggaaaaaaaggagaagtggacagtgagggtgcgcggaggaacccaaacagacgcattggcccccccgacagacaaacaagtcggagagccactaggacgcgggccgagcgggtcggaagaatacctcttttggaccgccccaaaacaagacaaaaaacacactttcacacgagagaggggggggggggggcgtcccacgaaacaaaacccaggctcccctgagcggaggaagctcaaaaaagagacacttcttagtgcgagagagtgagacaaaaacccccacaaaccgggagagaagacttagacagcaacagaacacccccccccagagagacagaatattagaggcgaagagctaacagcgacctacgcccacccacagagagagggggcacacccccaggggacagctacaacacagagcagcggaccggccccccggagcacccccaccacaaagcacggccgcgcatgccgcacataacacaacacataaagaaggagaggagacagcagcaaaatgcctcactaacaaactggggtccccatcggtggagacaaacaacctagcgggtggtaaaaagagaaggacccactcctagaaacctgctggggcgcaccacaacaacctattgttgcccgccacagaaggggaggtagctgcccccatcctccaccgctcccccccacacaacttgctagagcacacaagcgcgccggactaca

SEQ ID NO: 504990 - DNA, 148 bp, Homo sapiens
aatccccccccaacttttagaataccccctgccagcatcaaaaagcaaagattctaattttttaagccaaaaatttgtactaacacatgtaattttttaatgtgcctaagttaatttttgtatcaattccataaatgggattggctga

SEQ ID NO: 504991 - DNA, 1077 bp, Homo sapiens
gttgagatcgagttctaggagatccaaagggtaggtatggggcgacctatcagagtaagtggctcaatcagatccgaagaatggttaagtacgtggcgactcgtgaggacatatggtgggatgcaaagtggtgatgcctggcgatgtggatgggaagctcacattgttccgtagtaggaattcgcagcatatattgcagggtgaatggtcacatattggtcggaggttacagcgaggtagagtgtttgattactgttgagatcagagggatgacctgtgtactctcgaagacattggtgtcatcaattgttgggttcatgggattgaaagcaagtattgaatatgtttgaggctctgagggtctggtaatggaatctaagaatctaattggacgattttttagcataaatacataaaccattcacaagttatgtccacgggcttggtggtatgctttaattatggacacctaatggccgagcttgtggattgtggttcggagcatatgtggaccctaaaatggagtttgggattgaagacgataccctgagctcggggatagctgtgggtggaccaaccaaagtgaaagaatttgcgaccccttttgaataggaggagattctaatggtcaagttcataggggttcaaattgtttgggatgatgaaggggggcatcctcggacatcttctgtgagtcacatctttattggtggaaggcatttggtggacgatgaattagttgaaacacctttagggcagggctggtgtattcttttccttaaataacgaagggcggcaggggttggggcactgggtttgttccttgaagataagtatcgcatgaatgataagaaaattacgaagtcttctgtgtttcgtgaccattgcgtgattgtgtggatccagaagggaggagatgagtgttatccttggatgggggaattcccggttacaaagggggtcaaaggtacgtgtaattggatattactatatggaatttggttgggttcgtggggattagatggtggcgacaaggtgattgttagggtaataaattgtattgatcttaaaattaca

SEQ ID NO: 504992 - DNA, 311 bp, Homo sapiens
atacacaactaggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 504993 - DNA, 400 bp, Homo sapiens
gtgctctcaggatcttgggctcagtgatctccattcgcacctacctctcgtgctgcctgcctctccacgcacagtgttaaggagccaagaggagcactttgcccagactttgtttccccaccggctgctggatgggtgtgtccagtgccaccgctggcctccgctggttccatcagccttgttgccacctggtccttcatgaagagcagacacttagaggctggtcgggaatggggaggtcgcccctgtgagggcaaggcgttggttccaagccggttcccgtcccttgcgcctggagtgcacacaggccagtcggcaacttgtggctggaaagccaccctggtttagatcactcggggtccccaccttagaagggtccccgccttagatcaatcacgag

SEQ ID NO: 504994 - DNA, 228 bp, Homo sapiens
gactctgatctgtgacgacactggcctcaccagggatgtcccatggatgcttccaagtcggaaaattccctgaagactttgagcacgaagggtgatctgtgcctaataaaactgcggagacaggtcaatcgcagcttctctccaatcaccagcagcagcttcaggccgacaggttcaaagctaagcagatgctggtgaggccagtgttgtcacagatcacccttcgtg

SEQ ID NO: 504995 - DNA, 919 bp, Homo sapiens
ccgctcgctgtgctcgcgggtctccgcggggcctccttcgccggttttggcatccgaattgtgtctttcacggcatgggctctatagagacgtgtctaaggttgtgggcacctgtggcccgaaatcccccggtgagacgcggttcccgctccaggtgttttgtctgtccccccccgcgccgatttgcccgggcggtatcgccccttatttggggtcccaacccggctcccgtgcaatgcacatgtctcgtttgcgggcggaaagaaggttcctgccccgttctgtgttaaaaactgggggccagcgccctcatatttcaagtgtttgtgtgagccgcacagtggcgtgatgggtctccgccaacgcacctgttgttggcaggcttctcacggcattccacccccagcggcccccatctcgtttcggggtcaatcgcccccccccgtcccggggggcttgtcccacgacccggggctccagaggctctgtcggcagtctggcacgaggtcgccctagttgtcccccgatcgctttcggatatggcttcaagtgagatatttacccctgtttccccccccccccctctcgtctatcccgtggtggggcaagaccgcttcccatactttgtttggtttcccacatggcccacttcaagcatttcagtactgtctacagaagctgcgttctatggttaccccacgggcggactgtcaccgcctctccgcatagatacagatgatctttttgtggagccacctcgtggggttatttcttatcttgtgccgtgtgccgcatcttatatttgatatgagttctttattaacccgcgcactttgttgtactgcggaagccaccagtgcccccaacatgtgcccggaggtggcggaccccttcaaaaaataaagcaggccacaaaaca

SEQ ID NO: 504996 - DNA, 387 bp, Homo sapiens
  misc_feature (316)..(316): n is a, c, g, or t
  misc_feature (347)..(347): n is a, c, g, or t
ggcctctgcctttttcgcatgaggcagctacccccgccagcgagggcaaaggccagtgtgacagccttttgtatttgcactggtggcttctgagctcttgcctggcatccaggaaaaatgaggttgcacaaacaaattgaaggatgataaatgtgggggattttattgccgataaagtggctctcagtgggaaggggagctgaacaggggatgggcaggtaggtagtcttccccttgaatccagctgtctctggctggattctcctccgaagttacgccgtccaagctgtccctccaaagtcaagcttgctttctnttctggacatttcatctgttagtcccacctnaccagctaaagtcttgggggttttttattggggcacaggt

SEQ ID NO: 504997 - DNA, 486 bp, Homo sapiens
aagagagagatgacctatggagcttaatttattaatgcagacagtacctaacaaaaccacaggtcctaagacataccaaagctgcattaggaggagtttcggtagggtgcgacctcggtagcagaaccctaacgctccgagcagtacatgctaagacttcaccagtcaaagcgaacgtactatactcaattgatccaataacttgaccaacggaacaagttaccctagggataacagcgcaaggcgtattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaagttcctccctgtacgaaaggacaagagaaataaggcctacttcacaaagcgccttcccccgtaaatgatatcatctcg

SEQ ID NO: 504998 - DNA, 417 bp, Homo sapiens
gtaggatgtgttccttatgaagcgtacgcatggaaatttccacgaggctcatcctcagtatctcattaactcatcgcaagatttcagttgcattggtcacctgtcgagacatgaccagacaggatgtactaggcctgggtatccagcgaggctgtgcatccctgctgtagggccctctgtagagttctagactttctgattctgatgctcagtagaccttttagaggctcgctctgcttgatctgctccaaggaagctgacgttctaatgtatgaaccatgagatgcattaggtcttaggaccgacagatcatcatggagctgctcatgccctgagacgcactgctgtgcgagctgctgatgctcagtgcactttactcaggctgacttgagactagagcaccttagctgacatggg

SEQ ID NO: 504999 - DNA, 677 bp, Homo sapiens
  misc_feature (1)..(1): n is a, c, g, or t
  misc_feature (102)..(102): n is a, c, g, or t
  misc_feature (117)..(119): n is a, c, g, or t
  misc_feature (126)..(126): n is a, c, g, or t
  misc_feature (412)..(412): n is a, c, g, or t
  misc_feature (665)..(665): n is a, c, g, or t
nagaagaagtaatgaagtaaaaggaggtgatagtaaaataaaggtataaaaaaagtaaagagagattgaggagttttaaaagaaactgagaagtagttatgnagaagcaagcataannnaaataanaaggaaggtaatgtttgttggggagtatgaaataagggagaggagagcagtgttaaatgagataatgagatgtgtataaaaggatgaagagttggaaggaagaaaagagatgatagagttattaggtaaaagataaaaaggggatgaagggataaaaagaagagattaatatgtaatggatggaaaagaaagtaagaaagggaatgatgaagaggatttagaattttttgaggagaaagaaaaagtggaagaagagggtaagaaagtaaagagaatgaagggaganggatgatgaggaatacattggaggaggaggaggagatggaaaatatgggaattatgagataaaagaagaaaaagaaaaataaaaaagtggcagtgaaagaaaagaaatagaaaaggataaaaatatttgaagaggaggtggaaaatgatgaggggatatttggaaagggaaggaagatgtataaaaaggaaaaataggaggaagtgtaataaatggaaaaaatgaagatatttgatgataatgaaataggagnggaaataaaaat

SEQ ID NO: 505000 - DNA, 123 bp, Homo sapiens
attaatttggtaccaaggcaaggatgaaatttttacccggttattatggcgggttacccctataccctctatatattgacccagaggaatttttctcatacacaggggtatttatattgcaca

SEQ ID NO: 505001 - DNA, 585 bp, Homo sapiens
gggtcaccccttccttgtctagggttgcaacaagaagtgacagacagggtcccacaaggtcttataaatctccctctgtaagttgtgggaatatcagataacttgcttggtccttagggctttgaatctgagtctgtaaaatgggtgaaataatatttctctaaacaggtttatcatatgaatcagaagaaattgtagaaggtgcctagccagggtgcttggcacgtagtaagcttgttgagtgaacgttgtgcttgcattgcttggcgttcctccttatgtgagcctgtagtaaacacagttgctgtgtatactaggcaggcctttctctcttctgcaatctctgaggtgcttctgtgccttaatgaaccaaggggtactacacccttgctgtttcagaagactacttcaggaaactagtccaggctgtagtggtgtgcacgctgtagtcccagactcccaagtagctggaattacaggcatgtgccagcacgcccgtcattcattttgtcttttgttagtcgagacaggctgctgtccgtgctgcgtgagccggataccggtgcacgtgcggagttccaggac

SEQ ID NO: 505002 - DNA, 185 bp, Homo sapiens
ggaggaatcttcaccccacttcctctacccccaggttcttctccccacagccagtcccctttcctggatttctaaactgctcaattttgacttaaaggggctattttccattaatcttcctacccatttctgccagctctggcttcttttcaactctctcacaattttgtattgtctctcccaga

SEQ ID NO: 505003 - DNA, 498 bp, Homo sapiens
  misc_feature (47)..(47): n is a, c, g, or t
  misc_feature (75)..(75): n is a, c, g, or t
  misc_feature (448)..(448): n is a, c, g, or t
  misc_feature (460)..(460): n is a, c, g, or t
cgcaagcccgcccgggaactgctgacgcttgatgagaaggaccccgngcgtctgttcgaaggcaacgccctgctncggcggctggtccgcattggggtgctggatgagggcaagatgaagctggattacatcctgggcctgaagatagaggattttcttagagagacgcctgcagacccaggttttcaagctggggttggccaagtccatccaccacgctcgggtgttgatccgccagcgccatatcagggtccgcaagcaggtggtgaacatcccgtccttcattgtccgcctggattcccaaaagcacatcgacttctctttgcgctctccctacgggggtggccgcccgggccgcgttaaaagaaaaaattccaaaaagggccagggtggggctggggctggaaaccacaaggaggaggattaagtccccctgtccctcctgggntggtggattgtntcgttttcctgccaaataaacaggatcagcgctttcca

SEQ ID NO: 505004 - DNA, 436 bp, Homo sapiens
ttgtcacgaggggatagtgaccacaagagataccagagacgcgctgcacagggtcatgcgctgtgatcccaaaatattgtgattacacgtgtgagccgctgtacctgtgcgtgtgcttatttttggtttttcaacgcgcacatatatctggagcattctctttctgagaaggccttaaggactttctatgggatgccagggcacacctatgggtgaactggttgggaaggagcccggaagaacggatctggctgtgccttatagggcttagaagtggtggaaggagccacattagcaaccttggttgtgcttggcgtgggcttggaagcccttagaccaaggctctaacctgtcgcaccttgtgttttaagttccggccagatgtagaaccttcaagctgtgggaacaagcgcgcttctttccttctggatgggtg

SEQ ID NO: 505005 - DNA, 476 bp, Homo sapiens
  misc_feature (216)..(216): n is a, c, g, or t
  misc_feature (450)..(450): n is a, c, g, or t
gtttttgtttaatttatatttgctcactttgcagttacagctaatgctattaatatatgtggttaaaacttttcattaatttgacaaaaaggataataggtaataagaatgttttgtttcgtttaccaagaaaaagaaactacaactgtacaagcagtataaatttaatcaaatatttaaattattgcctcactttaggacagagagaaacattanggcaaagttgtaattgcatatctggcaatatacatagcaatttattggacatgcagtttaataataaatgacactgagattaatctaaaagatatgatactaaatcattgatttgaatcatttaatttgactgtgtcatgattaatggcattagataaatgtttatctaaggtgtatattactttaggtcattctaatatacctagtttgataagaacttttgattaacttatnatttatgtcttttaaaatcaattctg

SEQ ID NO: 505006 - DNA, 118 bp, Homo sapiens
  misc_feature (3)..(3): n is a, c, g, or t
tanagactgggcgtagaattcatgtttcaggagcctaagaccctcccagagccaagggttcaccgcagaccccaagccgttgagcacatcagccaaagcagtggtcaacatcgcggac

SEQ ID NO: 505007 - DNA, 291 bp, Homo sapiens
  misc_feature (58)..(58): n is a, c, g, or t
  misc_feature (64)..(64): n is a, c, g, or t
ccggggggggggggccccccccatttccaaacctggggttaaaggaaaaaaccccccnaaaaantggggcccgggtccacccttttttttttaagcctttttaaaaaaaatcccttaacccgggggcgggccccggggtttaacgccaggtttccctcttgggcctttaaaaccgggtttaacggtaggttttggggggacccccccaagggggggttccttttttcccccccgccccccctaccccctgggttttaaaggaaaaaaaaagggtctccccccttttggtta

SEQ ID NO: 505008 - DNA, 593 bp, Homo sapiens
ctctctctctctctctctctctctctctctcctaattcccccacatacttacaccctcgttaaccctaacaaaaaaaactcatacccccattatgtaaaatacagtgtcgcatccatctatattatgagtctcttccccacaacaatatttgtgtgcctagaccaagaagttattatctcgaagtgacactgagccacaacccaaacaacccatctctccctaagctatcaaaatagactatttctccaatatatatacatcctctttagcatgttgctgtcgttacggtggtccaatcatagaacttctcagtgagtatatataaacacagacccaaatattaatcagttctatcatatatctacttatcttcctaacttaccatactactcttagtgtaccgctaacaatctattccaatgtgctagcagtcgggtgagagggcgttaagattttatatccttgtcgttgctcactcaggttgatgactacgcccgagacagtatgccaacacaggcagcccattcaccgacacttctatacaagcgtatcggagtatagtcggtcttcactcctcgcctgagcgctgata

SEQ ID NO: 505009 - DNA, 213 bp, Homo sapiens
cacgagggctatttacatgcatgggggacaatgctccaaggcagctggtgtgctttatgggcattgcagctctggacagttgtctacgggacctataccaggcttccctcgctgcagtcaaccagcatcttgctccccgtgatggaatctctcaagagggcttgcgcactcagatggtcactgcagtccatgatatttcccatctcattgagc

SEQ ID NO: 505010 - DNA, 387 bp, Homo sapiens
ttctagaggatccctttgccatggctctctaccttgggtctgggtctctcctgggcactggatcagctgggggtacctagggcccaagggctggtgggaccctggggtttgggggagcagagggcacagccacggaacagttcagggaacgccaggcgggatggaaaataaatatgaaaagcattgagtcttgggcagttctgcttcccttggatggaatagggagggtcccggcaggtgagtgcggagggtcagacaggccagcaggtggcaagtactgagccgtggtcagggtgtgcctcctaccatgctggcatcaggcttggctctgcaggctggctcatcgcttctgatgggtgcgggcaacagggtgtcggactgcacaaa

SEQ ID NO: 505011 - DNA, 166 bp, Homo sapiens
atagcagccacgacctttacagctggagatgagcccttcaagcgctacgtgaagagagaagccagcccagaaatgttgccggtgtttcaccgcactactgtgacctgaacaaagacacggtcatttcactgcctgagctgaaaggctgcctgggtgttagcaaaga

SEQ ID NO: 505012 - DNA, 170 bp, Homo sapiens
ctccacaccaacaaccccagggacgacataagtgtcaggttttccagcgtcacatcacggcacaggcattcctgagcctcatccaaggagactccattcctcctgggtaaatttcacagccacgtcttcaaaagtcactgtgccctgaacggggaaccctagcgcggccg

SEQ ID NO: 505013 - DNA, 896 bp, Homo sapiens
  misc_feature (5)..(5): n is a, c, g, or t
  misc_feature (129)..(129): n is a, c, g, or t
  misc_feature (171)..(171): n is a, c, g, or t
  misc_feature (194)..(194): n is a, c, g, or t
  misc_feature (208)..(208): n is a, c, g, or t
  misc_feature (214)..(214): n is a, c, g, or t
  misc_feature (227)..(227): n is a, c, g, or t
  misc_feature (244)..(245): n is a, c, g, or t
  misc_feature (255)..(255): n is a, c, g, or t
  misc_feature (260)..(264): n is a, c, g, or t
  misc_feature (267)..(267): n is a, c, g, or t
  misc_feature (269)..(271): n is a, c, g, or t
  misc_feature (273)..(273): n is a, c, g, or t
  misc_feature (335)..(335): n is a, c, g, or t
  misc_feature (352)..(352): n is a, c, g, or t
  misc_feature (361)..(362): n is a, c, g, or t
  misc_feature (374)..(374): n is a, c, g, or t
  misc_feature (387)..(387): n is a, c, g, or t
  misc_feature (389)..(389): n is a, c, g, or t
  misc_feature (394)..(395): n is a, c, g, or t
  misc_feature (663)..(663): n is a, c, g, or t
  misc_feature (786)..(786): n is a, c, g, or t
  misc_feature (801)..(801): n is a, c, g, or t
  misc_feature (872)..(872): n is a, c, g, or t
tttcnttttttatctgttaagctctcttgataaaaaaggcaaaccaggccagttttaaatttaagaaacagaaacattgtcagtgcttcttgtatcaacacacttcatattcagaactactcccaaaanataacatattatctccttttcaaagatggggaaactgaaacnaggcattatctataatgaccaanccacatagtaagangcacangccagcattaganttcagatcttacttganngtctacagcnccccnnnnnccncnnncntccttccattataaatgtaggtacctggcttactgggagaatgttgtggtgtgaaatgcagntgatgggagaagattanttctttttnnttactcccagtngtagccagatcantnatttnntacatactttccgatactctgctatgtgtattttttaaagtgtgaatacatggtatatcaaaatggatgtatcagtattttaaaaactaaaatctgattttaaaaggaaagcatatagaaaatctggaaaaatactgatataaagaaaattaaagtcatctagaattccattcatccaaaataaacattgttaatatttccatatattcccttaggtcttttttctatcaattttctttttatatagttaagcttataatggtacaanatttttaagggagagttaacaaaggtttaaatagatgacaaaaagggggcttgggtgaccgatagtatttgccaatcaaattattcaacaggttttgaagggggtgtgctaaacttctaaggnggatcctgacgtggnttactggattaccttttttgttgttttatttcacccaagtgcgtgtatgtcatttacctaagtttttatgngtggagtattctttgtaggggagg

SEQ ID NO: 505014 - DNA, 102 bp, Homo sapiens
tcgcgcacacatctcgcgcacacatcctttacttatgtttttagaattacttttacattttcccaactagatggcctagagtccaacattaccttatgagat

SEQ ID NO: 505015 - DNA, 391 bp, Homo sapiens
gtaatgtttaccctgaatgttattatttggccacatttttatattaagtgtgaacacttgttcctgtgagctattcgagttagttgcacacttcgtgcttacttacctcttgcttagtacttcggcatatgatccaagttctagaatatttcatataactagagtttgtcccagtatccttggtagattgttttagatccacacgtgtatagtacaggatcatcgtatctagtggctctcacgtgtatcaaatgtggcacagctccttagcctgaatgtgttccatgacctctatatcttttggagtacatggcaatgattcttgtagattgacacgcattccgcatttgaatagatgattgcttcgccatactaggtatactctactctg

SEQ ID NO: 505016 - DNA, 832 bp, Homo sapiens
tacggtacaatcccagagacctagagtgtgagtacgcgacatcaggtcgttgcctggcggactcgtgatatacatatctgcattgtccgggtaaccttgtaattaactattcctggtagacaccgtatagtaggaggtagggagagatattgtactccgcagttttagcacaagtgcacgggatctgcgatgttgcacatgaagctacgatagaatacagcactgccttcgtgagcttctcccatcaaagtgaccaggagatccactagggcgggtaggaatactcaattggggccatgtggtgcaccatacacatttaaaaacccttcatatatggaaccctgttaatgagctcactaactcagagacccctactaagtgtgggcacaagcaagtgggagattgtgaagaattgggatatgtgacgtttatggaccatagattgactctggattgtggaggaaagttgaacaagcgtatattgtagctttaacagtgaaccacgattggcgttggggtgcacaatgttaataacaacagttctgtgccactaagaaaaatggggtaaaagaggcagtcagggttatctggatgcaggggggcaacaagagcagttaacccagctactagtgtaagcacgggtccccagctggtttaaaaaaattcaaagggaaacaagggtcagagtgctttggggggcgaaaagtggtgtctcctaaccgatgggttaaaagtgggcttacctcctccaaatattaaaagaatctggtgcaaccaataattctacaattggaaacaagggcaacttcattggcaaaagggccccgttggc

SEQ ID NO: 505017 - DNA, 273 bp, Homo sapiens
aacatgtcgaggctgagcatctctagcttcattgcttaccagaaacagaagctatcgtcttcaaagaaaatgcagaacaaggggaggtggacatggagagccacctggaatgccaacgcagagccagctgttcagcatactcttttagagacatagaagattgtcggcagaaacatgccaggcgttggcagcagggttagaacagctgcctgaggttcctcccttaaggataacttgcgctgaaaagccgacaattggaggcctttcttgttc

SEQ ID NO: 505018 - DNA, 1434 bp, Homo sapiens
ccatcacccctccttatttgtaccccctcctttgattaacagcgggggggggcgccccctctttttgcatgagccgcccccctcttccctcctcttcttgtgtgtgtgggccgtcccctctcgcggccggctccttttgttcgcccaacacacccttgtgggggtgggtgttgttgtctacgccctggtctccgcagccccttttcctccagtgttattgtagccgctggtctcctcgtcgctcatcaagttttcgtgttgggggcgcctccgtttgttatgtccccgccacaccacctcctcttgtcgccagccgtaggtgttgtggccgcccccctctcttcttgttttggtgtgggtggggctggcccccccgctagctttgtttgtgtttctcccccccgcggcgtggttccgtctcctctatttttttcccccgcaggggggcgcctctctaatctcgatcagctcgctcaccgccgctgtgtgtccccctccatcataggaggcgcccttctctcgaggtattcgcgcgggggtgtattttcccctctctctcgttttgtgtttcccctctccccgcggaagatgtgttgtgttttgttgtttttctcaccacagagagtattttttctgtgaggcgccccctctgttttgcacaacacgctctgctcgctcctgttttgcgccctactctctctctccccccactatatatagagagggcgcgccccttcttgtgcgcgcccacacatcacgcggctctctctcctcccgccgctctatatctcctctccctctcagagagagtctccccacactctctctctgatacacacacatctctcctgctctgtgtatatctcttcgcgccctctccggcgagagtgtgtctcactctctcctctctcggaggctctccccaccatctgatgttctctatatataggagagcacaccccccgcgcgccttcaccccctctttttatttctctcagcacactctcgcgtgtcttatgtcacacactctctgtttcgtcgcggtgtttctctctatatgttctacaccctctctctccctccgcgcactctctctcgcgagttctcttctggggtgtctctcccttctccaccactttctctccgcgcgcgcgtatatttccggcgccccacacacattttgtgtgccacccccacacaggttctcccccgggtttctcacccgctctcttttgtgggcgtccacacctttctctctccccatttgtgttctatccccccccttatatatttctccctttacacacaccccaacacataccccttgggtcttgaaacccccccccggatttactggccattttgttgagagagagatgggtttgtgaataatattttgtgtatagtattcccctttttttaagggggttttta

SEQ ID NO: 505019 - DNA, 502 bp, Homo sapiens
aactcggccctatttcacggttgatataaaagttcttaattttgtgaagtcaaaatgtctaatctttttaatggttaatggctttttgtgtctcattcacttacattttctactaaaagttttaaagttttgtttctgacatgtaagtctttggtcctctggaatttaatgtttgtatatagagtgaagtaggaatataatttcattttgtttcttatatcaataaccattatttttctattctatttattgaaaagtcctttctttccttactgatctgccatgtcacctacatcacgtatcgaagattaaatttgtagagatttgcttgggagctctctattctgtttcattagtcagtttatcagtgaggaccaaagacttacatgtcaggagtttgagagcaggctggccaacatggtgaaaccccatctctactaaaaataccagaaattagctgggcatcagtggcagacacctgtagtccaagctacttgggaaa

SEQ ID NO: 505020 - DNA, 352 bp, Homo sapiens
ctcaggtagagttgtgtagtgaggggagacagatacggaatctgtgtgatagaatatattatgaggaggggaggctatagggccgtagcacctctttcctcttaagccaccagaagacctttcctggggaagggaaggttggtagttgggcctgtcacttggctgaaatatggagtccactccgcttctccagagtccctcagcagccctccatgtctcggggtctccacacagggaccagctgctgccccgggcttctagccagaattgcccatgccattctctcgattctttctttctctccagctgcttcatgtgagggcttgtcaggccgcgggttggaggccttagg

SEQ ID NO: 505021 - DNA, 590 bp, Homo sapiens
  misc_feature (33)..(33): n is a, c, g, or t
  misc_feature (81)..(81): n is a, c, g, or t
  misc_feature (102)..(102): n is a, c, g, or t
  misc_feature (184)..(184): n is a, c, g, or t
  misc_feature (193)..(193): n is a, c, g, or t
  misc_feature (209)..(209): n is a, c, g, or t
  misc_feature (259)..(259): n is a, c, g, or t
  misc_feature (271)..(273): n is a, c, g, or t
  misc_feature (275)..(276): n is a, c, g, or t
  misc_feature (282)..(283): n is a, c, g, or t
  misc_feature (286)..(286): n is a, c, g, or t
  misc_feature (303)..(303): n is a, c, g, or t
  misc_feature (337)..(337): n is a, c, g, or t
  misc_feature (340)..(342): n is a, c, g, or t
  misc_feature (358)..(358): n is a, c, g, or t
  misc_feature (361)..(366): n is a, c, g, or t
  misc_feature (369)..(370): n is a, c, g, or t
  misc_feature (374)..(374): n is a, c, g, or t
  misc_feature (388)..(388): n is a, c, g, or t
  misc_feature (395)..(397): n is a, c, g, or t
  misc_feature (404)..(405): n is a, c, g, or t
  misc_feature (407)..(407): n is a, c, g, or t
  misc_feature (409)..(409): n is a, c, g, or t
  misc_feature (420)..(421): n is a, c, g, or t
  misc_feature (426)..(426): n is a, c, g, or t
  misc_feature (431)..(431): n is a, c, g, or t
  misc_feature (436)..(436): n is a, c, g, or t
  misc_feature (469)..(469): n is a, c, g, or t
  misc_feature (503)..(503): n is a, c, g, or t
  misc_feature (511)..(511): n is a, c, g, or t
  misc_feature (520)..(520): n is a, c, g, or t
  misc_feature (526)..(526): n is a, c, g, or t
  misc_feature (544)..(544): n is a, c, g, or t
ataaaataaataatacagttaagcaaagcttgngtggctttttaaagtgatctgtggaggggatgtggcaggtagcccctnttcacttgctgtaagatagtnttttagtatttcagccacccttaggcacaactcagccaggcctaggaagcaacccaacgtcattgccatgaaccatttacanaagtaacancaaaatcaactgacanatttttttcctgatggaacagttaaaaaaacaaaaaactattgagttaangtttgggagttnnngnnggtgannttnaaagctcctccacacangtccaactgagcatgctcatcctgtgaggggganccnnncccttcctgtaaaccntgnnnnnnttnnaatntttggtttacaganttttttnnnccatttnntnancctgtttttgnngggtnggggnttttncatcttgtacataaagaaagaaatctgggtatncttgaggttagaaaggctttttgtaagaatagtnttccaganttacaaatnatactnataagagaaaagcaattnttcctcttggggaaaaagaggaaaagaaagaagaaaagagaaaaaa

SEQ ID NO: 505022 - DNA, 122 bp, Homo sapiens
gcggccgcctactactactactactactactactgctcgaattcaagcttctaacgatgtacggggacatggaaataaagcacccagcgctgccctgggcccctgcaaaaaaaaagaaaaaa

SEQ ID NO: 505023 - DNA, 1755 bp, Homo sapiens
  misc_feature (83)..(83): n is a, c, g, or t
gcttgaacccgacaggcagaggttgcagtgagccgagatcgtgccactgcattccagcttgggtgacagaagcgtgactctgntctcaaaaaaaaaaaaaaaaaaaaaagagggagaagaagacacggggttctctccctttgtgttccaccacaggcgtggcatgtcgcaaggggtgtgtggctcatagccctccactgtgtagcccttttaccctcctgtgggccacaagagtgtgaatctccctctctttgcccttttaggctttcctggacagattacctgtgggcacacacagggctattgaaacgcgccatgtgcccgggccctaactttgacattttgtcggtacaagaagtggctcctggccccaagtggatgggcccacagagcctgggggtctctttgtagacaccttttctttaaaaggggaggaacctccccttaaaggggggaaacctccctatcagtgggacccctttttgggacactctcaccaaaacagaggtgtgcggtcgtcgcgacatacttctcaacacgacgtgagttatgaaacaacccactaccccgaccaacacctgtgggacaccgcagacagtacgtagcgcccaatcctgtgggcaaagcaagcggcgcacaccacgcaccgacgctaccacacaactaagccgacaacacgttcgggcgcagcggggcaacagcaggccgtgagaccagcgaccacaaaggaggaaacacccagagcgggcagacgcgcacaaacaacacccaggggacaccccacacggaaagacagcacgacgcgcgacacgtacgacgcaggcccagccacaggtccaacaaccacagcgaacgcacacaaccgggccacgacaacaacgagcacgggaaaaaaagaaccgccgaagcgaacccagaatgcgagcaaagaggccaaaacgagcaaggcgacacagacacaacgcgcgaagcaggacgcgcaagcaagacaatcgccaaaacacaagcacagagcgggacaaacaacgcacacagaagacaaaaacagcaccaacgaacgatccgccgctcgcgaacacagcaacacgcaagaaaaaccaaagaatatctagaggaggcgaaagacctgagggagatcggcggcgtcaccaataggaaggcgcgaccccggtcgacgtacgcccgggactagcacctagagccgcatacggggacacatgcagcaaggatcgacagcacgcgcgaatacagaggagcgggaagggccgtgtgacacagccatagcgtaagacacacctcggacaccgcggacaccaccacaacgccaaaggcggacgcacaaagaaccaccaccagccaacacgacagccacacaccgacaagagcaggaacagacaaacgagagcacaacagcaacagccaaacaacaacgcgcgctaggacgaacgcgccaacgtcgcaagcccgagcctgagcgcagaggccgcgaccgagacagcagacgccacacgacagtgtacctacacacaaccgagccagcaaccgctgagagagaagacacgccaaacacagaggcagagtagagcaagactatcaagcagctcgcgtagaacagagaggacgagaggcaagcatagcagggcagcagcactagacagcgcagagcgcgtcggagacagacgacagcatacgagaaagagaggggaagagagacgcacggaaagtgccaccggcgacagtcagcagagaaaggtt

SEQ ID NO: 505024 - DNA, 1498 bp, Homo sapiens
tgtgggtttgaataaggattaaaaaatggggaagggtgaaggtggcacaacgcaagctcgggtgggacgcgcgagctatcccccaaaatgtctcacaaatgtgtgggcggaggcactttggattggccactattggtgtgctgttttttctaaataagtctattccaaatattatagaaatggctgttggtcaacaggaaatgtcctcttggcacatctctaaaagagccacacccaattttcttctctcacagaggaaatatggcgcccagatctcttctccacaagtcccacacgagggaaaggtggaaagaataaggtctatacgcggttataaaacatatagtgtatacacgtgccaaagaaattatctcatataaaattctctgtgcggactctataaaatagtctctatatataatattgtgagggttatacatattctgagaagatgtagatgtgaacgatctctactgcgaggggagcccccccactattattaccacccctcttatatatatgttgtcgtcttctgcacccacccacaaaattgtttgtggagagaaacgttgcttatatacaaaacagaggcacacattataaggaggagaaacacatcccaacagaggagaagaaagtggtgggtgttctcgagaacgcaggcaacacccacagggggaggaaaatataacccactgtgtattacacacagacgagaaactctgtgaaaaaacccccaggaggtgtaagacaatactacagacgggggtgccgaacaaaccctatcatagacaaaaaagaaagaaaaagagacaaacaaaacaaaacaaaaacaaaagaaaaacgcgagaagggggaaaacaaataataaacgacgagcgaggagggtgagggaaagaaacacaaacgaaggagaacaaacgaacagagagggagcaaacacaggggcacacaacaaagcgataggacagcaagagaagacaacgaacaaacgatcacgaatgagtgaaacacaaagaagaggacaaaaacaaataatcgaagagggaggagaagccacaccaagcaaacaaggaaaacagaagacctaaaaaaaaaaaacaaaagcgacaacaacagcagccggacacaaaacaacgcaagcaaaaaacaccaaacacacgcgacaacacaaacaagagcgcacgagaagaagagaaacacaacaacgacagaagagcacgagagaaaaaagaaagaccagaaaaagaaagacggggacgaacaacacaaccaaaacagtcagacgaacccaacaacacaaccgaggaaagccaaggtcaaacgcaaaccaacacccaaacaaagcagactatcgagccctaaaaaacaaacataaacagaaacgacgcacaacgaaaacataacaacagcacgcacccaaccaaaacaaaaagaacaacacactaacaacaatgaacaagaagagaagaaacgagagaaaagcacacaagacaac

SEQ ID NO: 505025 - DNA, 123 bp, Homo sapiens
ccccatggggggccttttttaccccctgcgaggcccagctttttaggggacttttgcccatgtcatccagctcagctgggagctgcttaggtggaaaaccccaaataaagtgcggctgtccca

SEQ ID NO: 505026 - DNA, 596 bp, Homo sapiens
tggaaagggagtctggctcggtcacccaggcgggagtgcaggggcacgatctcggctcacggcaacctccgcctcccaagttcaagcaattctccggccccagcctccgtgattagcggtgggattacgggcggtgtgccaccagtgcccagctaatttgtgggtgtttttagtagagagggggttttcaccagtgttgggctcaggcgtggctcttgaactccgtgagcggtgggtgatccaccgtgcctcggcctcccagagggtgcggggataacggggcggtgagccaccagtgccgggccgaaaaacccactctcataacagaaggtgcagactcatggctagattcaggtgcccttgaggtggtgccagaggtcctcgggtgttggagacaatccgggtggtgtgccaggaggctccgtgtgcaccggggggctctcagaatcccgtttacccagtctgggagaccatgcctctgggagccccatctcagccagccctggtctctccctcttccctccaggtgaggcaaatttcataggaatcggtacctgaatggtgagctcctgataataaacctcggaggctttgac

SEQ ID NO: 505027 - DNA, 348 bp, Homo sapiens
  misc_feature (28)..(28): n is a, c, g, or t
  misc_feature (70)..(70): n is a, c, g, or t
  misc_feature (85)..(85): n is a, c, g, or t
  misc_feature (168)..(168): n is a, c, g, or t
tgttaaataagaagaaataggtattctnttaaaaataaaaatggcggcaggcgcagtgactcccgccccngatcccagcactttnggaggccgaggcgggcagatcaccctgagtcaggagtttgagaccagcctggccaacatgggtaaacccctgtctctactaanaatacaaaaattagccaggcggggtggcacacgcctgtagtcccagctactcgggaggctgaggccagagaattgcttgaatccgggaggcagaggttgcagtgagccgagatggcgccactgcacttcagcctgggcgacagagggagactctatctcaaatgaataaataagtaaaat

SEQ ID NO: 505028 - DNA, 103 bp, Homo sapiens
tcagggcagcagtgccacgttttccatccgggcctccgtttggctgttgggcatgtttcccacgggtctcccattcatcacccaacagggcaacacatcttcc

SEQ ID NO: 505029 - DNA, 139 bp, Homo sapiens
ggtacagattctgtacaagtgcaactttattttctcatgccttgtggtttctggtgggaatgaaagtcaaggatagggaacagtgtgggctatgcaaagtgtgtcccctgctgtccggctgtcctcacctaatgcatgg

SEQ ID NO: 505030 - DNA, 210 bp, Homo sapiens
tctagaggatccctccccgtacgccaacctgaaccctaatgcccaatacttgtagaggttttgtttgtttgtttactaatgatcgttttgtggggttttttaagggatgagtggatgagagaaataatagagaacagctatcctctgttgagaaggtgagaaaaagtaggatggaaaacttcaaagccttccagtattgggcgtacgggg

SEQ ID NO: 505031 - DNA, 243 bp, Homo sapiens
ctgcaacgtaggatttactgggaggaagaggtgagtgagctgagagcacactactgcactccaaaaaaaaaaaaaaaaaaaaaaaaaagggttgggggttaagaaaggaaactggggggggttttgtggaaaaattggaaaattccgggtggggtgcgggggttcaaacttttagcccaaaaatttgggaaggcaaggccgggggaatcattagggggccgggattttggaaaccggcggggc

SEQ ID NO: 505032 - DNA, 1228 bp, Homo sapiens
ccatggttataaaattgtcaagagttattctgtctgtttaaaaaactaagaaacctcatttaacgcaactagattcttgcttgggttttcttatttaaagaacataatactgtcgcaggcaaggcactgtaaacagttatacattccttccagaagaagccagtggaacgaactttaacatttgggcgctacgatcaagactactgagattagtagacaattaatgatgtctaaagcttaccaacaagaagaaccctcagccagaatcacacacacaatactttgctcaggacatgttgaggtcaaattgaagacggataaccggaaaccgttttgcttgtaagaccccatagaaggcaacgactcacggtaaacgcactcacactagctagcagcgcgacacaggcagagaactggacaactaaaacgtcaatcattatgcacgatgaaatgccttatctccataacgccattcttcacaaggcttgggtccttctctagggctgcgtaccggaatgagatattcacgcatcttcgcaatcacgctttcaatccaaacctggcatgaatcttacgctcatccaatcactctctcacacgcctaccacactctacatcctttctctccctctactgggtagcataatatccatcaactatttggcaccttcattacactcctccgccctcaccccaccacgtcgtttcgccacactcctcctcccggcacactgatcgcccgggagtcgacaactccatacatctccaccaacagacctccacacgcccaatctggtcgcaccctcgcggtctgatcacccccccttgaaaaaccccacagcttgccacaaacccacagcttaactaccttgatcggacacagcactgtagcacccccttatcgatcaccacccctatcacaaccgactaaacatccaccccgctgcacgggacaacaacatcccgacctcggacgcacacaccgcgccacacctacacacgcaccacacctccctgagcaagacacagcccaacttcagcaccacgccaaccggccaacagcaaccaccgcaactcacgccagccacgccaccgaccgcacaccaccccgcgcaaaaaccgcccctgccgaccgggacgagaacagtggcgtgccacacgccatcgtagcacttccacacccaccgatcaatcaccaccaacgctcaaacacccgccaccaacacgc

SEQ ID NO: 505033 - DNA, 407 bp, Homo sapiens
  misc_feature (37)..(37): n is a, c, g, or t
  misc_feature (153)..(154): n is a, c, g, or t
  misc_feature (167)..(169): n is a, c, g, or t
  misc_feature (295)..(295): n is a, c, g, or t
  misc_feature (314)..(314): n is a, c, g, or t
atggttccgatgccaagcttgggatggggtcttccanatgcactgaaacatgatctgtgctcatggatcagactctacccacacaccaaacatgatggatgagacatgacatggcatggcatgcattttcttgacacccatgggatgtgggannaaaccacatgaannncaaaacatgcaatgtctggtgcttgtggcctgcctgtgcttccatgggctgcccatggacatgtggtgcgggctgagtgtgttgggttgtgttgtgggatggggcctgctgggccatggtgcctcnctgcttctgggactctccntctgtttcttgtgcttggcgctgtggactgccttgtggaactatgatggtgggcatgcctctggcgaatgcccaaccccgtctgggttggagc

SEQ ID NO: 505034 - DNA, 184 bp, Homo sapiens
gcagctcggtaccgtcatacgttcgcatgcaacatcagcacttaaataatgcaaattgcaacatttctccctctggggctttaaaattcgttgcccttatcattatggggtgaaggagacatttctgtcctttgcttcccacagtcccaacgcagtctgtgtataattcctgtgatccatcgag

SEQ ID NO: 505035 - DNA, 429 bp, Homo sapiens
  misc_feature (426)..(426): n is a, c, g, or t
tatttttttaatagcagagatggggtttcgctgtgttggccaggatggtttcaaactcctgacctcaagtgatccatctgcccttggctccaaagtgctgggattacaagcatgagccaccacgcccagcccactaatgctatttttacatccatacaacacagcttatcgaagtgcataacttttgctatcactttctattcacgatatttaagacataatatgtgtgtgtgtatttatgatgctgtcactgtctctgtaatcctagatcagaagtacttagtcacatgaggattgggtacagttgtgttttcattcatcctctattcttaatctctctttgtggatttttgagaccataaccactatataattcttttaaaagggctggggaggggtgtggacagcactgccaattgtgggggncca

SEQ ID NO: 505036 - DNA, 228 bp, Homo sapiens
cgcgaccgaattaaaaaataaattcatcgccacgaaaaattatgagcccgccgatttaaatgaactgctcgattttgcgcgccaaatgtatttgcgcggcgaaatcacgatttcccaataccgcgatattactcgtgaactcgaattagcaggggcttacaaaccagaacaaaaaaacgaatatgtagggctataatcgggagggtgctcccgtttttttatgtatga

SEQ ID NO: 505037 - DNA, 864 bp, Homo sapiens
aaatcctcgtaccatagaagctgccatcaagtatttcctcacgcgaaggcaactcggctatccagtaagtccttcttaaagtagactatcgcgtcttcgaactaagagtatctgctccggacacatgataccataaggaatgatgagccaatcgaatatcatcattaattaatcatagagtggctatgaggcgaataaaactgaggaatagcccccgtgtatgcactatacgtgagtcccagaggttacccaaggcacgccctgtgacatccggcctgcttcttctcacatgacaaaaactagcccccatctcaatcatataccaaatctctccctgcactaaacgtaagccttctcctcactctctcaatcttatccatcatagcaggcagttgaggtggattaaaccaagacccagctacgcaaaatcttagcatactcctcaattacccacataggatgaataatagcagttctaccgtacaacgctaacataaccattcttaatttaactatgttatattatcctaactagctaccggattcctactactcaaattaaactccaggcacaggaaccctactactaatctcgcacctgaaacaagctaacatgactaacacccttaattccatccagcctcctctccctaggaggcctgccccggtaaacggctttttgcccaaagtgggccatttatcgaagaatccacaaaaaaaatagcctcattcatccccaccatcatggcaccatcagcctcctttaaactctaattctaaccatagcgtaatctagtcagctcaattcacggttaatcccatattaacaacgtaaaattaaatgaagtttgacattcaagacca

SEQ ID NO: 505038 - DNA, 457 bp, Homo sapiens
  misc_feature (379)..(379): n is a, c, g, or t
  misc_feature (404)..(404): n is a, c, g, or t
  misc_feature (427)..(427): n is a, c, g, or t
  misc_feature (437)..(437): n is a, c, g, or t
gcgcttggccatgaagttctttattaggtgattgtattagtccattttcatgctgctgatgaagacatacccaagactgggcaatttatacaggaaaaaggatttaatggactcacagttccacgtgctggggaggcctcacaatcatttcgaaaggtgaaaggcacatctcacatggcagcaggcaaagagagagagcttgtgcagaggaactcccccttataaaaccatcagatctcatgataattattcattatcacgagaacagcacaggaaagacctgccgccatggattcagttacctcccactgggtccctctcacaacacatggggaattcaagatgaggtttggggcggggacacagttcaagccatatncagtggatttaaatgttttagggantgtttagggtgtttctttgatgnattcattccnttttatttattttggaggag

SEQ ID NO: 505039 - DNA, 685 bp, Homo sapiens
gcattccgatgtgattgatagtcaggaacttatccaaagtacagaccgtgaattaccacagccatgaatttcacagccatgaagatatgctggcttgtagaccccgcaaagtcaaggcaagaagataaaccaccttgcacaattatcgtattctctcatgcaattcagcatagctgccatcctctctgcagcgtcaacttaaaccaggcagcacaaacacatcacacagtctctctctacctctatcgcgattatcagactcaagacagcaccaccaactgcgtatctcaatagcgacaaactgcaacagaagaaaccactgcaaaatgccttccttatactccagctcttcatactgagctctggcacattagttagtcatcctcatttaccgccagctacctggccaaacattaaccgttcacatgatggctactaggcactaaataaaaacaactacaagattcatgcaggagcctttcccactgcggcgaacactcacccatcgctccagacacccatcacacacaagccaatatcccagccggcccctaattcggtccgtctacatcgactgcgcaaatagccactaacttcacgcacccgcaacacaataggcaaaaaacctaactaacacctgagccaactcacacgtcaccatgcaactagcatagaccacaatcta

SEQ ID NO: 505040 - DNA, 131 bp, Homo sapiens
atgaggaattcacttcaggtgggcctgccagcactgttgcacacattcacaccagtggtggtgttagcgtgggtgcagagcgctggtgggcacaatgactatatccatctggttattttttggtagttttt

SEQ ID NO: 505041 - DNA, 172 bp, Homo sapiens
tgcatatatcaatagtttgttcctttttgtcacttagtggtattccattgtatggatgtaccatccatccagtttgtttattaacctgttgaaggacattaggagttgttcccagtttttggctattacaaatattacagtaaacctaagatatgaatatttatgtataggg

SEQ ID NO: 505042 - DNA, 421 bp, Homo sapiens
  misc_feature (5)..(5): n is a, c, g, or t
  misc_feature (370)..(370): n is a, c, g, or t
  misc_feature (393)..(393): n is a, c, g, or t
agaanaattcattgcaaaattcattgcagaagaattcatcacctaggcacatagtcatcagattatctgaagtcaagatgaaggaaaaatcttaagagctatgaggcaaaaatatcaggtaacctataaaggaaaacctatcagattaacagaagatttctcaacagaaaccctacaagccagaagagattgattagggtcctatctttagtctccttaaacaaaacaattatcagccaagaattttgtgtccagtgaaactaagcctcataaatgaagggaatgatacagtcttttacagggcaaacaaatgctgaggggattcgccactaccaggccaggcactttaaggaactggcttaaagggagntcttaggtctttggaaaaaattntttcggaaatacacccaaattagggacc

SEQ ID NO: 505043 - DNA, 163 bp, Homo sapiens
atccccctatacagcagtagcagcagtagctatgacaggtggcagaagtctttattaggaaacaacagcttagcaggagaggagagccagagaagtgacagggaagctacgaggttacaacattatttgtgacctcagccaagcacagtggtggcagggccta

SEQ ID NO: 505044 - DNA, 250 bp, Homo sapiens
gttcagaccagctcctgctttaccatagcctcacttgtctcaggaggccaccgtggtaattctctctcgcatcttacaacaccctaacatttttttaacacaattgactagttttgatcacaataaaggatgatcatagatattattttttcttatgacagaagcaaatgatgtgatttatagaaaaacagggaaatacaggtacccaaagagtacatcaacatctgtatacccccttcccaggggtaac

SEQ ID NO: 505045 - DNA, 237 bp, Homo sapiens
  misc_feature (69)..(69): n is a, c, g, or t
  misc_feature (87)..(87): n is a, c, g, or t
  misc_feature (113)..(113): n is a, c, g, or t
  misc_feature (120)..(120): n is a, c, g, or t
  misc_feature (124)..(124): n is a, c, g, or t
  misc_feature (130)..(131): n is a, c, g, or t
  misc_feature (145)..(145): n is a, c, g, or t
  misc_feature (185)..(185): n is a, c, g, or t
  misc_feature (189)..(189): n is a, c, g, or t
ttgtatattttattacaaataaaacaatattgcttgacagcatcatctgtcatcttacagatatacaanctacacagtcctaaagtnatagtatgtctctagaactgagcttntctaaanacanacaatnnctatactattattnagtcctgcaccctaatctatacagcagcttatcaatgtgnaatnaatatgaatatattacataaatactatacattaagatatttcaatgtg

SEQ ID NO: 505046 - DNA, 1141 bp, Homo sapiens
ttttctcttctttctttttcgtctcttttttccctcgctcctttctctttttttgctccgtgccctctctttctctccccgttgtctggcttccgttttttttgtgtcgcttcttcagcttccgcgctttcgcctccctcctctgtggtgtgtgctgctgtttctttgtgtctcctctcttctctcctcctcccttctccgctgttctcttcgccctcttgctttatccttccctctttgttttctgcggcttctttttttttctgtttgtcttcgttctccccttgtttgtgtctccgttcgttcgccccgtaccttcttgttttcctccctcgtcttaatatccgttccctgtgcctggtggttctcttcccttcttttttttcgtgtctctttggtttgtttcggtgctccgtcttctcgttttttttctggtcttgtttttttttttctccttccttttgtttgttttttctcttttcttctagttctgtttgtcttctgcgtttgttttctttgtttggttgttccccgtgtgtttcctctgtcttcttcttttttcctttctgtctttttcttttgtggctcctctttttctcttctgtttcttcctgtgtcgtgtctgcctcttctctttgtcgttttcgcgctcttggattctctgggtctttgttcgtctgtctctggttcctggcctttgtctattgtcatgttttgctgtcctgcgcattgtcttttcatgcaatttttctgggtgcaatctggattggacaagaccatgcaacggtttccagtgagcacgcagccaattgtcttgcagcctcatcagctgcggcccgaggacagtggtcttgccacagctcttgaggatgtcaccacattgaaccagaaatccagttattgttccacacctcataagagtgatcagcgcatggaccaggcacgggtgcttctagggggctcgtacggggggacagctccactctgactggcacagtctctcgcatggagatctcgacgcgagggatgggctatgaggttggtgaggcttaggtgcgtgtttaccgcgcatagtcaggacatcagtacgattataggtggtgccggacctttactttataaccacagacgagatacaggg

SEQ ID NO: 505047 - DNA, 293 bp, Homo sapiens
gccttaggccagcaggtcagtggtaatcaaaactctgctagagccagaacgaaactccctacataatcacgtactcgtacctttaggtccatatactaccatgcataggcggatacagtagaaatctacgagcatagcatactatactacggtgagccagtaccacctatacctaccgggtgtaagatagaacgatagactagcctagggtagataggtacagggtaatcataacacagtacacataagtagtgtactgagctataccatctacctactacgtatccaccata

SEQ ID NO: 505048 - DNA, 384 bp, Homo sapiens
  misc_feature (110)..(110): n is a, c, g, or t
  misc_feature (133)..(133): n is a, c, g, or t
  misc_feature (190)..(190): n is a, c, g, or t
  misc_feature (214)..(214): n is a, c, g, or t
  misc_feature (266)..(266): n is a, c, g, or t
  misc_feature (278)..(278): n is a, c, g, or t
  misc_feature (297)..(297): n is a, c, g, or t
  misc_feature (306)..(306): n is a, c, g, or t
  misc_feature (352)..(352): n is a, c, g, or t
ttgtggataaggggccgggtgcagtggctcacacctgtaatcccagcattttgggaggccaaggtgagtggatcacctgaggtcagaagtttgagaccagcctgaccaanatggtgaaatgaaaccccatttnaactaaaaatataaaaattagccaggcgtggtggtgcatgcctgtagtcccggttantcgggaggctgagacaggagaatngcttgaacccaggagatggagattgcagtaggccaagatgatgccactgcantccagcctgggntacagagcgagacacggtntcaaaaaantaatgtgtggctaaggagttacctgggggaagtagaatgagaggtntgttgggaataaaggttttttttagattttgg

SEQ ID NO: 505049 - DNA, 221 bp, Homo sapiens
cactgatagccacgagccgtcatcgacggatccaaacgcgacgtcgctatgaacgctatggccagacacaagccagtatatccctgatggatacactatatctagacacctacctgataaaaaccacaaaaggtcagaacggagcgtgagagccccgactttcacgagtctgtattgcgtacatgaaaatcaagatcaacgcgagcattttgcaccttctg

SEQ ID NO: 505050 - DNA, 351 bp, Homo sapiens
aggattctgcacgagagcacatgtcagtaccgcagcctctagtacacacgccacaagggcctgtatgtggggcttcccgaggagaggctcttcggaaacacggacctgttgtccccttctgggacatggcagcctgattatacagggggagactgctgcaacgcgcggagcacaaagacacacgggcggctctatctatagaacaagatccacacactggagctgcttgaggagagacataaccggttcttagacactggagttaccaataagacgcttgcggcagagatgcaagagctgcgagtcccgcttgccgaggcccaggagacacgccggaccgcggagcgaccg

SEQ ID NO: 505051 - DNA, 169 bp, Homo sapiens
  misc_feature (52)..(52): n is a, c, g, or t
  misc_feature (62)..(63): n is a, c, g, or t
  misc_feature (114)..(114): n is a, c, g, or t
  misc_feature (147)..(147): n is a, c, g, or t
gcgaccggcgctcagtggaattccgttttttttttttgaaagtgttttttantttattaaanntaaaggcccaaatgaggatgtctccctgggggaggggggatttagggacantgagggggagggagaaaagggaaacacctgggnaagagaattcacaccacaggag

SEQ ID NO: 505052 - DNA, 249 bp, Homo sapiens
  misc_feature (5)..(5): n is a, c, g, or t
  misc_feature (17)..(17): n is a, c, g, or t
  misc_feature (183)..(183): n is a, c, g, or t
ctggntttggatggatncttccagcagagagtcacatgtcacggctaacatcaacgacaacatacaaacatttggctatattatgcatcaactcacggtttaatacatacatctgattattattctagtagagaacatacaaatcagcctcttcaacatattatatacagtttaataagcctnttgcaagttacttgttctctcacctgaggtattttaatcctccccacctagacccctgttcactac

SEQ ID NO: 505053 - DNA, 806 bp, Homo sapiens
  misc_feature (107)..(107): n is a, c, g, or t
  misc_feature (213)..(213): n is a, c, g, or t
  misc_feature (225)..(225): n is a, c, g, or t
  misc_feature (298)..(298): n is a, c, g, or t
  misc_feature (341)..(341): n is a, c, g, or t
  misc_feature (357)..(357): n is a, c, g, or t
  misc_feature (415)..(415): n is a, c, g, or t
  misc_feature (718)..(718): n is a, c, g, or t
  misc_feature (722)..(722): n is a, c, g, or t
ggacagacgaagagtttaaagagaaaagggaaaaaagaagagaaaaagtaagcagggctggcttcgcccgcgttctcgtcgtcggatcaaggagcgcggcggcgttntggacccgcgctcccatcccccaccttcccgggccggggacccactctgcccagccggagggacgcggaggaggaagagggtagacaggggcgacctgtgattgtngttattgatgtngttgttgatggcaaaaaaaaaaaaagcgacttcgagttggctccccttggctgtgaagagaccccctcccccnttccaacgagcttccgggactgtgtctggcacccccagcaagnaaggcgagtaagtttnctagagacttgaaggagtctcccccttcctgcatcaccacctgggttacggcataatntggcttctgggtcaagaaaggaggggagaacccagcgcacccctccccccctttttttaaacgcgtgatgaagacagaaggctccggggtgacgaattgggccgatggcagatgtttggggggaacgccgggactgagaagactccacgcaggcgaaatccccgttgggggcatatataacctccctctttccccatggccccctcggcagccggaggaggagcatgtgaggggaggaggccagccagcggtgaccggcgctaggaaatgacccgaagaaccccgttggaagccagcaccggnacanagggccggggcggagcaggacaccaactgacgggggtcagggcaactgaactggattcgaccttggggaactgaggacgcgacg

SEQ ID NO: 505054 - DNA, 257 bp, Homo sapiens
agggatgttcatagggcttgtagaagattatttctgggtatgtctgtgagggtgtttccagaagagattagcattttaattggtagactgagtacagaagattgcgcttaccaatgtgcgtgggcaccattcaatctattaagggcctgaatagaaagaaaatgtggtaggagggtgaattttgccctctgtttgagttgagctggcacattgatcttctcctgtgcttaacattagcactcctggtttggactaga

SEQ ID NO: 505055 - DNA, 920 bp, Homo sapiens
cggcgactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtgatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcagcttggaattcagtcagtgattgctgctcatcttcctcatggacacaccctccatttcaggtgaggtggccc

SEQ ID NO: 505056 - DNA, 194 bp, Homo sapiens
cagcaaattgtctattccctacgtcagcgcttccctccaccgctagtagctatctcaagattcatttgggtctcaggcatccccagccccctcaatgagctccagtatgggagggctatgaagatttgaccctgagccttccgtcgagatcctccagtcttgcgcagatctatcttgcgttcagattatatata

SEQ ID NO: 505057 - DNA, 949 bp, Homo sapiens
cggcgactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtgatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaa

SEQ ID NO: 505058 - DNA, 317 bp, Homo sapiens
  misc_feature (253)..(253): n is a, c, g, or t
gcttctcaccgctcagaactacatctgccacggctattccacaccttgtctttctggtagaagtcaaaattccatttcctctagcagaaaaccacaggagtggtttccttgtagcactatggtgctgtggggtgcacaatatcagttatggtcaacagatccccctttttttcccacttggtactgaaaaccaaggactacttcagtacacccctttattacacctctaactgtggatagaacgcactacggnaacttacttcttctgtacctggacaaaaaaaccattaaacctgactcttgacgaacaaaaaaca

SEQ ID NO: 505059 - DNA, 202 bp, Homo sapiens
cacgaggagctcctattatgtataaggaagaatgactatcagcattctacaagggggttgctcctctctggatgagacagataacatacaccatgatgaaattctcctgctttgaacgtactgttgaagcactgtaaaaatttgtggttctcaacacccgcagtgaatgttcacagccagaacagctggctgtaacatttgt

SEQ ID NO: 505060 - DNA, 1120 bp, Homo sapiens
ggtggatctctgcgttgtgttctgtttatttcttttctcgctcgggggtgcggtgtggttaggatggtttgcttttttcttctcatagatagtattgttctgcgtgtagtttgttggttgtatgtaaattagtagatcttcccctcgcttcccgtatgtgtgtgtgcaaccacttactcttgtctccgctgctggtatgattctctggctttcttgatcacttgtcgttgttggttctctcccttttcatctccgctccctcgtcgttgtagattcgacgttgttttttcttgtctcagttgtcgtggtggtgtgtgtgactacctactactgttgtcttttgctctttgttctttgtatataagtgacgctccctctgtgcttgggcactgactcttgtttggtttgtctctccgctacactgttctctccatggttgggtgtcgctccgtgggtgataatactcatctctcgctacccactgtgttgttgtgtggtggtatcatactattaggtgcgcgctccgctctcagtgggggccgcgcgcgtaggttccttcctttctgtactcttcggtcggtggctctcggtgattgtatgaccgctttcgtagcgagattgtggtcgattctcacatttagattttcctatctgtgagtcacacataaatatcgttgtttcgctgtgagacacacatctcttttgcgtgatcctgcgtagaggagtgattaattctgtgtgggagacacacacatacagtcttctattgttggtgagaagaaggagtgaacacatctcacacacaccaccaccaccccctgggtctgcacaccccgcttgttcacgttttagagaggccccccagaagcgcctcttctttgccctcttgtccttctatctttggcctcttggccccacggggcccccggggaccctctcgtgcccctcgttggttagagggtgcgtaagataagaatttcgtacttctctagggccctctttgtcccccccatgcccatataccccctttatgtgtgtggttttatatttttttgtggggggagaaaaaaaataaaacggtttttttaaattttatttaaaaaaaaaaataaaagggcga

SEQ ID NO: 505061 - DNA, 1507 bp, Homo sapiens
atgtctgaatgcgactcttcccaaactgtcgtcatttaccagaatcaggcatttcgcttataccatgtatagagactcagacgtcctatgaacctatgcagggggacgagatgttttactgggagagctatagtaagaattacccatttcgtgtcattgtatctcagtggccacgggacacagtacacgacgtagtcttaccgtggtactccagtgatacttgttacaacgtgactgatcgtagaagtcattgctacataggttcgctgtgaaggcctgtgcatggatgctgtcctagccggttctactcgtgaagacactacaactgtttactacaactccttgttgtgtctcgactattcgactagataactataaggtgatgctgaactgtctgcccctcgggagccacacaccatgagaaaacatgagaccggtgagcgacgcggtatacacgcaggagggaagcaactcccctagctacacggggacccacttgaaaaggttaatcaattgacgaagacccacttcaccgggttaatccacgtggcagacaacgcgccggttcgagaggcactctcggaaaccagagggagcgatgcagcgtaacttttggcaaacggcccaaggcctaacgaggccagttcaacaggttccccagacttttccaagtcaggaaccgagatgctggcacgacaataaagccgggaagccaagctcctttgttgcacacttagtggcgcagttgcggcagcatccgtcccaactcccacatccaaaccaggaaacggggaacgtttgggccacgtggaactttggaggcccacaaagctccaggacgcgccgggagccatttttggccaagacccttcgaacagtggagcgcggaaccaggaacaccagggaaccaccgggcacggcgatctcgtttgattaccgagcgtggtagttggtaaacaccacagaaaagacaggggaccacaaatatatcatctagtacacgctaactagtttagctcacaccaacatttactgtcagctctactaaccctgtagcaggacactcttaggcaccgctgcacacgcgacaccaacactattatctttaatacaagcagagaagtagcacttagtagataactaacacaaatacctacagacagccactaatccaccacctaaaatagtaaagcaacacccagcaactcatcaacaatctctcatatttatccacccactcacagttaattacaactataactataactacatacaggacaataccacaaatactaatcttacaaataactaacatcaatcacacaaacaaaataactacacagtagacaccatatcaaaataactacacgcacaaaaagcatacccaaatacacacacatcagctctaacacaccaatacaacctcataatctcacaatcacaacgactcaacaaaacacagatactagacacacagaacacacaacttacccaaacaaacacataa

SEQ ID NO: 505062 - DNA, 115 bp, Homo sapiens
gggcgacgggcgtaagggaccgtagggaccgagtgctacccatgagcgcacgtgggccgggcggtccgcaagcaccggcttgagagcatcagccatggggcagggcgggctgcaa

SEQ ID NO: 505063 - DNA, 237 bp, Homo sapiens
ggcccccccccctttagattttcccctttggggaaaacccggttccccctggggattccggaaagacccgcctttttttttttggcccggctttgtttttaaagcaggggaatcccgggcccttttaaaagttgttggggggtttttttttaaaaggccccggtttttggaaaggagaattttgggggccaagggttgttttttttttggacaaaaaaaaaaccccttttaaaagga

SEQ ID NO: 505064 - DNA, 488 bp, Homo sapiens
  misc_feature (133)..(133): n is a, c, g, or t
  misc_feature (158)..(158): n is a, c, g, or t
cgttccaaaccaaaccccttattaaaatggttgaagaagccagagcaaaatccttctggtgccaaagaaaaagatcaagataagaacattgaggtggtgtattccaaggctgccagtgtccccaaagttgagnctgtaaagtcagacaacaaggatgncgccatcgatattgatgccatttaaagggatggatgccacctagcttaacagtataatgctgcaaattttcctccattatcagccagaagtgcaacatgtatgtgcaaaagctaaaatggcttaacatcatgctcccctttaccctaaaaatctattactgtgagtggtctgttattaagcccaatgagacatctagggagtccatacccatcagtgagcagatgtagtttgcttatttatagcatgtttctttttgaaaaactagtggtggccccatttggatcccctttatccagttataaaaataaaggtttgattttggtcgttta

SEQ ID NO: 505065 - DNA, 84 bp, Homo sapiens
aaacaaaagtttttttttagcattttgaaaaaaggaaagtaaaatgtccaagtttaataaaaaggggccttcccctttagaata

SEQ ID NO: 505066 - DNA, 609 bp, Homo sapiens
attgctagatacccaaatggagaccattctgtgtgtgattatgcactgagactgtaactggtaagacttgtatctccctccccctgaaggagaattgctggctcaattttcaggagccctgcccttcctcacctgtggatggtgggttgtggaaacccggtcaggtaatgatagtggcaggaggccagtccaaatgccccaggccagataggggtgggtacctggtgaaacacccacccttataagctgagagaccagtccccggcgtaaatcctcatactgaattgagaaccctgtcttccccaattggtgtgctttcctccgattgatccccaccctctcacctattttacgtgatacctcgccctttcctaattggtttttacactgctgtgcccacctctttgagtggtgcccttgcataacttaccaatcagtccacgtgtattcccctatttctgagccccataaaagaccccgactcagctgccgatgaggagagaaatcaccctgctgtgggggttggggaccactccctgcatcccctctcccctgagagctgttcttttgctccataaaattcttttctacccatcctcaccccttcca

SEQ ID NO: 505067 - DNA, 359 bp, Homo sapiens
  misc_feature (332)..(332): n is a, c, g, or t
caaacacactgtagtagccacaggtgatcttttttaaaaaataaatcattttatgttgctcctatactttagcactggttactgtgcaaaccttcatgataaaatcctaatttctgagcatggtatgcaaaactcttcataatacagactgattacctcctaaccatctttcaccagtcagtccctcatttcctcctaactatgtgctctcgccacactgaattgtttcctgttccctatgtaagccataaatccttgcctctaaaccagcagtatccaatagaatgttctgtgataatagaaataatcacttatctgcattatccattatnagaactgctagctacatcacatacatg

SEQ ID NO: 505068 - DNA, 1244 bp, Homo sapiens
tttcagaggacacattagaactcacacggtgggaaaacgcctttttcttgcactcagctgtcaacagagcatttgcaatgacagggtcaaatctgacgggctcatcttgcagacccattctgatgtaagagaacattaccagtgcaaagaactgtctccaaaaccttctccagaatgtctctcctgcacaaaacatggaggaatctgggctgctgtgtaccacacctgtagtgacgcaatcgaatgtcttactcgaaacagatatgcattacttcgactccggaagccaaactgacgaattaaagtccaaagggcatatactatccgtgtgcatgacctaacgcacaattaagtactgtaataagacaatccacagcaccattattggcaacaagctacgaccagactacaagcagcaatctccaaaccagggacgcacgaatgcagctggccacacgatgccattggaacatcacatgttgttataactgattaactcctatccccactcggtagaagttttaagaattgcacctattatactgtggctggattgggcatagcattccgccgcaccactctcacaaagcaccagtacaccacattattcatcttatcacacaccgacttaacacccttgcaacaccacgccaccaactttggccaacttccttactcaccttacccataaatcaccatcaccatttgcacacaacatactctttagcactttcgggcttgccgccacacactttcacttcctccccaaaccctttcgcaacaacgaggcaacccaccgttaacattgggcactgacctggcacccaacaccgcgaaccgactcccatgtgactacaacgctccacacgcacaatctttgctcccccatcatttatggcacccgccgcgcaccagcactcctcgtggcgcccaagaatccactgccacggacaaccatcacacacaggcgcctgtgccccccctctacttcacaacaaacacaaagcggtatcatcttctccccaaaaaacgagctttatctaaccacagctctaccacacacatttgctagacaccgaccggttgcttttcatacgcgccagtatgcttaggatctccacttatagactagataaaatctgtgacacacccaccaaagcaattcggatcgatctgtcgttgtgataaacaaacagaataatcataacacagacccgcgaccacacgcctatattgctttagtc

SEQ ID NO: 505069 - DNA, 472 bp, Homo sapiens
atcacagtcgaaacttatttcatgcacaaaattcaaacagtgtataaaattacctgcaagctacgtgtatgaggtgtgcgtgaaaaataaatgagttttgtgtttagactcacggtcacgtcccaagctgtctcatatatgtatatagcacatatgtccaacactactgaaaacaaaatccaacaatccgacaacatttcgtggccttcacgcattttcggatactgggatacccaagcctgtacggagatacttggccatgatatacgtgggagccaactggatgtatacctacagaatctgcctaaacctcgaccgtgcttcccaatgtcatgggtcaccagtcgtcacgccgcaccgccggttcaaatgcaggcgattcctgaggaagccatacctgaggagagtggcgatgaggacgaagacgaccctgacaggagcatctcgatctgctcctctgaaaaacgcattg

SEQ ID NO: 505070 - DNA, 319 bp, Homo sapiens
acacgctactcaactctgtcaatcctgtccgtgtccgggccgggtgaggtttcccgtggttggcgcatgtgcaagacaggttcctaaacgcttctttactcggacacgtctctcctacttctacaagtcctgctgtggcttacacacttacctgacgctttgtactacttggttactctacggacactgcctcttagggacctgacgctacacgttagttgccaatggctacactaccccccaacgcctgacttaaacacatttacggctgcctagacacacaacacaaccccccaccaaaacggacttccacgcacat

SEQ ID NO: 505071 - DNA, 702 bp, Homo sapiens
  misc_feature (207)..(207): n is a, c, g, or t
ggagtgctgggccggcccttccgagttgtgtcttgctggagcagtcccagggccaggggaaacaagttccaacgaaaaaggacattcttcacccagtcagctcctgtccatattcagccgagatgtgttgtatgtattttacctatgtcatttcttccatcagcagtatgtgcaatgaagcactaattcttgagtattgggatacantcaatgaacgaagagaccactgtctataacccgtcaggatgtacgagaaggaaaacaagatcagcgaagaagatactgcccgcttacccccgcttaacagaggagaccacagattgcccttgtgaacaccctaccagtttggctgacaccgtggggctcaagataagtcctctctggccctagttgcatttctttgaatgaaacagctctaatgagagctctcttcagagtttatatgttctcgacacttgttcctagccagtggcaatgaataaatcaacctatactaattgaacaattagctgtgggcaaaccacagtatgaaacactcctgggcaccatggagggattccagaaaggcttggtccttgtctccctaaagcctggaatagacttgccacaattacctgatggtggaatgccgggccgattacaggtgaacctggactcctggggttcaggaaacctccaacgtccacttaagttactggctcc

SEQ ID NO: 505072 - DNA, 756 bp, Homo sapiens
atgctggttagataattattggactacacataaactcctaatattgaatcattacctatcaggtattatctttatggaacttttcaatatcttgctttataaagattctaaacatgtatctgagctggtaatattttaaaatctccattatttgtgtaaaactgtttataagcagtgttgagagggtctgctttaccattaccccctcaatatcatgatcatccaatctcaaatgtgaaaaaaaaaaggaaattggatttaggtatggtgagtaaacaagtcttatatagacgagacactggtggaagttaagagttcttcagaagttacattggtgcagttctgtaccttttcctcatatacgtgccatggaaatagaactggaaagttatctgggcaaaagttagacaaccaaagacgactttagtggactggttttcaaaacttgagcagctgaaaagcaaaagccgtggtttcccatgacaatgtagccttgtgtggatcgggtttggcttgggtgtgaaacagaagtgcttagtcctagggcagtagatggcagcagcttttcatgtgcagacaaaacctctgtgaaaccttcccccatggacaagtcgccatgatggaaagcatctagattctgctctttacagctatccagagagggagtctttgccactgtgaccagcagttccaacgccagatagtctcgtgaacggccattccgaatacggggcttcggcaatctcccggcttggg

SEQ ID NO: 505073 - DNA, 1183 bp, Homo sapiens
ttgtgttactgccactcgtcgttttgtcttgggtcttggctatggtcgtgcgttatgtcgttttctgattcttcttccgtacatattgtgcttggttgcgtgttgtctttccgtccggctgtttatcctcgagtgtctctgtgtttcgctggttacgtcttcgtctgtctgctctgctctttgtccctgtgtgtgttttcgccctatgttgctcctctgctatttttctcccccgcttgttcgctcgggtcccccggcttttgggccacctgtttcatgtgccacactaatgcttttccccttcgggccccggcttgccccttgggaatcttcgggggccccagttccaccgtggacccctctgggtcattgtgcaaatgtgtctggctcccaacttgtaccccctcagaattggattaccttggccacgcttatagagggaattttctcagggtatttaattaggtgtcccacaaggtcaaggaaccaggatgggaaagacgcattcagaactgttaatttattgaccaggccaatgattttctggtttctggatgcccgactattaatttgggacttattttcccctttgagaagttataatagtatatgttaagatgatagagtttcctgcttaagttgtgcccttcagcttccatgagtttaaggagccctaagggtaatgatacccatgagggttggtttattgatccaacctgaatagctgtggtttctcccgtaaatacttttctgtctacctggaccctggaggcccttattaagagttgtgtgtttctttacttaatggaacacctctggataatgttttttcgctctgttcgtgaatcgtttctaattttgtcctaaatagtgttttctcttttagatttttctgtaaaagatgtgtgcatacactacgattctagatttctgatgctaactcgccaatccggttggtctctgctgggtctctcctgcttttattttaccttaaggacacagtgtaattgtcgtccaccacctttccaaaaaaatgtgaaactgccctgcctcccctttttgctgaccaaccactgtgtacattgaccaccttcctaccatactttatgttgtaaaatccaaactcttttgtggtacattatctcatgcttctgccaattcgaataaattctatggcttccca

SEQ ID NO: 505074 - DNA, 1253 bp, Homo sapiens
tgggttacggcagcactttaatttttccttacacaatggacgggttggctgggggcctaattattctcactataacagtagaaaaccaaaatttggtggtctatctctttaaagaatcgagatattgcgtacaaaaaaaaccttactataaattaagaatgaatacttttacagggcgtaaatggcaaaccggttccaactcaggggcaatgttaacagcccagggtggctctacctggccacgacaaccatctataaaaaaaaaaaaaaaaaaaacaaaaaaaaaaaaaaaaaaaaaaaacaaaacaaaaaaaaaacaacaaaaacaaaaccaacaaaaaaagagagagagggagggcgcgcccccacaccctccctctccgcccgcgggggccaccctaaacgcgccccccccgctcctttcccccaagcgcgcgccccccccacacggaggaggtatatcttaaataacccagcaagccgacggcccggcccgtcctaacaacaacaccccaccgcggccgggagaaaaaaaaaccacacgggaccatcactcttctcacacaaaccaccaaccgacagggacgcgacagcccgacacaacactcagcaccccacccccacccacgacacccaaccctccacccccgcccaccgacaaaaacacaaaacccttccctgcagagtgtatctactccggtcacccaacacaaaactaccaacacaccgcaccccgccgcaaccaaagatcatcccaccccaccccagcagcaacagaaccactacacacacacactccccaacgaggagacacgaaaaaagaaacaaacactaacacccaacacagacatagagagaccagacaaaaacacaccccaaccaacacacacaacaaaacacacgcaaacccgcaccacacacaagacccacccacccacacacaacctgcacccacccatattcaatcatcatactacataaacacttaacaaccactaacactacatatcatataacattcatccacacatcttcaaagcccacacccaccacacacaaaacaaccctaagcacctagaaacctacaatactaatatagccggaacaaccaaaacaaccacaaaacagacgcaacattacccacaccacccatcaccccaccaatcccaaagaactacacactgatcagtacaactacaccagccagtcaccaagcagaacacccgacggagttgtgcaaaaacagaaacaaa

SEQ ID NO: 505075 - DNA, 357 bp, Homo sapiens
  misc_feature (44)..(44): n is a, c, g, or t
accaggtatgtatacagaaatagacgcaaaatgaaatgcagtantataattctctcacttgtatattgtatataaaaaaggacactaagcgggaaaattatccaactgtagatgttcaatatttaatgaggtctaaacttcagagtgacaaaaacacccacccaactctacatctctatcaaaacaaatatattatgtaagaaagaattccctttaaatatatatgtatatatagtcatgttatactgttaattaaacccataattctatttatttaaataagaattaaataaactggccaaatgcttattttcatttcacaaaacataaagtattttaaatcacaacttcagggtg

SEQ ID NO: 505076 - DNA, 542 bp, Homo sapiens
  misc_feature (445)..(445): n is a, c, g, or t
attcgcggccgcgtcgacacggtacaccgggtacgcggaatccccgtcgaggataaattgctcgccgcccttgacgtagctgcccttgttgaccggtccatgcaatgtcacggcctcctcgatcactggtggcttcttgaacgcgtccaaccctttgaggtttctgaccggggatggcagacgcaggttgccaacaccaccgtcctgcagccattggcggtgtctgacccgggttagcagcgccccaacctggggctggctttgcctgaggcgccaaagacagggccacatcagccaccaataccaatgccgcaaaaccggcggccaccgcatccgctgggtcgccactgtgatgggcacggcgggcggcgagcaacagctcatacagattgactccgatactcacgcccggaataaacgataacaagccccgcgcacgcgccgncgactgtccatcgaggcgcagctgacggtagtcttgcagcgcacggcgtgaattggccatggctcgtcgacgcggccgcgaatttaatagtagtagg

SEQ ID NO: 505077 - DNA, 198 bp, Homo sapiens
acacatcagaaatctggacatatgcctttttcaaattatcacttagtgtttattttttttggtgaattcttcgataatggcccatttggccaaaatagccggttagctgggggcaggcctcctagaggaaaggcagggagaataggaataaaagggtgtaagccatgtagagcttgtctcagcgcatccgtggggtac

SEQ ID NO: 505078 - DNA, 196 bp, Homo sapiens
  misc_feature (13)..(13): n is a, c, g, or t
tcgatacgacttntctctctctctctcttctgtctttcttcgcctgcctgccttccttccttcacctctcttttccttccttcttttccctatctatctctttctttctttctatctttctttctatctttcttccttccttcctctctttatctttcttcctatctttttctttctttctttttccttctgtcgt

SEQ ID NO: 505079 - DNA, 286 bp, Homo sapiens
  misc_feature (29)..(29): n is a, c, g, or t
  misc_feature (58)..(58): n is a, c, g, or t
  misc_feature (107)..(107): n is a, c, g, or t
  misc_feature (188)..(188): n is a, c, g, or t
cctgtagccatccattttggaggcaatanccctatgtggatgaagtgtcatccaaacnggacatacaattgaatcagagacctctatatagtgctgtgtccccagcnggaaaaatgccaggggccctaagaaccaagggatgtaagcaggaaccgtcccatttatcatcacttgcaataatcccaatnaggggcattttttttgctgttcatcatgaaatgtggagtctttcaggattagcggtcctgaagactccaccatttcatggatgaacagacaaaaaaaa

SEQ ID NO: 505080 - DNA, 121 bp, Homo sapiens
  misc_feature (22)..(22): n is a, c, g, or t
  misc_feature (33)..(33): n is a, c, g, or t
gtagtcagatatctaaactgtnttacaaaaaanaacccacggagctattattaaaaaactgatcttttaattttatttatttaggtcaggaactccctgtattgaaacttctaaaactagg

SEQ ID NO: 505081 - DNA, 174 bp, Homo sapiens
gtgactctagtaggatcccgcttgtggcttctgacccctctgtgtctggtgtgtcctgccctggcctatgtggacaacgcgtactggctgtggactttccagtggacgcctcctgcagaagaacaacaaggaccgcttcgtgccacgctgcgtgtggcgcgccccgtgcctccc

SEQ ID NO: 505082 - DNA, 1264 bp, Homo sapiens
cagcggggaggctgggagccctgcggggcctggagccgccctggctgaggcgttggtggctgcggggccggcccatcctgtgggggctgacttgacgcgttgagtggctgcgcggggatggcgagccaccatgttcatgccagcagcagcagcagcagctccagcaacaggcagcagcagctccaggcagttacagcatgcagcagctccagcatgcagcaattgcagcagcagctagttactgcatgcctccagcagctgctccagcagtccccaccacaggccccgttgcccagtggctgtcagccggggtgctccccccgtcagcatgccacagcaggcctgctatctgactctccatgggccaccaacatcaagccatccctcctcaactggctccattgcttgctgaggaagctattgctatagagcatgcagtttggcaaggaactgcgaccacgtttgcagtgccaccaagccagggtattgacagctggcgcggtacatcacgcgattgcccacgatgcacacacgtggtgtaacctcgcgaggggctattggcagttggctcttcccggaggccatcaggaaggccccacaggcacagtcgaaacaacccctagaaattggacccactacgcaaattttgcacacgatgttatcctattaccccacacgtggccacgtcagacacatggtaccatatggcatgggagtacgcgttcccgtcgcgtggtatgcgagggtaccccatttggagagcgctatttccgcaaggaattcaaagcccgtatttcaaggtgaaggagataacacacgcgaagtaaacagtaggggcccctgggaacccttccccgataccgagttcagttaacccgacgcctcggccacgcgctccggaccgcaggggagttttcagtcacgtttcgcttcaacgacgcgtacgttgcgtgtgttgaggacagagcatgagttaaggagcccctagcgcaagagaggtgtgtagcgctaggttggcgcaggcgaccggccgaaagggctcgcggatgattttgcgagcaagccgtccggcaaagtcaaccgcagagatgttacgccggtatcagtgcccccgagaacggtccaattctctcccaggcgggtataccaagggcgtggcctccaggactgccattgacgccttggaggacctattggtacgggggttccggtcgcgtgcggccggacactgaggagtgtgcatggaatccttatcaatcatgct

SEQ ID NO: 505083 - DNA, 204 bp, Homo sapiens
atccccgtaggtggttgtggctagacagggagacattctgtaggtgatggataagtgtcgaatatggggaggtcgctgtaggagaggacacattgagtggatgagaactctgactcccacatctctgtggcactttgtgagttgagactagcttgatataagaacagagcctaccatatttcttgcttgtaggaggaggtgaac

SEQ ID NO: 505084 - DNA, 233 bp, Homo sapiens
ttcgccatgtttcccgacgggagaggacgccccacttcgagggctcacacaagctttgccttcttgtagaggggccaggagcagcttcaggtagaagcactgtgcagcctcttagggttgaagaaggatgggctgttgccttcacgctcatctttgcccattacgccgtgaaagatgatgggaaagccctgtcgagcgaggcccgcccagcggcagaagcgttctcgatccac

SEQ ID NO: 505085 - DNA, 189 bp, Homo sapiens
ccatttcccatttttttttttaaccaggatttgttcaaagctccagcaaatttttgttttttttaattctagctttgagaagctcatatatatttaggaaatgctttgccaatatttttcagggggtggtttgcctttttacccagctatgttgatttttttttatttaaaaaaattgtttttggtcca

SEQ ID NO: 505086 - DNA, 409 bp, Homo sapiens
  misc_feature (397)..(397): n is a, c, g, or t
cctggcttctagaatgctctgtccagggtctgcaacttccctgggctctgacttaggagtgatgtggctaactgaggcctgagtgagtgtgtagattgtccttgggtgagtgagaaaaaacactttgcattgctttcaggttggtggaaaatgtcagtggtgtagtgttgaggacctcactatttttttttttaaatcatttatcctagagaaggactctgatccttgctttcctaagtaaattatgctggagtgcttccagtactaaggcctcttgattctttccccttgaacactatgagcactgacaaatcatggtagaggtgccaccaaccagtttgcacagtggaggcacctgacatgcattagcctggacttctctgagagctgggcacanttgcaggacccc

SEQ ID NO: 505087 - DNA, 277 bp, Homo sapiens
gcgcgaattcatcatccttctgcgcgaattcatcatcctgctgcgcgaattcatcatcctgctgcgcgaattcatcatcctgctgcgcgaattcatcatcctgctgccgggcgcgatgacgctggcctgaagacccagctactcgggaggctgaggctggagcatcgcttgagtccaggagacctgggctgtagtgcgctatgccgatcgggtagccgcactaagtttggcatcaatatggtgacctcccgggagcggtggaccaccaggttgccta

SEQ ID NO: 505088 - DNA, 1397 bp, Homo sapiens
  misc_feature (896)..(896): n is a, c, g, or t
  misc_feature (1397)..(1397): n is a, c, g, or t
aaaaaaaaaccgggtgggtttcactcagaaggttggttagggaagacaaaaacttgggaggagcagcttgggcacggtgggcttcaagccttgttaattcccagcaccttgtgcgaggcttgaggtgtgggtgtggatctcacctgtgaggtctcaggagtttcgagaaccagcctgtggccaacatgtggttgaaaccccattcttcttacttaaaaattacaaaaaatttagccgggcgttgtggtggttacgcacctgtgtaatctcccaggctatactctccgggagggcttagagggcagcagaaatctccgcttgtgaaccccagggagggcaagagggttgtgcaacgagagcgccaagagattcggcacccattgtgcaccctccaggccggggccaaacaagagagcgcgaaagacctctccatctcttaaaaagagaaacacaaaaacagagccaaaaccaaaacaaaaaacacagcgggagaggagaagccaatatacaccagagggaaaatctccgagggcttgtgagagttatttatttattataagagaagagagagagagagaagaggagaagaggcgtgtggtgtgcctctctctacaccttctctctccctgtgtgtatgagggtgtgtgtctcttataaaagagatacacccgtgtgtgtgtctccctctctgtgtgtatatatatatctcctgtgtgtcacaggtgggtgtgtattctctctttatatctatatatatattgtgtggctccccactctgttgtgcccctataaaatatgtggagaaaactctccacaggtggggacacgccaatgtggggctatatatagaggggtggtgttctgtgtgatgtcctcacaactcatctgtgtgggcnctctcttctccgcaggaagggggagctcttgttgataaaaaacaccgcaagaacaacatgtataccgtgttttaacacacaccgaggatgacggctcctgttgtaaacaacacccaaaaaagagtgttgaaggagcaagcccccccacaaattaaaccactatgttggtgccagctagaagagggagcacaatgtgtaacggagtgaacactagtgcaactctgttgaagaagagcagccccccccccgaaagggggggagagtggggacccccctctccagcgaagaacaagccggggagaagaagccccttctgagtgggccaacacacaggggtgcttatccaccagacgagtcccactaataaaaggttccccactctctagtataggaaccccacaaaaaattatagggctgggcgaaaataatcaacacgctttattatttatctccaccccttgtggtgtcccccattttgtaatagaaacactacacacacan

SEQ ID NO: 505089 - DNA, 300 bp, Homo sapiens
  misc_feature (1)..(1): n is a, c, g, or t
  misc_feature (21)..(21): n is a, c, g, or t
  misc_feature (117)..(117): n is a, c, g, or t
  misc_feature (156)..(156): n is a, c, g, or t
  misc_feature (171)..(171): n is a, c, g, or t
  misc_feature (205)..(205): n is a, c, g, or t
  misc_feature (209)..(209): n is a, c, g, or t
  misc_feature (257)..(257): n is a, c, g, or t
  misc_feature (288)..(288): n is a, c, g, or t
nttgcctcttcatcctaagtnttatatacggttctggcaatgtcttttaacacatgaacacctggaggggtggctaataagatgtcaccatgtatgggaatgttaaataggatacantttaaaatactgaaaaaaatactattcagatgtgatgcnttaactctccaaacnttgaaagatctgtcacatgacagacagatttganttgntctttattgctataggagagggtgaagttaaggggaagcacatttcanatcaatataaggaaatactttctctttaganttatttgtagat

SEQ ID NO: 505090 - DNA, 291 bp, Homo sapiens
agcagcatgtgcattgggatcatgtgatgtgtggggagactctgcaaacagtcagagaatgagaacaagtcagaaaatggttgaaatgggcacagaaattccagtcatgtgaagcaaactgccctttgtcctcaaagaaatcgttgaacaagacaacttttataaagagatttaaagcatattctcagccttgtactgatcaacttgacgatgttggcattctctaacctatgacctgttggcctgacactaattcagtatccatgtcaaaatttctgtgccccatttcaa

SEQ ID NO: 505091 - DNA, 726 bp, Homo sapiens
  misc_feature (43)..(43): n is a, c, g, or t
  misc_feature (235)..(235): n is a, c, g, or t
agcggatatccttaatggctggcttcgaatcatcttcaacggnaatccgccttctaggcctggtgtggtggctcacgcctataatcccaggcacttagggaggctgaggcgcggtggatcacttcagcgagttttgatgaccagcctgggcaacatggagtaaacactgtctctactaaaaacagaaaaattacggctcaggcactggcttgtgcgatgcctgttagttcccagnctactcgcggaagctgagtgcgggaggatcacctgcatctaggcgcacatggcaggttgcagctgcagttgagattgcaccatcactagagcaagatcctgtctaaaaaaaaaaagaaaagaaaattcggccttccttttattcatttttatttcgaagaaataaccggaacttaccgggaacctaagttctaggctcatggtattgcttcttgctctttagccaagttcccttaggttccttgcagtccttcgtggctaaggtgacgcagagtgtttataacagagagacgattttaagagatgaccgttgaagacagatgttccaaattcgaccggtttcttacttccctagtttcacaagttagggtcttcagaagttgccaagcagtactaggatactcctctaggaccgaggatgtgcaattctgagcaaatgtgcagtgtgcagtatagatttccagcctccttttaaactccttcaagtctgtg

SEQ ID NO: 505092 - DNA, 428 bp, Homo sapiens
aggaacatgtgagtcatcatccccctgatgctgcgaacatgctgcgtccaagaaatggctggacatgcgtccggaaatcaaaatcaccagcaagttgcgaggcaaatacctctccattatgccccgttcggtaccagttcattgtaattccatgcaactgggcaccactacacttggaagaacgtaccacaactgtacacaacattatgtgggcaagtgtggatagatcagtctggcgaaattgatattgtgaatcacaagacaggagaccagtgtaatcttaaattgtaccttatagctacttctctcgggatgtagcaagaaacgtgaccggggcgaagtgacagatccatcagtgcacacagtccactttgctcttctggggacgtgggatgacaccatgcaatgtttcacagtacagccagtca

SEQ ID NO: 505093 - DNA, 117 bp, Homo sapiens
actgtcaagctggccttgttgtggagatcgccacctaccgcgagctgctggagggcgaggagtgcaggctgaatggcgaaggcattgcgacaagtcacacgtctctgtagtacagtc

SEQ ID NO: 505094 - DNA, 1449 bp, Homo sapiens
ggacgcgactgagcaacaggaggactcaggcctgagtgacagggccccagatgagtcacacaaaggtaaatcgttgatctctattacagtgaaacagataacgcgacgaacgtccgagcagttgcgcgcgacaggtcccttgtgtggtcttacattgtcatgagacccatgaaaggacaggatgaccgttggactacaggccacaacgtgtcctcccaagagctcctttaattgagggggcaggacgtcccagggaaaaggagaaaccattgaccattgtctgacacaatatgacgaaacatttgagacgatacgaagattgtagctccctcagacgcgggtacgccacgcaaaatgtgagagacagaagacatatagaccgagagaacattggtgggagatgtgcgacataggttccttgctcacgggtcgcctaagggggatgtcacaagggacatgctccagtgagctcgcataatgtaacacgaactcttagcgacattatggcaccgataatgcagcattcctcgtccaagccacacaaaggtcgaacagccatggtgcccgaggctcatccgtcatcatgacacaccagtgggagtcaccatcccatcaaggcactccccaggacttgacgcggcaacagcgggagagcattcatggcgctgtacgctctgtatctcgcaacctccaattttgcctataggagatcatattcttaacaagacattccccttcgtatgggggcaataggagccttgatgcagggcctgggggaagactcgaagggtcccaccttcaaggacaatcatttccaacacgaaggggacttggatcagaagactgggacccgtcctatattgtgcccgtgacatggccctcggtagaaccaggggatagtaaagcaaacaaaagcacacgaaggattccctcacgttggctcaggtggcgaggaattgcaccactatatggggaagagagccatggcccagaattcataggtacctaagaggcccaaaaggaccaactcacggagcaaggccttaagataacgcgaggaccccactatcccacaccagggggggcgccgagtgggggaaccaccgagtggattaaaccaggtctaaaacgaggatagggcttctgataagtaatcaagagaggaagttttcagaccgccgcatgtgagtggtaatgcagaacgccccacattgttggcacggaagatttcggcacaagtggaaaaccccccggggttacacccccactttcccattgagtagaagaggtactactggtcaaaaaaggaccaacagaatgttttgcgagtatacgctctcgaagaagtacaagaggcacgacaacacatcagttactgtgctagatggagaagcccactcggggagcagcacccgttggatatatcaccggaatgtaaaaggaaggagc

SEQ ID NO: 505095 - DNA, 259 bp, Homo sapiens
cagatgtatgtttggatgtaaagtgaaatattggttggcggataagcagatagtgaggcacgtggagccaataatgacgtgacgctccgtggacagcctgtgcttacaagaaaatgttgagccgtacatgcctgtcggaaatggtgaagggagactcgaagtactctgaggctttgtaggagggtaaaactagagccccagtaaaatttgtactacagcagtgcttgaataaattgggttaccggtaggtggcctatca

SEQ ID NO: 505096 - DNA, 1732 bp, Homo sapiens
gccaaccccaggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgcatcccagagggaccagggatacaaactccaaatccagcctttatatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 505097 - DNA, 1885 bp, Homo sapiens
  misc_feature (16)..(16): n is a, c, g, or t
agccggcatgggagtnggaatggccacaagtggccaacggaaagcaggtggcaggacaggaggctgtggtggggcctgaccgagcagcctttccttccaaatctgactgtggcttgctcaggcccctatggtggctgtgaccctgttttgtccatctcctttcaccaggacccgccgggtgagggtgactggagcacattcctgggcttgggggtgggaagggagtctgatttgcctggggttgatgtgggggggtttgggcatgggccgtgactcacagagtagatccagatccgcctgctcccctcatatcctgttattcagaaggctgtatccgcttagaaagtgtcttttgtcctggggtgagagggtgacgcatgtgccctctggcagtctgctgctgtgtccagagtccgactccagctgggctgtaactgggcttggcccccgccttaggccccgccagcaggcgaagcagggagatgtcagactgctacacggagctggagaaggcagtcattgtcctggtggagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 505098 - DNA, 1714 bp, Homo sapiens
gccaaccccaggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcgcattgctgaccctgcttcctccccaggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 505099 - DNA, 1658 bp, Homo sapiens
gccaaccccaggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 505100 - DNA, 838 bp, Homo sapiens
gccaaccccaggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctgctgctgctgctgctgttgctgctaccactgccaccaagagcagggagacctcaagcaccaagctgacctttagaggtcaggacgtcgacc

SEQ ID NO: 505101 - DNA, 661 bp, Homo sapiens
gctcattaaaaccttcccactccagcctttatatcatcattatttcaagcaacaggaggaggctcagtgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 505102 - DNA, 778 bp, Homo sapiens
gggtggtttgcttaggcgcagacggggaagcggagccaactatgccagatggtccggagctgggttttgtcgcaacaagcttatgtgaccccgcggagacccttacgtagaagatctcgtctcgaccgaagagtctgaagctagatcggcgagtatggggctccgcgaacaatacgttgaggtctgcgcaggtgtcataatttaccctggcctaagtatcctggtaatggtcgcccgggaactgctgacgcttgatgagaatggacccacggcgtctgttcgaaggcaacgccctacctgcggcggctggtccgcattggcggtgctggatgagggcaagatgacagctggattacatcctgggcctgaagatagaggatttcttagagagacgcctgcaatgacccaggtcttcaacgctgggcttggccaacgtccatccaccacgctcgcgtgctgagtcctgccaagctgccagtatcgagggtccgcagagcaggtggtgaacgatcccgtccttcattgtccgcggctggattcccgagaagcacatcgacttctcgtctgcgctctccctacgggggtggccgcccgggccgcgtggagaggaagaatgccaatgaacgggccatggctggggctgggggctgtgggacgactgaggaggaggattcacagtccagctgtcgctccctggggctgcctggattggtactccgtaattccttgccaatagtaaacaggagtcaggcgcttttacaaaagcacagacaacgaa

SEQ ID NO: 505103 - DNA, 841 bp, Homo sapiens
  misc_feature (50)..(50): n is a, c, g, or t
  misc_feature (63)..(64): n is a, c, g, or t
  misc_feature (69)..(69): n is a, c, g, or t
  misc_feature (104)..(104): n is a, c, g, or t
  misc_feature (201)..(201): n is a, c, g, or t
  misc_feature (206)..(206): n is a, c, g, or t
  misc_feature (218)..(218): n is a, c, g, or t
  misc_feature (222)..(222): n is a, c, g, or t
  misc_feature (229)..(229): n is a, c, g, or t
  misc_feature (231)..(231): n is a, c, g, or t
  misc_feature (238)..(239): n is a, c, g, or t
  misc_feature (247)..(249): n is a, c, g, or t
  misc_feature (255)..(256): n is a, c, g, or t
  misc_feature (258)..(258): n is a, c, g, or t
  misc_feature (264)..(264): n is a, c, g, or t
  misc_feature (296)..(296): n is a, c, g, or t
  misc_feature (317)..(318): n is a, c, g, or t
  misc_feature (323)..(323): n is a, c, g, or t
  misc_feature (328)..(328): n is a, c, g, or t
  misc_feature (333)..(333): n is a, c, g, or t
  misc_feature (347)..(348): n is a, c, g, or t
  misc_feature (354)..(354): n is a, c, g, or t
  misc_feature (362)..(362): n is a, c, g, or t
  misc_feature (387)..(387): n is a, c, g, or t
  misc_feature (509)..(509): n is a, c, g, or t
  misc_feature (516)..(516): n is a, c, g, or t
  misc_feature (542)..(542): n is a, c, g, or t
  misc_feature (662)..(663): n is a, c, g, or t
  misc_feature (720)..(720): n is a, c, g, or t
  misc_feature (732)..(732): n is a, c, g, or t
  misc_feature (772)..(774): n is a, c, g, or t
  misc_feature (826)..(826): n is a, c, g, or t
tggacacctcactctcctcgggccctggacaagggaaatgtggtcatccngctttcctcgggnntcagntggtgggacgttatgtggctggccaaactggggcngttgtgtctagaaaagagaaaacagggagggtgtgccagctctggggactgggccaggtgccggggtggtgggtcagggcgagggaagtcacccggnggagngcgtgggtcaangggngcaaggngngcagggnngggctccnnnaccacnncnagcacngcagtgtggcaccgggaccagatgcaagtggntgttgcctgcgcgtggggccnntaccnggttntttcnctcagtggttcttnntagatnttggtttnctgttttttttagtagggctgggantggggtgtaatgcaagacagaatataaaatcaggcaaaacaaacactagtcaccatggaagtgaatgactctcaaagtctcccaaataacaaggtgtagggcatctcacaccactgcatcanttctggnagactacccacagggtgggggctgcnatgggggccaactcgggaactatagagaagagaggagacacacaccacaagacctcctttcattaggcaggaaagctcttgtgggacagtggtgtgcaaatcctaggacctcaatggtgnngaactccaggaaaacaaaatgacaagtctttctcaggacccctcatagatgacaagnattctgctcccngggtcgagatctctttagaggggcttcaccagctcagtgnnnaatatcagacaacaagactctcacattccaaagggggtatctagggcttttnctctcctgtgatgat

SEQ ID NO: 505104 - DNA, 1038 bp, Homo sapiens
ctgctgacctgatgcagcattaagcagctaccacaatgcctgcacagcagaagctgctgtgccttgaaggacacggtcaacctgcctacgtatcagctccatccaggccaccactgctgtgctgtggctctggccaccccacgtcatgctgcagctgccgcagagatcatggctgtcctctttttccacaccatgcgctacaagtcccatggaccccctggaatcctgcacaatgacctgcttatgtgctctcacaaggtgccatgcatgatcccataccgtctacgcggtcttggtgctgaatgctggtttcctggcctgaggctggatgctgcttgaacctgagtgaagatcagctccgacttgtgactgggcacccgtgtcccgaaacaaagctcttcacctgacgtgtgccacttgtgctaccctggagccatgggcctcagagtggcctgcttgtagggatcggcctacaccctggcaaatacttcagaccaaggccacgctaccagagtctatatgcttgctggagagacggggagctgtccagacgggctctgtcctgcggaggccatggccttcgccagcatctatacgctggacaaccttgtggccattctagacatcaatcgcctgtggccagagtgaaccggccccactgcagcaccagatggacatctaccagaagcggtgcgaggccttcggctcggcctgccatcatcgtggatggacacagcgtgacagaagctgctgcaaggcctacaggccgggccaagcaccccccaacagccatccatcgccacgcacccaaggcccgagggatccacagggctacccacaccgagcccaggcagggaacgcacatcaccaacaacctgcgcgagcaagaaccaccacgcagaccacgagcccacccccaacaacacaccgcaaaccgtggacgccgccccagcagaacacccccagggcacgtcccaccacggagccaacacgccaaaaaagggggacacagagcaccaaagacaagccgaacgacac

SEQ ID NO: 505105 - DNA, 795 bp, Homo sapiens
ggctctgccgggggccgcgggcttcttccgtgggggccgaggacggtggccgtgccgttctctagaggagcgaggggaccgacgctatggggggaaccggttcgaagctccaggacgtgggggctacggaggctccagagactactatagcagccggagtcagagtggtggctaccgtgaccggagctcgggcgggtcctacaggagacagttatgacggtctacggataatggtcacacctccgagggtcgccaggcatgctgtgtgcctgtcggtgggagctcggttcaccttggtgccctctccaatgcactttagtgctggtacctactcaggacgcttgtcacgtgtgcttgcccagaagaggcgcatctgtcctctcagagccatttctatcgcaggacgcaaagagccaaatgagactgaccaatagagaggcagatgggagaggcgagggcccgtgtgggcagtcagggtaggtgcagtgtgtgggcgcaggccagcctccctcggctgtggggggtggttgcgtccccggccgaggccggccctggtctggcctctggggtgaagcgtgcctcttgttgctgtcggtgccgtttacgagctgtgccgtgcgttcttgtcctacagctacacacaagcgagtaagaacccttcctgctcaacgatcgtccttccaatggtgtgtgtgcaggattgtgggagcgttcgctgaacgttcagtgtgtggtagtgcccctccttgtattccgcccttggcgtagtctgttcggttctgatctggtaagcca

SEQ ID NO: 505106 - DNA, 381 bp, Homo sapiens
aattaagcccccggtcttttatccaaaggaaaggctttttcccttggccaattttttgggggccggagtccaagttaaattccttagggttttaccaccattttggatggaattggaaatttggaccattttttgtccaaatttattcttttattttcttggaacttgttaaccattgggaagttgtttgaaccttttcctggaggtgtttttttattggcttgaaaattccctttggaaaaatttttgtcccttccatttttcccaaattccaaattttcgccttggttttgaaagccattaaatttgtacctttttgtccaggttgaaattattcccttaattttccccttttttccccaaattaaattgttaaggtta

SEQ ID NO: 505107 - DNA, 148 bp, Homo sapiens
tggagtgggccgacgtattacaatgtacgtgacagggatattgtgttatgaaggtagacaacctggatgtacttatgctctgccagcccaccaggtactctggtaagcttgttgttgtccaagtgctattgaaacttctaaaactagg

SEQ ID NO: 505108 - DNA, 124 bp, Homo sapiens
ggaagatggcggcggccgttccacagcgggcgtgggaccgtgggagcagctgcgcagtgagcagctgcccaaggagggacattatcaaggtttctccaggacacggttcaaattcgtttcttgc

SEQ ID NO: 505109 - DNA, 874 bp, Homo sapiens
agatcatgttggagaccttcaacaccccagccatgtacgttgctatccaggctgtgctatcccctgtacgcctctggacgtaccactggcatcgtgatggactccggtgacggggtcacccacactgtgcccatctacgaggggtatgccctcccccatgccatcctgcgtctggacctggttggccggaccttgattgattacctcatgaagatcctcaccgagcgcggttacaggtttcaccaccaggccgagcggggaaaatcgttgcgtgacattaaggaagaaagcttgtgcaaacgtcgcccgtgacttcgagcacgagatggccacgggtgctttccagttcctccctggaagaagagctacggagacttgccttgacggccaggtcactcaaccattgcaattgaggcggttccggcttgccctgaggacacttttttccagccttcccttccgtgggcatgggagtctttgtggcatccacgaaaattaccttcaaaattccatcatgaaggtgttgacggtgcacataccgcaaaagaccttgtagcgccaaacaacaggtgccgtcgggggcaccaccatgtacccttggaatttgccgacgagtttgcacgaagggagatcacattggccctggacccaagcaacaatggaggatcaaggatcattggtcccttctggagcgcaagtacttccgggtggatcggcgggctccatcctggcctccgtgccactttccacaatgtggttccgcagcaggattttgagagtcggcctcaatgtcacacggaatggttcaggcggatatacatagttgcgtaacctttttggaaactatgggcaaacacaatgaggcagcaactgc

SEQ ID NO: 505110 - DNA, 1021 bp, Homo sapiens
gtatctttgtgtggtgttctcttgcctcgtggcaccctttgtactttccacgagcgcgctttggtctcttggggccgcttcgatttccgtcccagttgtgaccctgagcccaggcggttttcgcaacgtgggtctccgcaaccctcgcttgggcgcggatgggcgccgtggccttgtggccccaccgtttttgagcgcgtgcgttgcccgggaatccggtgtcttccagccccttacgttccaccttgagccaccccatggacacctcgaatttcgaccccgttggtggagaagcccttggaacgaatgccactcgaaggtagcaccaagggcctgggacacaactcacctcgccccattaccagcatcctgagcacgcattttcgaattcaccttccgaaggttctttgaagcaccatggctaccccgttcgatgccccaagccttcaggacccagaagcttcaccggctgagagctccagatttagaaagctctgatctggtggatccagactgaaggctgcccagcctgtgtacctgtagaatgggggcccaggcaccccccacccactcgctgcctccccaggtcagggtcccggagcccggtgccctcaccaggcccaatagggaacccgagggctgttttgttttaaattagtcccgtcgattacttccaccttgaaattcttgctctttccacccaagaaaaccccccaccaggcaccacttttgagaacaccaggactccagccatcgcgtttccaataggcttttccaggaccttccactcgccattaaacaccaataatttgttgaaaatttagtcactagtttagaaagagcacttattttgtttatatcccattttttctttactaaattatagggattaactttgcaccaaatcatgctgctgttattttctcacctttgtattttatcccatagccacttattccacctttaggaaaagacataaaaactgaagaaccttgatgagaaatctctgtgccataatgta

SEQ ID NO: 505111 - DNA, 959 bp, Homo sapiens
  misc_feature (367)..(367): n is a, c, g, or t
ttttaccgttcgatcttgctgacgccacccgggtcgcccattggtgtcttctataatgatcgccgcgcatagcccctctgtgctccctcctcgttgatatctcgtctgtcaccgttggcggggtttcccccccccgcgggagaatgttcttggggtttgccccatcagcgccttgtttagcgccgtgtgccctttggggcccccaccaaggtgggaagccccccctgttgaagtcgccgtctcctgttccccgtattgcacggctgctgagttacacattctgtcgagccgccccgcttctttttgttaacaactccggtggtgcgccatcctctcctaatgggcccaggaatgatccccctttggngtcgcccttaatgacccgtgccaaacgggtgtcgcgccatgcggtgttctcatccgccattttgctgttagctgtggcgccccagttctccgcaggatgctctttgcggcgccaccgcaactgtttatcgtccgtcgtctaggcgggcgcctcccgccttcggggccacggtgcgcgcccggtggtttcctcccctgttggccatgcgccgccgccgagaatctgttgtgtgtgagtgcgtgtccccacagagtctcgactctcactatacggtcgaccccgccacacatgcttctctctcaaagcggtgcattgtgaaaatcattctcctgctgggccgcctccactgtgcgtgaatagatgaagaccaggatgtcccaagcctccgaccccaaggtgtcaaaaatgagtatcgttaccccccgctgccgtagttgttctttatagccgtagtgccgcccccgtgttttggcccaggataaacaagattctgccccccccaatttgtgcatagatcgctgcgagacgcccccgaaatttgcaactttttttagaaacaaaccacccatgaaataaaaaaaaaacataacaa

SEQ ID NO: 505112 - DNA, 248 bp, Homo sapiens
agggcgcacagttctcttttgtcttattttatttttattgttttagagacaggttctcaccgagactgaagtcatgactcactacagccttaacttcctggactcaatcaattctcccaccttagcctcccaagtagctagactagaggggcgcaccaccacacatggctacaattttattttttatctttgtagaggcaggggtctcgccatgttgcccagactggtcttcaattcctggcctcaag

SEQ ID NO: 505113 - DNA, 205 bp, Homo sapiens
ttctctcatctactaccatgtgaactattccaaagataaacagaaaaaaagtacagacttacagtagctgcctagcatcttgccacggtctggcacaacggcagtgccatcattcctccctggtattattcaagtacccaatgcattcctcacttgtcaaggaaagtagactcaactggagccacagcagcttgtagcctggtgg

SEQ ID NO: 505114 - DNA, 80 bp, Homo sapiens
ggcgcctcgggcaggacctccccttcctccgtcgcgggtttgcagggtcagaggaccacgccgagggtccccgcggcccc

SEQ ID NO: 505115 - DNA, 166 bp, Homo sapiens
tgtacagacggggttttgctgtgttgccagggctggtgttgaactcttgggctcaagctattcgcccaccttggcttcccacagtgctgggattacgggtgtgaaccactgcgcgtggccattattaaaataattttttcttcctgatactaaggatcactgttta

SEQ ID NO: 505116 - DNA, 304 bp, Homo sapiens
cgaatttgtgccaataagtacatggtaaaagttgtggcaagatggcttccatatccgggtgcggctccaccccttcacgtcatccgcatcaccagatgttgtcctgtgctgggctgacaggatccaaacaggcatgcggggtgcctttggaagcccagggcactgtggccagggttcacattggccaggttatcatgtccatccgcaccaggtccagacaggggcatgttattgggcctcggaggccaagtcaagtttctggcgccaaaggtccaatttaaaggagggggttcacatcatttgt

SEQ ID NO: 505117 - DNA, 836 bp, Homo sapiens
accctccatgagagttgtggacacttgggtcacctgacccgttgcctctctgacacatgtctccggaggggcagaccatcgtgggccaatgtgcatttgtgcacgtgctggaaccttccatggtgggtctgggctattggctggagccaggaccatgagtcaggagtcgaccatggatctctactagtgccacgggagactggaatgtgggtgtcgactcttccgtgactgctctaagggcgtgcgaggaggctgctttggcattatccaccccgtgtgacagaataggagcctagtcgagctcaggactgctcaacgggtcaggagggcaacgcctgaagtcagacctccctataaggtcaacgagggacagaggctgagggatctctggagtcatgggccctcgtcatctacagggctttggtccatcgtcccacctagactaccttgtgatccaccgtgagccaagcaaatgctgggatcgaaggggcccccgtcgatcagcatgcatttaataagtgtctgagaacgtgtgtgctgaatcatgaatgactgacagaatatagttgggcaggcctgattgaccactaagactggtttgagagtactgagtgatgtcgcagggcccgaatgttaagtagcacaggccaattgcaggtaacatgggaatcacctgtggtacccacatataaagggagtgtggatttagacttacagttaagaacgggtgaagggtaaaccgcaaaggtatggtgagagtgccatcatgtgggaggttacgggggaataggggggactttccagacaggagtttacgggagtgtgtagataaatta

SEQ ID NO: 505118 - DNA, 477 bp, Homo sapiens
tggagagaagggaaaggtgggttggggatacgtgaagtagcatagggcatctcagtggtgtttcaggctgccaggccagtcaatgagtcactctttgcccatgagtgatgttctgagcatcagaataacaaggataggatactggcataccatcattagtgtgattccctccttcctgccttttctttctctcattttgatatgattgactcagactttttaattaaactttttattttctttttaccatgcgtactagccttatacatgtgacgtagggctccctctttccctctctccctccctccttctctccctctctctttctctccctgtgaacatggaactctgctaatgattcaagcagtgatcatgattctgtcttctgatcttgttttatatatacagcaaaagtaaattgagaccgtttggaaataaacacattagtacatagcccagcaccgtgcttatctcaat

SEQ ID NO: 505119 - DNA, 273 bp, Homo sapiens
  misc_feature (146)..(146): n is a, c, g, or t
tgtgcgtaactcgatcatcaacatgctcctagcacagtgttgatgtggagacagcgcgtcttcatcatctgtgtgctgacggagtcatggtctctgatatgtctgtgctggagtggctgcaattatctgatgtttcgaggtagccnttgcaagtaagttgcgtctgccatcgtccccgctcgtctgctgatgtgcaagactgctgtcatccagtaatccgaaggctctgcactggggagggtgcaggagaccactgatcccttctccacctca

SEQ ID NO: 505120 - DNA, 202 bp, Homo sapiens
cattcacagtaactctgagctaacatcccacttcaagaattgaacgagagttgccagcatatgtctacacaaaaacgtgtacataaatgcccataggagcattattcataatagccaaaaagtggaaacaacctaaatgcccatcgatggacaaatggataaacaaaatgtggtatatgcatatgatggcatattattcagc

SEQ ID NO: 505121 - DNA, 956 bp, Homo sapiens
gctggagcggggctcctgtagacctgaggggtccctctctctagggtctcctgtagggtcttatgactgtgaatcctatggatagtacatgatgtcttatgtgacgattcctaggagtccctggcccctagagtagagagcgaggggctggtagccccaagcacccatcgctctcttccgatggagagaagagtgatctggcgttctcactacggacctctgtgaatattgattctatttatggttcccggggaagtggtctccggtgaaggaagcccctccctgggtcacttttctgacctatgctggaagtagacgtaccgcatcttctgggtcctggactcagggggctgggattttgatatatttgtctatgtaaacggactttgtctcgcgaatagaaatataagagaagaagagaaagccaagaaaagacaaagaactacgatgcgatctcttatcgagcgaggaggagcgcaaaacaggggaaggctagcaaagcgcgtgaaccgggagcacatcctcgagatctcgagtgcctaagccctgttggtgcgcaagcacccgcgtggagagcactctgtggcgtgggacgcgctagaggaggcgcgccagggtcttggaattgaacgtccacgtgcacgtgcgtatagctcctgactattcccgcagggtgcaagaacctggttacagccccagaccccagcactaccccaagccggctccagggtaaggcagaccaggcagccacgggcagcacaacagaaccacgaaagaactgtggtcaatggggtccatgggccccctccgggacaactaacagggttgccaaaagggaacaacgccagggctcctggtaagggccacccagtgaagacccccaagggtcaggcgggatgtaccccaaggacacgacggacacgtaaatcttggaaacccatggggggagggagccc

SEQ ID NO: 505122 - DNA, 319 bp, Homo sapiens
aaggcaagatcatgccattgcaccccagcctgggtaactaagaaaataaaagagaagaaaaaagaaaagaaaagaaattagcttattaggtgtgctggcgtgtgtctgtagtcccagcaattcaggaggctgaagtgggaggatcacttgtgctcaggagtttgaggttacagtgagctaagatggtccactgcactccaccctgggcaacagagtgagttcttgtctcaataaataaaaataaataaataaataaataaaggaactactgataagcagcatatgtgcaggtccaaaactgaacaaaacttactaaaaa

SEQ ID NO: 505123 - DNA, 360 bp, Homo sapiens
tttacttctcggggaccaacggccttgcggggtccaagtaactcgctcgcagtccaaaactctgcaacgctccacataaccgtcctgtagacccacaactctcccaggagcacagccccaggacctaacccaccgggttctgctcgctcacccaattcccagtgcgagcgcgcgggggaaacgtgctcgcctcccgcacctggcttccgcggccccgggagtcgccaactctcccagcaggcagctccgacaacccggacagccgggccgatcccccgccccaccacccgctcggctctcgcgtcctcctcttcctcctcccgtggccccttgcctcccgccgtctgcctctgcggccgc

SEQ ID NO: 505124 - DNA, 305 bp, Homo sapiens
cccgtgacacttgagactttctacaatactacagtggagtgagatgcccatgaactgtggctgaccttatttaattcctgggatgagagtttggatgccgtgctcgctgttgctgaatagagcgatcactacgtgcattagtgcttcttatctgttgggaatatttgaatcttgtcgtcaatgctcataacggatcagaaatacagatttcgatagcaaagcgacgttagtcgtgagctctggtgaggcacgtcattggctttagtcctctttagagttagactgtgggtgcgggtagctctaaa

SEQ ID NO: 505125 - DNA, 270 bp, Homo sapiens
  misc_feature (251)..(251): n is a, c, g, or t
actctgctccagtcaaggtgtcccgtgtggttggagtgagttggaaagagttgaggaggttgaggtcacatagggccttttggcttgcagtccacaggaaggttttttttgttttgttttgttttgtttttgagatgcggagtcttgctatgtcacccaggctgtagtgcagtggctcaatcttggctcactgcaacctccacctcccaggttcaagcaattctccctgcctcagcctcccgagtacctgngcttaccagtgcccgtcac

SEQ ID NO: 505126 - DNA, 816 bp, Homo sapiens
  misc_feature (560)..(560): n is a, c, g, or t
gctcttcgacacaggggatgactacattgcaactggagctgatgaggaacgaattaggatctcaagattgaagaagctatatagttacagaactaaggcaatacagacatgaaatacataaaatacgagtacgacagtaggatatcagaagtcttaaagatgcaaacaaatccaaatttataggaagaaactgtcctctgtgggaactatttcctcctgacttatttgcgtagaatgacagcagaggaaatggctagtgatgagctcgaaagagatgcgtgaacaacttgatcaaagaagccatcacgagagcatcacgatggccacagactggctgggacccagactgacttgtaccacttgtggcaacaggttcaaagcgcaagacatggcactttacacgacaggtacaaacccgtagtagctgatgacccaagtgaaaacatttgtaggcctcgtcatgcactgtggacactcgatggacaggtcctgctagcgtttggacagcactggccaacaatatcctgggagccatccacgaaacacgggattgtggtatnctagcttgtacactagcgcaaggcaacctagtgtgtcctgccagatccccttgtaacagcgcactgggtgaacaactggccgttggaccctacgcctgccctttcccttaaattgcccttctggagattcgcaaactagcaaagggagacacaatataattaccttgctatgtaccggtctcaacgacagtatgtccgcgtcaatccgctactgtcctccagtgaccctctggcaacgacctcgacataacgggaa

SEQ ID NO: 505127 - DNA, 170 bp, Homo sapiens
agaggatcccagctcatcatgcttgagctttgttggtcctggtagttagataacggtcaagggcttgttttcatgaagggagagattggaacactcgcaggtgtacgaagctcctcgctcgccgacgtgcaccttgatgaagtatctttgtccccgcagaccacctggcc

SEQ ID NO: 505128 - DNA, 590 bp, Homo sapiens
  misc_feature (32)..(33): n is a, c, g, or t
  misc_feature (51)..(51): n is a, c, g, or t
  misc_feature (95)..(96): n is a, c, g, or t
  misc_feature (168)..(168): n is a, c, g, or t
  misc_feature (235)..(235): n is a, c, g, or t
  misc_feature (251)..(251): n is a, c, g, or t
  misc_feature (256)..(256): n is a, c, g, or t
  misc_feature (262)..(262): n is a, c, g, or t
  misc_feature (270)..(270): n is a, c, g, or t
  misc_feature (283)..(284): n is a, c, g, or t
  misc_feature (291)..(291): n is a, c, g, or t
  misc_feature (304)..(304): n is a, c, g, or t
  misc_feature (314)..(314): n is a, c, g, or t
  misc_feature (316)..(316): n is a, c, g, or t
  misc_feature (318)..(318): n is a, c, g, or t
  misc_feature (325)..(325): n is a, c, g, or t
  misc_feature (327)..(327): n is a, c, g, or t
  misc_feature (330)..(330): n is a, c, g, or t
  misc_feature (336)..(337): n is a, c, g, or t
  misc_feature (347)..(347): n is a, c, g, or t
  misc_feature (362)..(362): n is a, c, g, or t
  misc_feature (375)..(375): n is a, c, g, or t
  misc_feature (377)..(377): n is a, c, g, or t
  misc_feature (398)..(398): n is a, c, g, or t
  misc_feature (426)..(426): n is a, c, g, or t
  misc_feature (445)..(445): n is a, c, g, or t
  misc_feature (456)..(456): n is a, c, g, or t
  misc_feature (459)..(459): n is a, c, g, or t
  misc_feature (486)..(486): n is a, c, g, or t
  misc_feature (494)..(494): n is a, c, g, or t
  misc_feature (497)..(497): n is a, c, g, or t
  misc_feature (521)..(521): n is a, c, g, or t
  misc_feature (526)..(526): n is a, c, g, or t
  misc_feature (531)..(531): n is a, c, g, or t
  misc_feature (538)..(538): n is a, c, g, or t
  misc_feature (541)..(541): n is a, c, g, or t
  misc_feature (543)..(543): n is a, c, g, or t
  misc_feature (551)..(551): n is a, c, g, or t
  misc_feature (556)..(556): n is a, c, g, or t
  misc_feature (568)..(568): n is a, c, g, or t
  misc_feature (571)..(571): n is a, c, g, or t
  misc_feature (573)..(573): n is a, c, g, or t
ttggaggaactttggatgctatgtgttccagnnggtataactaaagatganagagatttatgcaaaccacactgaactttatatggttaagaaannatctcttattttgccaagccatcaagatttagaaatttgaaaatcaatttggagatttgaggattaatgtgntatcacttcatagaccatcttatcttaactaatataaaggtatgaaacatttaaactaatacctgtnacagaggttattcaanaatgngcttgnttctttgntaataataaaaannagagggntctaataaaagcnaaaacacatngntnaaatagngntgntcaggnntattccttgnataaaataaccaatnaaacaaaagggcnanagaaaaaaaaacaaaggcggntttttaaatattagagactagctattgngaaaaaaaaaacacttttntaaattatccnttnaatggaaaaattaagaccctgcaaagntttatganagntcaattcatgattctaaaaagggnaacanaatcntaaagtntgntnaaacttgnatagnctttggatagancancnggcatgactgggaggag

SEQ ID NO: 505129 - DNA, 718 bp, Homo sapiens
taatttatttattggttggttggttggttggttttgaaacagagtctactccgttgcccaggctggagtgcaatggcactatctgtggctcactgcaaactctgctgccggggttcaggcaattctcgtgcctcagcctcccgagtagctgggatcacaagtgtgtgccaccacactcagctaattttttttttttttggaaacagagtctcgctctgccgcccaggctggtgtgagtgtgcgtgtgtttgtgccgagcttctattccatatggcaaatataaataagggagggcagttctacaaaaaaaaaaaaaaaaaaaaaaaaaaaacaaaaaaaaaaaaaaaaaaaaaaaaaaacaaaaacaacaacaaaaacaaacaaaaaacaacacaaaaaaacaaagacaacacaacaagaggcgggggggcgccagacaacacccccacgcgagggggcccaaaacgtatctagcgcccactcacaactctgtcgtaaagacgacaaggagggtcgccaccacagaagaggggggactacataaaaagaagagggcgaggacgcggccgagctacacaaacaacaaacagtagctgacggcaaacaacatagcgcagagcatgagtattattatgagagccaccacacactgggggggggcgtacgaaacagacggcgaccacacccagcagcagaggaatccgcacgacgaatcata

SEQ ID NO: 505130 - DNA, 567 bp, Homo sapiens
tcacacagttagacgcttatcagaggcacaaagagacaaagataaccctgaaggagctgaaagctccacagcggagattggagtatctgtccttaggacccactttaaggccgtacactcccacaggagctgggctttacggaagagtggccaaaaaaaagtcattgaaaaaaaataagcaaaacacgtttggtgtttgccaaaaggcatgtgggagattccccaaacatattttagaaggtactctggttagatgagactaaaattgagctttttagccatcaaggacaatgctatgtctggcgcaaacccaaaaactctcatcgccctgagaaaaccacccccacagtgaagcatggtggtggcagccatcatgctgtggctatggactaggaaactggtcagaactgaaggaatgatagatgcccgctcaatacaggcaacttcttgagggaaacttgtatcagacttaaagagatttgagactgggacagaggttcaccttcccgcacgaccctgaccctaagcatactgctaaagcaacacttgagtggtgtaagacgacac

SEQ ID NO: 505131 - DNA, 306 bp, Homo sapiens
atctagagtatcccccccttacccccacagtgagatatccccaaaaaaaaaaaaattaaaagacatctaccatggtattgggggccaggtgaggcacaaggttcttgtttaggggctttctctaatgacatatcaccacctgtcactgtagtggcttaaagaagtgaggtctgtacttctgcctcttgaatataagtgactctgtgactgctttgcccagtagaatgtggtgaaagttttgctgcgctatgttctggacccaagtttaaagaaacttccatttttcactttctgaatcttagaacg

SEQ ID NO: 505132 - DNA, 311 bp, Homo sapiens
gctgtcaggagagatgggatccgagtgtttatggtccagaggagtgatgctagcggcttccacaagaatcctgttaggtcagttcagccagaaccccctgcaccctgatgtttcctcttagttaaattttccgtgcatggcccccactcctgctcctaggtctcccccactacacaatcccattgcagcagtccctatacctatcatgatcatcctgagcagcctgcccttggtcttgcttctctgagacaaggtctggctctgtcacctaggctggagtacggtggtgcaatcatgcagcctcgaacccc

SEQ ID NO: 505133 - DNA, 353 bp, Homo sapiens
caggtctccattttgtgtaaaaaaggttttagccaggcccgtggctcacgctgtaatcaacacttgagaggctgaggcggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactca

SEQ ID NO: 505134 - DNA, 834 bp, Homo sapiens
  misc_feature (831)..(831): n is a, c, g, or t
cagtgagctgaatcctcccccaagctgttccacggccagcaggcactctgcagctaccttctcctacagtctaggtaacaacagaatggtgagtaaccatgcactggttcaagggttctgggagttctccatgaaagcttgcgcgttaaattttcgctcagacgtatccaggagtttagctcacgtagcgctgcgaggttgaaatggtgatggatgaataacaacagccaggtcttcctgtgagccgacatggagcttgaacgtagcggcactctgtggctggccttggcatgggctcagccctaggaagaggagaaacgatcccttgtcctgcccctcccttgtggcagggctacgctgcctggccctcctggctcgctagcgcagttccagccccctgtgtcagcaggttctcctcattgggcttgggtcttcaatcctgtggcgacaggaggcagggcagactgtggcaggacaggatgcacggtcagggagacgggaatgcgctagggcgtaggaccgcctatgagcatgaatagagaccctgaagcaagttgactgcttgccattgtgctacgttgtttgtgttctgcagactgagccatcgatgtctccgattgtgcacttttgattttgtcttcgataacgttttactgtgacaggaaataaggctggccatcctcggtggggaaccagtggtaatggactgctcactgtccgcccgtttttcaagggaatgcgtcgaaaaggtagttaggtaggagacaacaaaaacctcaccaaacactgggcccctccttctctcctccccctctcctaccaagagggggngta

SEQ ID NO: 505135 - DNA, 803 bp, Homo sapiens
ggcggctctgctgtcggaaagccgctcagtctctcttccccttccctttcccggctcacgtcttcctctctctttcctttctttcctgcctatcttttttctgctgcctgctccgggtcctgggccattttcctggtgcctggtgcgcactaagtgtgctgctgtgcccctgtgtggcccatgtagtatgaccctgcctgtccatgctatccttctgcgttccccctgccccattgtggcttgcggtggcctgctgtgctggctgcttgcccactatgtgccctggacaatgtagttatgcagtgaagctggaaaggctgccctgcctctgcctgggagcttgggagctgacgctcagtggcccgcagtttggcttgggatcactcgccttcacaaaatggaacaatgacttcctcctgtgaagcagatccttagtatactacttgaagaaccgggaacgtcatggctacagaattgaaaccatgctactctcgagtgttgcacttggttcatgcacgcacagcaaacttcccagtctcctgaaggagcagagagtttcacctttgggcacccttaataaaagtgtttcgcatctcagtggttgactcataggcaagtggtgtgtggcaaaaaattgcaacacggctattttgtcgtagattgtccagacaaaagccagatcaaccaaaaatccccattcttgaaagaccgggaacctggaggttggacccaagcatgcttgtggtatccatgccatacagaactgactccttctagaacactgctagccactgaagacagac

SEQ ID NO: 505136 - DNA, 330 bp, Homo sapiens
  misc_feature (21)..(21): n is a, c, g, or t
tcagtgacgcagctcccctgnaagtcatggcctgtcctccaagaccctgctccacggccttcgacagtcctcccttcgttctctctttccccgtccttcctctctctctctctctctctctctctctttgtgtgtgtgtgtgtgtgcgtgtgtgtgtgtgtgtgtgtcttgtgcttcctcagatctttctcgcttgtgagcggggtggtgtgttccctccatctctccgaactgctggactgtcatgctgtcccttacactccacaccctgcgtggccttctgtcgtgacgctgcgtgtggagagagagggtactcctactagagtcgac

SEQ ID NO: 505137 - DNA, 132 bp, Homo sapiens
ctgtaggactgatatatagaggatccccccgggagccctccgtgagtacttaaccctccttgagcccttaaccgttgtgtcgatgagtgagaggaggagtctgcctcaaggagagggttatagcttctgcga

SEQ ID NO: 505138 - DNA, 266 bp, Homo sapiens
cccccgcccccgccccggccaaacccaaattaattggaattaaacccccttaccccggaagtccttttaattttttttttccccaaaaaacccgggccggggggttgggggtttgttaggaataatccttttaaggggccccacgggaggggggggaacagcctcccagaaaccttttttttttgtataaataataatactaacaaacagttggggaactagggagaaaaccagaccattaaaactgtttgtggtcgaatctcaaa

SEQ ID NO: 505139 - DNA, 171 bp, Homo sapiens
gatctagaggatctttatatataactaccagatagatgtcatttgttcttggccacaaagctaaagtatttattctctagactgttaagaaaaaattgcgaccctggttaactgatgcttgtgatgtggggatgactttgagaaccacgtaagccattttgctaagctaag

SEQ ID NO: 505140 - DNA, 614 bp, Homo sapiens
  misc_feature (72)..(72): n is a, c, g, or t
  misc_feature (191)..(191): n is a, c, g, or t
  misc_feature (266)..(266): n is a, c, g, or t
  misc_feature (269)..(269): n is a, c, g, or t
  misc_feature (302)..(302): n is a, c, g, or t
  misc_feature (378)..(378): n is a, c, g, or t
  misc_feature (381)..(381): n is a, c, g, or t
  misc_feature (413)..(413): n is a, c, g, or t
gaattcggcttcaccagacgtgaaccgcagctgccaggggttcctccagaacctcctccccctggagcttgntacaagtgccagaaatctggccactgggccaaggaatgcccacagcccgggatttctcctaagctgtgtcccatctgtgcaggaccccactgaaaatcggactgttcaactcacctggnagccacttccagagcccctggaactctggcccaaggctctctgactgactccttcccagatcttctcggtttagnagntgaagactgacactgcccgatcgcctcagaggnctacagggccatcacaggtgctctaggtaactctcaaagtggaaggtaagtccgtccccttgttaaccaatacggnggntacccactccacattaccttattttcaagggnctgtttcccttgcctccatacctattgtgggtattgacggccaggcttctaaacctcttaaaactccccaactctggtgccaacttaggcaataccttttaagcacttctttttagttatccccacctgccctgttcccctatcaggccgagacactttaactaaattatctgcttctttgaccaccggaaagccgaattc

SEQ ID NO: 505141 - DNA, 227 bp, Homo sapiens
tccactccacccttctccaggggacccttagatcacatcactccacccctgacaggccccaggttaggaatagtggtgggaggaaggggaaagggatggatctcaccggtcccagcaactgaaaggacaccactatctggagccacccactgaaaggggtgcagacatggagctgtacccatgctgatttctcatctggtcattaaagctgtcatggccagcaacca

SEQ ID NO: 505142 - DNA, 159 bp, Homo sapiens
caagtccatcccgttatgacaactcttagtcattaagtctggaaacgaaacaccctaagtctagagtaaggtctgttatcagaaaccaacagatgatggcattctaaacgagtcagacgccacagtgcattcccaattaaacgtcagacaactagacca

SEQ ID NO: 505143 - DNA, 131 bp, Homo sapiens
tttttaccacaccacggataaaatcgagatactttggtatcagactcagcacagctgtccatgactgatcacacgggcggacatacgagttggatgtctgttcttgttcttcttgtcctcaaacaaggtca

SEQ ID NO: 505144 - DNA, 168 bp, Homo sapiens
taattggagctttattttcttgggagggagggtctggctggtcatccaggcggtagtgaaggggcttgtcataactcacggtatccacaacctccggggctgaaatgatcctccagcctcggcttcccaagtagctgggactacaggtaagtgccagcacaagggtgg

SEQ ID NO: 505145 - DNA, 524 bp, Homo sapiens
  misc_feature (419)..(419): n is a, c, g, or t
  misc_feature (465)..(465): n is a, c, g, or t
  misc_feature (519)..(519): n is a, c, g, or t
aattcgggccgcgtcgatacggctgcagacgacagaaggggctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaattttttctcctattctgtggttgcctcttcacttttttgattgctccttgctgtatagaagctttaaactaatgtgatcccatttgtccattttgcttgatgcctgtgctagtggggnattactcacgaaatcttgcccagactgatgtcaggagagttcccgntttctgtagtagtttcatagtttgaggtctagattgtcttaatcctttgttgcnttttc

SEQ ID NO: 505146 - DNA, 437 bp, Homo sapiens
taaaaaatgtgtggttcccgttgcccaatgggtttggaggccgggtttgtgggccctttccggccgggttttaaaaaaaaaaaaaagcccccctgggggcccccccccctggtgggggttttacgggggggggtcccccaaaatcccccctcccggttttaaaaagggttgtcccaccaaaaaaaaagcggggaaattttgggcccccctttttttttcccgggccccaaaaaaaaaaaagggttttggggcccaaagaccctttaaagggggtttttaaaaacccccccttgtttggggttttttgggaaaccccccggcccccccttcctttggtccccgttggggccttgggaaaaaagggggcgggggttggtgaaggggattttggttttaaacccaaaagaagaaaaaaattttaaaacccctttttttca

SEQ ID NO: 505147 - DNA, 953 bp, Homo sapiens
ggccggaggatgatgtggggagtatctcttcgaaaggctcactctcaagcacgattaagagccttttgagcccagtgatttctgaaggggcccttgctactgctacactaggggcttctgcctgagagcctctccgctccgagcctagataggcaagcttgtcttgtgaagttatcgcatagatcaaggcccttgggactcaattatggcaagagtagaaagcttttgtgactgcaaaaaatcaaaattcacagacacacacggacccatgaaaaaatttgggcggggggcctgggccccccgaggaaaagggttttttagaaacccccttcttggtgggggcggggcggcgcgccccggtgggttcagggtcaaacattgtgggcacaaaacgccgtgtgctccaaagaagaaccccggggcccagaacatcagcgcgtcgggagtttctctccaccaaattataaaaaaaccgcgccgggcgcggacgaccgggcgcgttcttcgaaacacacaacatccacagaagagtaggtccagagcggccaacagatcgccggggtcgatacaaacaggagcggggtcccagagcaacgctccgaatatatataattcagccccgcgccgcgagggggaaaaagaaaaacagcgcgaagcccttgccagcacagcccagaaaggtgcgacgaaggagcgaagaagcaaaaccacacaaccacaagccacacaagtcaccagaaggcccaacgaaccaacacgcaaagcaaacacaccagcaaaacgccggcgacgacacaccgaaacaacgaaaacacacaacgacaaagaaaacgacagacaatagggccagccaaaaccaaagccacacacgacgccagcaacaggaaaagacgagaacgcaccagaacaacgaaatgaatccagcagaaagaaaaaccgagagcgcagtgaga

SEQ ID NO: 505148 - DNA, 1700 bp, Homo sapiens
  misc_feature (441)..(441): n is a, c, g, or t
  misc_feature (1075)..(1075): n is a, c, g, or t
  misc_feature (1570)..(1570): n is a, c, g, or t
tatggacgacgtcgttgctgccccactggcggggccgccccccaccactgattgggttgtggggggccgccctcattctgcggggggggggtgatgcatgcagacccctccgtttgttggcgcgttgtgaggtcgcgccgtccatgattggatacggttttgtgtgtcctgccgcccagcagtaggggggggcgcccggcccctctgtgtagtggcttccgcgcgcctcaccagacatgtgggtgtgcgcgcgcgtgttgcgccgcgccgtgggtgtgggacggtgtgggtgctgtgtcgcccgcgccgcggactcgctggttggaggccgtgtttgtgttcgatcgcccctatttgcgcctgtctcttttgttctgtcaccctgtgtgtgtgggtgtgccgccccccgctccctttgttgttccctcgctaatgtgtgcntcgccctatgtgtccgcccccccccttggggggtcctacaattcctcggtgtctagaccctcttgatgtggggcgctcttcctcccgtcgatgttgtgtaagttgttctgtttggcgcccacaccgcccctttgtttttggctgccccccttgattgcccccgccgttttgttacacacgtccgacaagtgtcctccttgctctctgtggaggtcatcaccgcgggggttggtagcgccgattttgctcgcagaagtcgtctcctccataagagtttttgagcgccgcccccttgtggtgattcccggggcgcggccaccactattggccggtgacgccgacatgttttggcggccccccggcgcaccccagtagtgtggtgcccatgatagtggtggaagggtcttccaccccccctttttgtgcccctcgtcgctcaatgttgtggtgtgacgtcgtagttttcgcagcgccgtttttggacctctatatatatagaggtggccttctccttgttttgcacacgtttggtccccaccccctgtgtgtctgcacgctcacgctccgtgggcaccccacgcctctgtgggatttttacattctcttgtgcgcgcagtctgcattgtgacgcgcnctgtggggccgccatttatatatagtgtgagtattgtatttgtctctcacccacgtgtgcgcccacagagagacccccacactctgcgatgacccccccctcttttcttggagccctttgccgccagatataggggggtagattctctcgagacattaagttctctctcaaagggttttctcacacacactctcgaggatttacacgcccgctcaagggccacgcattctcgccacctatattcttgtctatatatacccgagaatacacacccacacaccatttatatatatatataattacaccaccaccctcacaccacatacacaaatctttctcttatggacaccacacaaatattgacacgccacttcttctccacctgagacatcttacccccaccatattttgtgccccacagaccccactgtttaaccctcccctggtttttattgagaattctgagacccgcaatatccccccgagttctccgcnatcgagcccacgtccaataccaccctcctatatgtgaaaaacattcctacccctccaccctacccttacttatatgataatgtctcccataccccttcaccatttcccagccttccccctccaaccttta

SEQ ID NO: 505149 - DNA, 407 bp, Homo sapiens
cgcgccagcaggcggccgatacggccaaagccgtacaacaccacatcggtgcctttgcgggcggcagcgttttgctggccaaccacatcggccatttcttcacgcacgaactgctcggcagtgcggccggcgccttctttacggaatttgtaggccaacttgcccaggtctaccgaagccgcgccgagcttgagctcgctcatggctttgagcagtgggaatgtttcgtggacggagagttcgctgtcgtcggcggagcgatggcgcgcaaagcgatgggctttgagaatcgcgatgacagactggttgatcaggctgcggccatagatcgagctcaccacattgttattgcggtacagctgaccgataagcggaatcatcgcttcagcgagtgcttcacggtcgat

SEQ ID NO: 505150 - DNA, 607 bp, Homo sapiens
  misc_feature (23)..(23): n is a, c, g, or t
  misc_feature (76)..(76): n is a, c, g, or t
  misc_feature (103)..(103): n is a, c, g, or t
  misc_feature (111)..(111): n is a, c, g, or t
  misc_feature (119)..(119): n is a, c, g, or t
  misc_feature (128)..(128): n is a, c, g, or t
  misc_feature (130)..(130): n is a, c, g, or t
  misc_feature (135)..(135): n is a, c, g, or t
  misc_feature (141)..(141): n is a, c, g, or t
  misc_feature (153)..(153): n is a, c, g, or t
  misc_feature (183)..(183): n is a, c, g, or t
  misc_feature (196)..(196): n is a, c, g, or t
  misc_feature (203)..(203): n is a, c, g, or t
  misc_feature (233)..(233): n is a, c, g, or t
  misc_feature (279)..(279): n is a, c, g, or t
  misc_feature (510)..(510): n is a, c, g, or t
  misc_feature (601)..(601): n is a, c, g, or t
cttccaactcaaagcaagtcacnccccacggcgttctggccaaagacatcagctaagaaagggaactgggtcctanggcttggggtttccaaccctgacaganccgcaagngaaaacanctggttctngncagcntctagngaaatcccagancactcagccctgacaggttaataccctgcncagatcagggggngcggggnacgacagactcaccaagccacagacttgtnttccacaagcacgttcttaccttagccacgaaggaccaagccacangtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggggtgtgcatttgccaggggcaaatttctattctcaattaacccatgcngcaaatgctacgcatctgctgagtccgtttagaagcatttgcggtggacgatggaggggcccgactcgtcgtactcctgcttgctaatccncatctg

SEQ ID NO: 505151 - DNA, 1382 bp, Homo sapiens
  misc_feature (1242)..(1242): n is a, c, g, or t
taaaaccccggttctggggtgggtgtgggtataatactaagtggaaatgatatcaatttacgggggaaaggcgcttgggtgaagttaggccttattctctctggtgtcctcttcgtacgagggagaggaattgtgaagtagcatagaaaaccgaccgtggattacctccggtcgtgaacctcgaaatccacgtagcgaactttaattcgttgtgaaccacaagcgaaacctttataatataggcgggctgtgccaccaattgcgggaaatttctccgtgatctccaaacaattcggaggtctcgtataaaacccccatattgtggtgtgcacttgtgggcacctctatagaaaatatgaggattgtggcccgtgttatctccccatagagtgtataaaccttgtgttttcccccgtatgagggtgactacaaaggtctatagatgtgcgaaactaccaactctgtgagacgtatatatgagtatgaagttctgcggcgccttgtgcgactgtggggtgtgacagaaggtctcttttatgaagggcgatgtggtgctaacgcggtgtgctctgcgggaaaaggggtccatgatggggagtatctcggtgggacgtacccacgaggagtagttgtttcgcggcggccccaccgaaagactcgcagagaaaattctccttattataacaaggtctgccgcgagaaggtgttatatgggggcggtgacgcggttgttataagaggagaaccccctatgtggggggcagatgtctatcaggggtgaataacgaggaggataacccctggggtgttgtggcggcgatcattctcgacacgtctagacaggatttgataaagaggaaggggtcttcccacaacataagagggggtggtacatattatccaatgacgaggtatactattgatgaagcgatggtgtgctgcttactaagtgaggccccacctgcactaatactattttacacaacagtgtgggcgaccaagttgtgggtgacacaaagttatttctcaccacactcttggtgggtgtttctacaacagcacagttgttacaatctagagatcgcaacgacacggtgtcgtgtgtggagaagacaccccgcttctttgctagtctatggtagtaaaccgacccgcatagattctaccaatcaatacgacaggagggggccatccccccctgataatgtttgtagtaaagaggggcgggaatcaacacccaanagacgtaggtaggcaatatcaactattagtcggctactataacccgctattttgggtggcacaccaccgaggattaatacgagacggagatatcaacccccggggtcgggcgacccgcgggatataaacacacaacagtg

SEQ ID NO: 505152 - DNA, 549 bp, Homo sapiens
atggcgttctagaggatctcggagatggagtctcgctttgtcgcccaggctggagtgcagggcattatctctgctcaatgcaagttctccttcccgggttcacgccattgtcctgcctcagcctcctgagtagctgggactaaaggtgcccaccactacgcccggctaatttttttgtatttttagtagagatggggtttcacggtgttggccaggctggtctcgaactcctgacctcgtgatccgcccgcctcggcctcccaaagttctgggattacaggcgtgagccaccacgcccagcttatggtttaaattaattaactgaaaccagaagcagcttgggtttcaagataagggcccagttttctggatctttttttttttttttttggggaaccggagtctggctatgtcgcccagattaaagtgcaggggcgcgatctgggttcactaaaagctccaccttcgggggttcaggccattctcgggggttaacctcttgagttgtgggaactacgggcgcaagcaaccacacgggcaaactttggg

SEQ ID NO: 505153 - DNA, 1117 bp, Homo sapiens
gggcttctagggcggcgagcggacgggctggctatcgagctgagcggggctgggaacgcggagttgctgcctgcctgctcgggctgcctggggctccgtcgcggcctgcagccccgcgggtcgtcctccctgtgcctcgcccctgcggacaccctggccgtggacaccctggcctgtgggcaccctgcgtgggcgcgcggctgctggggcctgctgtgcctgtgctgtgccggccggcggcatgacaggtcacgtcgctcgaccgggcgccatgctgcgcaaagatggctcacgcaaggagtgcgcgcggcgctgctgctgtgtgtgctccgacttgcctggccctatcttggccttcgactgcctcgacacgtgcagcggatcgcctcaaacgtcggacctcaagctcggtgggtactgctggtcgggccctggggctggcggcggatgtcaggcgcgactaccgtgcctgccccgacgcaggcgggtcgcgccgccgcaggcttcccttgacaagaggaagcgagcgcgttgggcaagcgacgctcgacgggacccgatcgatgggtcgctgagaaccccaaggccaagcacctgaccaccatgcgcacgaaatgctctgcggcacgcacggaacaagcggccacgaccgccgctgtcgatcacatacacacatcccgcatacgtacgacatcatcgccagttaacgcaccgcgcagggggccccaggccgggagttcataacacatcgcctccaaacagaggcgcgcgactactggaacgaaccctgcgcacgaaacattcgggaacctaattcccctggatcgttggtcaggcccgtagtacaacgtgttcagaaagcacccgcaaattatcagaccatcagcaagaaaccgacattagagaaacacgctcgcgaaacaaaggaccacatccaataccagacgcaaccctgatggacaacaaacatccgcagggcgcacataacctggcccaaaccactagcaacggcaccacgactaaatgtgaaccactgcgggcgcggcccccacccgcgtgcgcaaaccccccgacccccacgtacccactcctaaccccatgacgagaacacggaacc

SEQ ID NO: 505154 - DNA, 306 bp, Homo sapiens
  misc_feature (168)..(168): n is a, c, g, or t
tggggaacgagagtaatttgaagaatgcttgaagtcagcgttttctatttaagaaagacttttattttttctttgggggtataatgtggaagctggttttagtctaggatttatactgaggagaggatttagataggtgggcttaatttcaaggggccttttctggcntggagaaggctttttacacacacacaacacatacacacacacacacacacacacatatcacagttttcacacagcccctgctgcattctctgtccatctgtctgtttctattaataaagatttgttgatctgttcaaa

SEQ ID NO: 505155 - DNA, 228 bp, Homo sapiens
aagtggaaggtgtgtcacgctcctctctgaggtcatgtcgacggtggactgactccaacatcctggtctgcagacgaagcctctgagcatactcatgggtcagagagatagcagcttcccgcttatccacagcaatgactcggctctgagtgagagctggctcaagaaggctgatagaagaatggctccctgatcctgcaagcccaacctccaagaatgaagggggac

SEQ ID NO: 505156 - DNA, 250 bp, Homo sapiens
caacctttaccaagttaatactgaatatacgcacaacataaagactgtatgcttttacctactaaaaggcaggtggaggttttaaaatcttagcattcctgtctgtgtatatatgtatgaaaatttaggtttaagctaatgtttaacacaatgcatttatctcaatttgggggaaaaaaagagatcctgactgtgcgacggtttggtatgaaaaccgacacttttgctgctgcctaaaaccttggcaagc

SEQ ID NO: 505157 - DNA, 397 bp, Homo sapiens
ggctatcacatatccaaagtacatgtagacaccacggaatattcaaattatacttatatgcacgttatagggacttgctgggttcttcgcttgtattggctccaagatagtccttgtcttcctaatgagggaggtgttcaatgacttggacagtgactaaactctaccccttgcatttcccacccataaaagacctgtaccttgtcatcttgccaaactttatgcaagagcggttccaccagggatctttagaaagcatttcttgaaattgttccaggagtcttcccccataaaggcttccccaatttcattcccaaacctggccagctccagtgaatataaatacaggagaatgatccttgtggtaaatgcttatgacgagacagcaaagcttgaa

SEQ ID NO: 505158 - DNA, 111 bp, Homo sapiens
gaggctgtgacccccctcttcagttgaatccccaagggagggaccagtgagtgtccactctgatacctccaattgatcttgcccctcatgtggtcacatgtgtgtgggtgg

SEQ ID NO: 505159 - DNA, 165 bp, Homo sapiens
tttaagattttttctttaacagaattcagatatttaaatattttctagtcaaaattgtttataatttagatttttcgcttttttcaattaaggagcaattgagtgattcctcgtcttagggttgtttcacgttccttcttgttaggtttaaatccaccaaccagg

SEQ ID NO: 505160 - DNA, 199 bp, Homo sapiens
  misc_feature (32)..(32): n is a, c, g, or t
atccaagcagtcgatagcaaggactaaccccnttccttctgcataatgaattaactagaaatagctttgttaggagagccaaagctaacacccccgaaaccagacgagctacctaagaacagctaaaagagcacacccgtctatgtagcaaaatagtgggaagatttataggtagaggcgactgcttggattacaagga

SEQ ID NO: 505161 - DNA, 213 bp, Homo sapiens
agcgaccgacctcactgaaatccacgttaaataattaattcctcatggaggaacctctttcaaggggattcctagcttagctctcagccctctctgcgccgcccgcctaaacacaagcacgttattttcctcaagctcagatgaatcacttactacatgactacagcatgccgttcctaaaacaatctggaaaactaatctcagccgcttaat

SEQ ID NO: 505162 - DNA, 136 bp, Homo sapiens
  misc_feature (104)..(104): n is a, c, g, or t
tgatacctgtccactcttagaccttagttcagcagtcacctcccgaagcaagccttcctcaagctgcacaggtgcagtccaatccaccatcacttatcacaggncaacaggagtcaggctgtcggtggattactca

SEQ ID NO: 505163 - DNA, 651 bp, Homo sapiens
  misc_feature (30)..(30): n is a, c, g, or t
tgcagttttataacttggggggagatagtngacaatcagggattatttctcatccacaatgactgtctataaatttttgaaaggggtaacaggtccataggtacccgaagtacagagctttttgggggaatcttcatcctcattatattctctggacaactgcccatggattcggcttgggacattccttattctttgggcccaaacagccttgttgaccctggtatcagttggcccatttaaagttcccatctccttcctgaaaatttccgattttttttgagggctcaaggggggtcctttttaaaccccccctcatgggtgccttggaaatggggaggggggtttcctcgggcccccacctcattgggtggcagaacggcccttttttttttttggcccccttttttcaagaggagcacttttggcgggggccggggttaaatttttagggagggttttttccatgaaccacgtaggggttgagcgggtgggtaatataaaaaggacctgcggttaattttcaaaactgtgtggtaaagggccctaccgcgttaacaattataggttgggggggcgctttgcgcaaaaaatcacggggtttccccccggtggtatttcacaagggtggaaagaaaatattaggggttt

SEQ ID NO: 505164 - DNA, 807 bp, Homo sapiens
gaattgtgccatgccctattgcatccaggtcatgaagggagtacttgacgaaggtggataaactcagatgcttcagaaatcactgagaaaggaagaagaaccaagctacagagacacaaccgcatggtcttatggtcagcccaagatggatgctgacagagaggacccaggtgtggccgtctcctcctcgcaggcagcccttgtgggtatggttataccgtcaccacccgttatggacggccacagcctggcttggggtacagcatgtgagatgaagcgctgatcctgtagtgcaccgtattgtcggactgaacacatgcgatctattacccacgtctcaggtttatgatgggggaaaacaggcaagcgtgtgcgttgtaacctttatttcatgaaggacttcttgtgtgtctaactataaacggtggcatcacctatgtgagataccttatttcagcattccgacatcattgtagaattatatctcgaaggggaatagtaacaatgtctaatacacttgggcttaatttcgttcccccctgcttatctttaaagaaccgtgcttccaatattcagatctgtgtggtgaagaacctggattaggcactctgtagtgtttaaaagaaagatagaaagtctactattgattctcttcaatttagggtatggtaagaggttacaagacgtatgtctaaggcttgtaattcgtttatcaagaaaaataagaaaacctgggtatgcctggtgatgggtgcacaagccaatatgaatggacgagggggtcgaatggaatgtgatgcggggtta

SEQ ID NO: 505165 - DNA, 867 bp, Homo sapiens
agccagcaaagacaaggtgcgaactgacagacaaacggtcagtgtagagaaccacgtgggctccatgcaggcgccccgatgagcccggaagatggtctcccgcagggcgacttttccgctcgaaggcaacgccaggctcgtgtgcgtccagacgaacacacgggtagggccccgccacctcaattgggctggaagcccctgggggcccacacattggggaaaaattaacaagaaggagatgggccacatgaaataccatcccggttctttgcaaagtacacagcgccgttggggtaaaaaaaaatttttaagtactgcgccttaaattgtaggaagcttttgcccgcggagtccccggcaaagtcggccattctacgagccacaactgattttccgggaaccccgcgcaaagtatcgtcccgcgatatgggaaccccgatataaatatttagcagcgtttttcaccacgtgccagagcagagaaaccccggacgtgggacacaaaaacatctggggtaacaacacgccctgcgagtgtttaggaagcaggagagcaccatccctctcagattgttcacacgaaggacattgaacaccattagccactccgtttgaaacccacggtgggccaccaatgccacagaagcaacggccttccttaatcaggtgaacccggcacaaacacggacacctgtggggaacgaaaaagagggcaagggaaagaataatggggtaacgccgaaaccctacggggtaaaaaacggcacataattcacggggtatcaaaagagctgcaagcggaaacatcccataaaaaaaaccctcagggccattatggggaaaaaaaagttgggaaaaaaaaataaa

SEQ ID NO: 505166 - DNA, 566 bp, Homo sapiens
agcgccggtgtaaattcgcaaccgacagtgtcatttccacaaagggtattgggtaatgggcatcataacagatatattgtgcaaaccgcaggtattcatgcgcaacatttctggaacggattgggggtagcacatttgcagaagctcgcccctagtggacgtcgctcgcgtgacgagacgtgactccttgtacgtgtgcctcgcactcccaggaggcctgcgacttgatgcatgataaagaaaataaacgcgccacgcaggccatgaaatattccccacctactcatgattcagcagctggacatccacgctttgagatctgcgcctaggaaccatgtatctggcaacctctctcatgaacacacaatcccgaggcgctcatctcactccaatccgacaatcgagcccttgcaggaaggtggtggctctcgttggacacccagaagttcctccggtaagaggtcgtgaagaacagcaccaaacgtcgttgctatcccgcggggaagtaaaaaatgcagtgtcattccccacacttttcgtaaccaaccacccaccgcccacataca

SEQ ID NO: 505167 - DNA, 214 bp, Homo sapiens
tcagaactgcctattattaaccgagttggctggacatggtggcttaccactgcaatctcagcactgaggcgggagaatcgcttgggcccaagagttcaagaccagcccgggcaacatagtgagacctcatctctacaacaaatttaaaaaatcagccagggatggtggcacacgcctgcagatcccatgcctgctcagcgagcgcgtgcagcgc

SEQ ID NO: 505168 - DNA, 913 bp, Homo sapiens
gtaagtgtgtttaaggattgttgtaatgtagttgtctattataaccacaaatacaagtgggtaaacaggtgtcggataacgatgagcggactttggaagcagttcgcaggggcgagacctttgtgggttgagttggctccgttctatcgcgtaaaaaagttttgacgcgtggccaccattgtgggttacgctctcacgaggagtggttgtatttccgcgcatagatgcttgttacctccgcgcttatgtgccaagatgcgtcatcgttggcgtaatgattccgttatagggtcttttgctgtcgccctcctcttcccgagttatttattgtccctgtgataacaaaatgttcctcccccagggggtccccgtgcgatgtctttggggattggtcaccctcttgccactcctgttggcggttgttcgactaaggccctcgacgaacagttttattctgtgcccccatatgggggttagtcttacccctctgtccgggttagtgtacatcgcgtcggaagtagatctatccctgggggagatgatacgctcggcgcgcgggcgcatgttgtctcgtcggccgctgttctctctctcatcgcgcctctgtggggacgagattggggggggtcgcgactacatatggcgcgggggaaaattgttcgccgaccggccgtggggcgccaccttctatgtagcgcccccgctacgtgaggctatgtatctgcaaacacctactgccgtggtctgtattggcctgcgtcgccggttgtagcaacatcggcaccggtggattactgaagcgtgagtgcaccaaacgttgcccaactgctggagcgagggagctcgactcatttgcccggggataacgcaaccccgcggggggggaaaagaaccccccccgcccaacataaca

SEQ ID NO: 505169 - DNA, 170 bp, Homo sapiens
gaatgccttcttgtggccccaaccactgcttaggcctcccaacttctcccaaggccaagtatggggctctggctgtgttctcgaggttcaagacacttagtcctccacagtgggtggaggagtgcaaggtcttccaggtcagatggagacgcagaacctcttgtcaagct

SEQ ID NO: 505170 - DNA, 427 bp, Homo sapiens
ctgctgtgggtactgagtaactagtgccccgagagcccctcggccaccttcagacaccttcgtcttctatcctggctctcgcggacctcgggactggcactcgattctccccttttgggcacccgagtcggcactggactttcactggcccttcggaggtgccctctgccacatggttctgacgggcactgtcctcgacgtctatgccagcctcttcctcattacagcgctaagcgttgctcgcctactggggtggtggccctagctgcggggcccggcaaccgcctctcagtcttctggggcccaatagcctccctggtcagtttgcgccgccgctgcccctgtcaccgtgcccacagcagtcttccgggtggcaggtgaggtgtgtagtgtgcgcccatatctgctgcgtttcccccgcaagtac

SEQ ID NO: 505171 - DNA, 944 bp, Homo sapiens
  misc_feature (13)..(13): n is a, c, g, or t
  misc_feature (66)..(66): n is a, c, g, or t
  misc_feature (76)..(76): n is a, c, g, or t
  misc_feature (82)..(82): n is a, c, g, or t
  misc_feature (85)..(86): n is a, c, g, or t
  misc_feature (117)..(117): n is a, c, g, or t
  misc_feature (140)..(140): n is a, c, g, or t
  misc_feature (175)..(175): n is a, c, g, or t
  misc_feature (180)..(180): n is a, c, g, or t
  misc_feature (218)..(218): n is a, c, g, or t
  misc_feature (222)..(222): n is a, c, g, or t
  misc_feature (227)..(227): n is a, c, g, or t
  misc_feature (315)..(315): n is a, c, g, or t
  misc_feature (328)..(328): n is a, c, g, or t
  misc_feature (339)..(339): n is a, c, g, or t
  misc_feature (353)..(353): n is a, c, g, or t
  misc_feature (368)..(368): n is a, c, g, or t
  misc_feature (370)..(370): n is a, c, g, or t
  misc_feature (375)..(375): n is a, c, g, or t
  misc_feature (383)..(383): n is a, c, g, or t
  misc_feature (386)..(386): n is a, c, g, or t
  misc_feature (388)..(388): n is a, c, g, or t
  misc_feature (394)..(394): n is a, c, g, or t
  misc_feature (412)..(412): n is a, c, g, or t
  misc_feature (414)..(414): n is a, c, g, or t
  misc_feature (418)..(418): n is a, c, g, or t
  misc_feature (420)..(420): n is a, c, g, or t
  misc_feature (422)..(422): n is a, c, g, or t
  misc_feature (438)..(438): n is a, c, g, or t
  misc_feature (440)..(440): n is a, c, g, or t
  misc_feature (503)..(504): n is a, c, g, or t
  misc_feature (524)..(524): n is a, c, g, or t
  misc_feature (530)..(530): n is a, c, g, or t
  misc_feature (532)..(532): n is a, c, g, or t
  misc_feature (561)..(561): n is a, c, g, or t
  misc_feature (694)..(694): n is a, c, g, or t
  misc_feature (696)..(696): n is a, c, g, or t
  misc_feature (723)..(723): n is a, c, g, or t
  misc_feature (787)..(787): n is a, c, g, or t
  misc_feature (857)..(857): n is a, c, g, or t
  misc_feature (879)..(879): n is a, c, g, or t
  misc_feature (924)..(924): n is a, c, g, or t
tttttcagttttntgattttgaccttttggcccaaggttattacagctacattctgtttggttctngggaaaggtncatttnctnngatgctggtcccctaatgatgggcccatctntccagtgccgtcccttccctccngcctggtacaggagttctggagctacggtcctgantttanagaacagcccggtcagcctcgtccctgcggtgcaagcnaggnctggnctccctccctgcctgttcttggcccggccacatcactccctgcgtttcttcttcttctccggctcctggtacattggcctgcctttantcgggcactggtnatggggccgangtgtcctccttctntggcgagcccctttntngccanggcccctnggntnatctcngagcagggcccgctcagntnttcntngntgctcaacagcttctncncgcgccttggggtcggcccctacacccctcctcctgctcctcttcctctccatgcccgggctnnggggctccttctcacctttncctctntnctgctgtataacttagcatatttttttcntcttcgtcttcttctgccgcctcccttcaagcaggcgcctgcaggccttctctgggatctcatcttcagggaaaatgcctactgccaggtcctgcagcttccggatcactttgtagagacgctttctgttctnanaaggggtgctctggcggctggccattncaaacagtctgttagcaactgcctcgtagtcaaactggagaacggggccgccactgtccctgtngtcacctgcctgctcctcaccagcctcaggttcagccctgcagatggagcctgcgagcggcttctcaganctcttctgggacagcgcgtctncacgctcaccaccctcagaggactcatcactgtgcgacgccaccncctcatcctgtgtgttcagt

SEQ ID NO: 505172 - DNA, 3370 bp, Homo sapiens
gcccccgcccggcccgccccgctctcctagtcccttgcaacctggcgctgcatccgggccactgtcccaggtcccaggtcccggcccggagctatggagcggcgctggcccctggggctagggctggtgctgctgctctgcgccccgctgcccccgggggcgcgcgccaaggaagttactctgatggacacaagcaaggcacagggagagctgggctggctgctggatcccccaaaagatgggtggagtgaacagcaacagatactgaatgggacacccctctacatgtaccaggactgcccaatgcaaggacgcagagacactgaccactggcttcgctccaattggatctaccgcggggaggaggcttcccgcgtccacgtggagctgcagttcaccgtgcgggactgcaagagtttccctgggggagccgggcctctgggctgcaaggagaccttcaaccttctgtacatggagagtgaccaggatgtgggcattcagctccgacggcccttgttccagaaggtaaccacggtggctgcagaccagagcttcaccattcgagaccttgcgtctggctccgtgaagctgaatgtggagcgctgctctctgggccgcctgacccgccgtggcctctacctcgctttccacaacccgggtgcctgtgtggccctggtgtctgtccgggtcttctaccagcgctgtcctgagaccctgaatggcttggcccaattcccagacactctgcctggccccgctgggttggtggaagtggcgggcacctgcttgccccacgcgcgggccagccccaggccctcaggtgcaccccgcatgcactgcagccctgatggcgagtggctggtgcctgtaggacggtgccactgtgagcctggctatgaggaaggtggcagtggcgaagcatgtgttgcctgccctagcggctcctaccggatggacatggacacaccccattgtctcacgtgcccccagcagagcactgctgagtctgagggggccaccatctgtacctgtgagagcggccattacagagctcccggggagggcccccaggtggcatgcacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggcgctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcagagtcactgtcaggcctgtctctgagactggtgaagaaagaaccgaggcaactagagctgacctgggcggggtcccggccccgaagccctggggcgaacctgacctatgagctgcacgtgctgaaccaggatgaagaacggtaccagatggttctagaacccagggtcttgctgacagagctgcagcctgacaccacatacatcgtcagagtccgaatgctgaccccactgggtcctggccctttctcccctgatcatgagtttcggaccagcccaccagtgtccaggggcctgactggaggagagattgtagccgtcatctttgggctgctgcttggtgcagccttgctgcttgggattctcgttttccggtccaggagagcccagcggcagaggcagcagaggcacgtgaccgcgccaccgatgtggatcgagaggacaagctgtgctgaagccttatgtggtacctccaggcatacgaggaccctgcacagggagccttggactttacccggaggctggtctaattttccttcccgggagcttgatccagcgtggctgatggtggacactgtcataggagaaggagagtttggggaagtgtatcgagggaccctcaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatgcagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggttatgaagagcattgaggatgggtaccggttgccccctcctgtggactgccctgcccctctgtatgagctcatgaagaactgctgggcatatgaccgtgcccgccggccacacttccagaagcttcaggcacatctggagcaactgcttgccaacccccactccctgcggaccattgccaactttgaccccagggtgactcttcgcctgcccagcctgagtggctcagatgggatcccgtatcgaaccgtctctgagtggctcgagtccatacgcatgaaacgctacatcctgcacttccactcggctgggctggacaccatggagtgtgtgctggagctgaccgctgaggacctgacgcagatgggaatcacactgcccgggcaccagaagcgcattctttgcagtattcagggattcaaggactgatccctcctctcaccccatgcccaatcagggtgcaaggagcaaggacggggccaaggtcgctcatggtcactccctgcgccccttcccacaacctgccagactaggctatcggtgctgcttctgcccgctttaaggagaaccctgctctgcaccccagaaaacctctttgttttaaaagggaggtgggggtagaagtaaaaggatgatcatgggagggagctcaggggttaatatatatacatacatacacatatatatattgttgtaaataaacaggaaatgattttctgcctccatcccacccatcagggctgcaggcact

SEQ ID NO: 505173 - DNA, 164 bp, Homo sapiens
gtctaacatcctagaggacaaggaggaggtacattacctgttcgtgcccctctgtcagaactccgacacctgaaccagctgaggtggagactcgcaaggttgtgctgatgcagtgcaacattgagtcggtggaggagggagtcaatgttgcactgcatcagcaa

SEQ ID NO: 505174 - DNA, 421 bp, Homo sapiens
cagctttagttatttgtgttgccatgtgtgctgaacaaaaaaataaaaattattattgattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttttcccccccttgcccccaccccttttaaaactcaaaaaatttttcaaatccccccaaatttagcccaaattggccaaatccccccaaagggagccctaaaaaaaataaatggcccccttttaaaaacctttgaaccggaaaaaccctgggtttccccaaataaaacccctttgaaaaaaaccccctttccccaagtgggcaaa

SEQ ID NO: 505175 - DNA, 299 bp, Homo sapiens
cgagagatttaacgaaactcagcaaggccaggcacacgcctgtagtcccagcactttggagaacaagggtggtggatcacttgagcgcgaggagtttgagacgagtctggccaacatagggagatcctggtgtctccaaaaaaaaaaaaaaaaaaaaggttccccggccctgggggcatgtctcacctacttgggaggctgaggagagagtattacttgaccctgggaggttgaaactgcagggagccgtgattgccccactgctctccaccctgggaaaaagaccacgcccctttcta

SEQ ID NO: 505176 - DNA, 810 bp, Homo sapiens
tgggtgcatatgcttaaggggagcccaaagggcctctcggctcgactggggtccccggccccccgagctgaggaggcttcgcaaggccggcctgctacaaagtgccgagtctggtgctgcttaaatttataagtgagaagcgttcgaggcagaagcgtggtgacgttggtggctctcctcgcgggacttgtgcagaattcatttacgcaaaccaactggtgttgagtgagtgaggaaacataggcacattcaaagacccctaaggaggctcacgtggagcgtaagtgatctaactcctacctttccgcaggcaggggccctccccacctcgctcgcgtgcccccgaagcccatttcccacgaggggacctccagctccacttcgcagaaagcacaggcacaacacgcgccccccattcaaggctcagaagccagaagtgacaagttgaggtggcaatcatagacgtcatcccattaaccgggacaaggaggagtggggagaaatgagagctacaaatgccatgatgtgccccaaacctctggtgcactgggcacaaggcccccagtttctccactactgtgggagaagaacccattggccctacctgacttgcctctcacaaataccgagcgaggaccagcaggaccagggggcctacaagggcaccattacagggtcccgactgagagcacccggggactcaacaggggcaccgtgggcaccacggggggccccatagccgggagctcacgcaggagctaggccagactgtccagaaccccgaggtcacgcaccgccctgcgatgccaa

SEQ ID NO: 505177 - DNA, 528 bp, Homo sapiens
agcggagttttgggaggcggcggtggaaggaggttggtggctgactccctcgctcgccctcactgccggacggtacccaactccaggcaccatgttccccgcgggcccccccaggcacagacatcctccggcatcaccccatgacatgcaagattgctgctactggtggtgcagagaccgatgggcgagagggggacatgcggaacagacgccagcacccggcacggaggagcccccccatgagaaaacatgtggtcatcgcacgcaggtacccaacagtaccacagtggacctgctacaccgaggcacaggctgcacgaactgcgccagagcactacaacggatgccagccataccccaccataacacaacgggacacccttcacagcaccacgactgcgccaccaacaacgtcgcaaccccacagcccttcacgcactccgccacacacacccatctgaccgagccccatccgacggacgcgcgccgcgggcacgcagcaccaccaccaccacgcactgacacccc

SEQ ID NO: 505178 - DNA, 567 bp, Homo sapiens
gagtagtctagcatagctgggatgcaactgtagtgctgacacattcatatatgagaaatgtactattgactcccatgtgttagtgaccccctctgattccttgtctccttgtatcctaagtgctgatatcttcatcattgttctactactgctgtgatcatgatgacatgtctccatttttacatatgctttgctttattcactcctttgtggatgaaatcctcctattacatgtggttgcccagtgccatgaggaaggattggagagccacttgaggtcatatgttaaggtatgtaaaacacactgttctgatcacttacatctgtggctctccagtattccttctaagggacttatttttcacaagcctggttatttgaggatgtgcttgtaacgtatgctttctcttctatttctcatagccaatgcttgtacctgaataggggaggtacgaagagggacagccattcactaatttacttaattccattccttcaattatgtttctttcaatgggttttcccaatcatatgactcagtgtggagtttaagaagaatttaagttg

SEQ ID NO: 505179 - DNA, 173 bp, Homo sapiens
accgacagttcgtcactcggattgacttaagaagtgtctggtgactcggcgtgtgcagcaacaacttcgtccaccaggagctgttggaccctcggcgtgtgcagtgtgggcactcggcgtgttgcacacgccgagtaaccatactgctcatatcagtgtggacgaagttgttg

SEQ ID NO: 505180 - DNA, 339 bp, Homo sapiens
gttttacagcccatcggcatttaaaaaggggagcctttttacatttgttccttttgggccagccgcaaaccattttgcagccctcacgggccttgagatgcacttttttttcaacctaaagtggcattttgacccttggcccttggcctcggcagtgacactgatgacaattaagccaaggctccccggggccgtcatttaggaatgttggaacaaaggacatttttcaaagttcccctgaagaaatgccatttttagaaccttttttttccccgactctacccccccctttgttcttagagccctttggtggggagtccagaaacattattgcccaga

SEQ ID NO: 505181 - DNA, 140 bp, Homo sapiens
cctgccttggcctcccaaagtgttgggattacaagtggggagccaccacacctggcctcttatttttacattttttttgataagtaaccatcctcaatggggcatgagttagtattttattggtggggtttcattttcat

SEQ ID NO: 505182 - DNA, 412 bp, Homo sapiens
  misc_feature (261)..(261): n is a, c, g, or t
  misc_feature (361)..(361): n is a, c, g, or t
ctcgatctctagaggtatccccagctggtactcagtgaaagcctggaggacacaggcactgtaaacgatagactttatccacacactgcccattgttcacagcaagggttgctctgacattcatttatttctagacttcacaactgcacaccatttgaatacctggtcatgcacagaacatgtgtaagcctccaagtcttatccacgacgggtagcatcattctggtcatggggtctgaactggcacccaattgatgtccnatctcacaacagaggtcctcgcataacccattcagaacatctcacatgtggaatggcgccatcgcgtgttcacacatttttcctggcatgctcacaaggnattgctatttggccatggcacattcatccacatcttctgtgcagtcagccc

SEQ ID NO: 505183 - DNA, 574 bp, Homo sapiens
  misc_feature (116)..(116): n is a, c, g, or t
  misc_feature (129)..(129): n is a, c, g, or t
gatgatcatcctacccgagaatggtgggcagcatgagtgggcgtctacaatcccagcgtacttgggaggctgactggcaggcgaatcacttgaacccgggatggcgagaggttgcnattgagtccgatngatcgcaccattgcaagctccatgtcgtgggcaacagatgtgagcattccgtctcgaagaaaaaaagaaaggaaacgggaataaacaaatataggctattatacctttttccttgggtctcaaacgcggccatggacaatttcttggaagcattccaagatttcaaggttggatatattccaaaagagaaatatttataaaggtattaaagattagattttgaacctctctataataggataattaggatattacgttttaacaaaaggccttcagggggctatatattagagtctgttctataaaaccaggctatacaattcccacggttgcagcgctatacctgtttaacgccaacgcgtattggtctcctacaaggttggagagaaccaacgcaaaggcgccttattttcccaccttggcgtgggtgatagccactcagggg

SEQ ID NO: 505184 - DNA, 1056 bp, Homo sapiens
  misc_feature (671)..(671): n is a, c, g, or t
ccccctccaggtgacgagagaagtatcgtcgagcggcggcgcgcgcctctcacagggtttgtctctcacgcgcgtcgccctatacgagcctgtgcccacccccccgtgtgtctcgtgttgtactgccgcctccttttttcacaggaacaccacgtcggtattccgctaattgctgaaaccccgcgttcgaatagaggtgctttttttttaggggaaacccttgtgggcaagtgctctagtgtttccccgggctttattgccttcggcctaagtttcctgggaaatttgaggggccgcaacgttcggcataatgagcctcccggcccccgtctttggggccctgctcttcaggcgtttcgggaccccaccaggggcaccaccggctcagaggcccggctcctctccacggggttaagggaccagaccccacggaaccccgatgggagcccacgacacccctgcgagacaccgcttgcagacacctgttgttttggaaatgtgctttccctcccctgcctgagaattcttcattcccttccaccccgccccacttcgggcacactgtgctcgtggggccagggcactgcgctcccctggctgagcacccccacgagagttttgcctgcacccttctcttacatgccgccacacgcctgctcacatccgctctnccacatgttgtggttttagagatccacatggccacattcacctgagactcacctatacacccctgcccaaaatctttataggagaaaaaggctgaagggtacgaccactgcacactatgtgacctgggaaatagccaatttagatcttttatgatttaattgttattgttttcccactagaagtttccctccccttcttgaaattaatatataatagtataaatttctgccctgagccctggcggagctgggcagcccctaggttagagtggagacggaggccccggcgccccggggtcacacctcatctggtttccttcccctctcaccgcttagcttgtgcttttccacccccagtctttaagagccataaaaactaccccct

SEQ ID NO: 505185 - DNA, 461 bp, Homo sapiens
gcgctgagctgggctctaccgggctgtctgggaaggcgccgtccacaaaacacactgcggcgtgggccggcggcgccaagcggagcagcgaggcgggcggccgggccacccgctcgccgcctgcccccctcggctctccgcgctcccccgccccccagccgcccgcagcctagccgccgccccgcctcactcgcggcccgcccccggcctgcctgacccgggggcggcggccccgcggatcgcccttatctggccccggcaccccgggccggcagctcgcgcagcacccactgagaaggcgagcccgccgcgcgggggaaggatggcggaggagcgcgaggctcctcctgtggggagggggcgcccccgtctctccgccagcgccgggctcggcaccccgcgggatgcgctcttccccgacgcggcaccaccgcccgcctccccgctggactccgcggccg

SEQ ID NO: 505186 - DNA, 326 bp, Homo sapiens
aaagcatcatcctacctggctccgtcagctagagcactggcacttgaggtaaaggcccgagtgaaggggtccactactcactagatggattttacaaccctccacccaaaagaggctacacgccttgtacagtgactcatgctatcccgtcagctacaccgtatggggcctttcttacatttgcaagcggtgcctagcactccctagatgtcgaggctatgaggcctgagttcagccctgtacccgaatacagacatctgtcttccaggcgctgcctttgtatccaggctgagactcagaacaagtgagtcatggctaactgggtc

SEQ ID NO: 505187 - DNA, 654 bp, Homo sapiens
ttctgcacgaggagagagagtatagagagagagagtagagagagagatagagagagagagatagagcacagagagtagagagagcgagagagagatttagagatatatacacacagagttcccctgtgtgtgtcctcttgtcttactccttccttcctctctcgtctccctctccccacatcctgatgccgactttcactactccctatcttcctgccctccctcactccttctttttcactccccttctttctccttcgctcttgcttctccacatctcttcctctctgcttccctctttccttttccctcgctctctctactctctctgtctccctatcttctttcccgactccttcttttcctttcccgctcccctctctatccccctacttccgtctctctctcctccattcctctcctctttttcctcccctgctcccttttgtccttcacttcttcttctcttctcctctcccccttctctctttttcctctctcttctccttctttctctcttctctcttcctctccttctcctctctctctcttctttctccctcttttttcccctcctttttctccctccttcctcttttctcccttttcttttcctctttttcctcttttccctcccttttcccttttttctcc

SEQ ID NO: 505188 - DNA, 477 bp, Homo sapiens
aacacgatagccacctactgcctgccacccagtggatctactcaccttccctaagacagcaggtgcccaagccctgcctcccggaagcttcccccaggccccaggtcgctgtcaccttggtcctccagacacagcaccccaggccggctcctgctaaaccctgacctccctggattggggctcacggccctgtctctccgactcatgagtgcgagcttgcgcagtgcagggaccaccgatctgcacctgcacattttccgccacacctggtgctgttctgtcatcagtgcccagtaaacacccggagaagcaaaggtgccagcctgggtggccacccgcatgcccccgtctcacccaccttcagcaggtccttcagctcctccatggtctgcttgttggccacctcatcatgaactgtctggccacagttctttaccacagattccatgacctgcagatgcccaggaagggaagggt

SEQ ID NO: 505189 - DNA, 133 bp, Homo sapiens
atgtatacgatggggttagcgactggacggtaggacttggtgctgtgggtgacagacgtatgactggggtggtggttgtggtaaacctttacctacgtgtacggacgactgacctacatttactgaccggacg

SEQ ID NO: 505190 - DNA, 321 bp, Homo sapiens
  misc_feature (6)..(6): n is a, c, g, or t
  misc_feature (50)..(50): n is a, c, g, or t
  misc_feature (86)..(86): n is a, c, g, or t
  misc_feature (182)..(182): n is a, c, g, or t
  misc_feature (204)..(204): n is a, c, g, or t
  misc_feature (217)..(217): n is a, c, g, or t
  misc_feature (257)..(257): n is a, c, g, or t
  misc_feature (268)..(268): n is a, c, g, or t
  misc_feature (303)..(303): n is a, c, g, or t
ggattncctgttttcggaagttgctgggttcgttttattcagcggcagtngtgctttcccgaatctcagaatgcctgttaaaagancactgaagttggatggtctgttagaagaaaattcatttgacccttcaaaaatcacaaggaagaaaagtgttataactttattctccaacaactggnacttgtcaaatgagtctatttncttctcccacaanttctgaagagcaaaagcacagaaatggactatcaaatganaagagaaaaanttgaatcaccccatttaactgaaagcaaagaatcnacaacaaaagacaatgat

SEQ ID NO: 505191 - DNA, 770 bp, Homo sapiens
agcgggctctatcctcggccgtctgctcccgagctccgggctcccgggtgctgaccgtcgcgcacgcgcggcgagcggagcgccgggcagcgggttcgctcggctgcacgcgagctcatccattccgtggccgcgcgccgcgcttggaagctccggcagtgcgtgcgtttgcaggaaagcgtgtgggatacagcatgtcacatgaaacatactttatgcttaagcaagtaaaaatggcaggcttcctagataattttcgttggccagaagtgtgaactgtacttgacctgggagtgacgatgacaggaaactgctgtgcgcgatctgattggtcgcaggtaatattgtgtcgtgtacacggctggctggatagtgattgatgcacgcgtgctgcgctgtactcgctaagaccaagtaacacgtatgaatccatggcctttcactaacatgtgagtgtacttcttccgagcattggctttcttcatgatcaacatgctgtatccaatgctcaggtgagaggtgatagctatgaaagcggctgttcaggaagaacaggtgctcgagttgggcttcctcattgcgtttcagtgttcgatgtctgggatcacttattgcttccatgtggattctcttgggtgcatatgttacccaaatgtgtggccataggcaggcaaaggagcaagttactgcttcctcaggcagttcgagatgtcagctagaagcaggaattactttgactaaacagaaaactttatactgatgtctatccg

SEQ ID NO: 505192 - DNA, 509 bp, Homo sapiens
  misc_feature (30)..(30): n is a, c, g, or t
  misc_feature (112)..(112): n is a, c, g, or t
ccgggcgcagtggctcacgcctgtaatccntgcactttgggaggccgaggcgggcggatcacgaggtcaggagttcgagaccagcctggctaacatggtgaaatcccatctntactaaaaatacaaaaattagccgggtgcggtggcagaaacctgtaatcccagctactggggaggccgagttgggagaattgcttgaacctgggaggcggaggttgcagtgagccgagatcatgccactgcactccagctgaggtgacagagcaagacttcatctagagaaaaacaacaacaacaacaagaaaaaacttgatcttgataattagcaagtgttgattagccttgccaagactgcaaattccccaacagacagagctcatggagaaggctttaaagttatgcaccattaattcagaattcatgtatcaatggaattttccaacgatgaagacctgctgggttttctgtttggaaccatcatttaaggtaccatttcagttgtaatctcc

SEQ ID NO: 505193 - DNA, 238 bp, Homo sapiens
tagcaggacccccacaccacctcgtcttacagtcctttttatttctgtcaggttgcgtacgtaatgtaacctcctttgttcctgagttttagtaattgaactcttctctctttaattcttggtcagtctagcttaaaggtttggcaatcttgttgatcttttaaaataaccagcttttggttttactgatttttctcacttgtttttctagttctttatttcatttcattggtttctg

SEQ ID NO: 505194 - DNA, 549 bp, Homo sapiens
cagcttgctcatattatgattagggtttattctaaggtaagtgtcgcgcaacctcgtgtaacacctacggttgatgtgagctctacagcattttatggtgagggatatgatgatagtgacaagagaatccttgacatgtccataatacacaggcagcttggatggaatcccaagacttcactttgggacctgcttgagtccactctgacatatcagcacaggacatatgctgaagccgttaagaaagtcattgcaaaacccgttgcaagttaagctttttacagtgatggtgatgtgctacctttgagaagggtgttcttgtcttgcccaagtgttctgccatattatactggttgattttatataaaatcgtaaattttcctcctattggtttcgttagcctgtaggcaatatagcccccacatggagaagtaggaatttatacaagggcaatctgtgctctatgtaattttaatgtagagaccatgcgctgctaaacatgttgagacactttatatattacctagggaagacttttttctgtgtttt

SEQ ID NO: 505195 - DNA, 800 bp, Homo sapiens
gataacacagagaaggaattcggaatactatcagataaatttaaaaaaacattgaaataattaaaaagaatcaagcagaaattctagagttgaaaaatgcacttgacatactgaagagtgcatcagagtctcttagtaacagaattgataaaacagaagaattagtgagcttgaagacaggctatttgaaaatgtaaagtcagaggagacagaaaaggaatactctaaaagaatgaagaacacctataatatctaggaaatagcctcaaaagggcaaacataagaattatgtccttaaagaggaggtagagaaagagataggggtaaaaagtttattcaaagtgataataccagagaacttctcaaacctagaaaaagatatcaacattcaagtgtaagaaggttatgaagcaccaagcgtatttaacccaatgaagactaactcaaggcatttaataatcaaaccagcaaaggccataaagaaaagatcctaaaagcagcaagaaaaaagaaacaaataacctacaatggagctctgataaatttggcagaagacttttcaatagaaattttacaggccaggagagagtggcatgacatgtttaaagtgctgaaggaaaaaattttttatcctatagcagtatattcagggaaatagccttcaaacacgaaggagaaataaaaactttcccagagaaacaaaacagatggatttcatcaacacagattgtcctacagaagtgctaataagagttcttcagtcaaggaagaaaagggtgtgatgagcaatagaaattatg

SEQ ID NO: 505196 - DNA, 2023 bp, Homo sapiens
  misc_feature (97)..(97): n is a, c, g, or t
  misc_feature (886)..(886): n is a, c, g, or t
  misc_feature (1566)..(1566): n is a, c, g, or t
  misc_feature (1616)..(1616): n is a, c, g, or t
  misc_feature (1747)..(1747): n is a, c, g, or t
  misc_feature (1778)..(1778): n is a, c, g, or t
  misc_feature (1834)..(1834): n is a, c, g, or t
cttctataatgttttgttgtgaacatacatgctgatggtattgatagcctagggatgctgtttttttataaaaaaattgggtgctcctctatatttncttttagatagcaggttgctgccttcttctccctacagatgtgtctgccccaaaaaatattgttcccgcaatattgtcatcgcttttgctctctactaagatatactctactgtgcgtgtatgtagtagtactttcttctatactccttccttgttggataaaagatgtttgttcccgccagatatgtatctctctccccttgttgtccgtatttgtcctccccatgccactccctagagtgtatcgtcctctactttgtgtctctttttgtgctgtcccactattgaatttagtgtggtccccccacaccctttagtttgtggtggaatcatcccaacctcgggtgtgtgttgctccgtgagaggaccacatctgtgtgtgtgcccggaaggataatagtcgttgtgttatcgtggggggcgctcctcgcgtagggatagggtgctctgttgtttagttcctacatcaccatcagggggttattactctcgtcgttgttggatgagccccacatacaataggtttgtttgtggcgcctacaagtgactgtttatgatgattgttgtttttttgtaaagatgttttatatttccggggggggtgagtcacaaaacaacaagggcgcacctctaataaggggctcgtatcgtccacaataaaagggagagtgggtgatcacacgccacaacgtgtcggtgttgttgggtgccacacacgaccacagcaacaagtgagtagatgatgtctgttggtcgctctcccgctctcgtctgcattaggagttgctnttcctccactcttgcttgtggggccgctcctgtgtgcgatcgcacacaatgagtggtggtggtcccccttctggcgttaattttgtgggggggcatcaacatcgtagtacaaataatctctctcgtagtcctgtcgctagttgttgtagaaacctcgtctgttgctgttctgtagtgttggtgggacacaccagcgccgccacttgggtgcacaacaacacaaaagatgggtcctgattgcctacattcttcgctcgcgctactctcgtgtgaggggattagctcgtccacaccacatatagaagatatttgttagtataagacagagttttttggcgccacacagcagtgctgttagctctcttgagtgtgcacaacagagagctcgcgtcacacattcttgggagtttcacacagagacgctactatagtgtccctctcgctactcttcgtgagtcctctatatgagactctctactagtcttggacacacacagagaggctactctcacaacaaaccttctctatgcgtgtgtgggtctgttttgtgtgtcacacactgtactgtagtgtgttgagatattgttgagaccccactactagaggagactcttttgtgtgatcactagctggtgctgctgaaaataatagagttcttcttgtgctgtgcttgtagttgntggtgtgagaacaccaccactacaagaagtatcacatctgcaagcaggtnggtgtcggtactcgacaccaccgcttgctgctcggcacacacgagttgtccgtcttgtgatgcttgttggtggctacacaacgcaaatcgcgtcgcgggctctctgtggagaaaagaattgtgacactctnatagatgtatcacttgtgaacactccaccgnctctcccacgatgtttgtggacacactgtgtccgcgctttccacgaaaccactggnagagaagataaaaatagacacttctcactggggaaccacactgtaagaaaaagatacccgatattgtcctcaagagagaagaaatgagcaccctttatacccggacaccagaattttgccaattggtggggtttccaaataaagagtattttccccctgtgaaattaaaaaaaaagaaataaaataaac

SEQ ID NO: 505197 - DNA, 88 bp, Homo sapiens
catggatttgctggtgcagtacaactaggcttaatagggacatgtctccatacccattacaatctccagcattccccctcaaacctga

SEQ ID NO: 505198 - DNA, 473 bp, Homo sapiens
cttcttcgtgtacccgccatgtacgagttacgatgtattattccacttggacttaaaatataaagtcttgtatcaacacattgttaggatgttgaagtttctcaagatatttgcacagaatatatagaagtacttagaggagttttgttaactgcagttggtcatactagatacccgagggttgcagttttgagagaccaaatgcatctgtgtcagacatagacaaaaggcatatactcctccttcctagaaacgggtacatagacatgttcttattcttgggatatgaaaaaacaagtagtactggcatttaaagtttaattactaactgtataatgcctgagaccaaaattcagagcaattctcaaaagggttaagagtcagactctgggcattttcgttttttagctgcaggctcctcagtctcgtgtgattctaaagtgcttgcctcgatctgcgtgtgattctggccg

SEQ ID NO: 505199 - DNA, 696 bp, Homo sapiens
agacatggcaatggagatgagggtgcccgtgcaggtgcctggggtctggctgctcgctctgggtcccacatgcgtgaacagggaatgtagaccaatccatgtttgaacaccaagttctgcgatttcactactcctgatacttgggatacttgtcgggagatcgttgaatgattttcgagccaatggaacttcgtcgcagaggtccactgtacagcgggcataaccgaaaagcttgtactgcgcgggtgaattcagaggctttgacttcttccccaaaccgcggtgaaaaaattaaaggcattccaccattaaaaaagtcttccccatagaggttacttatccaggaattaggcacctgacccagagtgtgaccggcggacacaacgggataggtgaagagggttaaccctcccccattttaaccagaaaggggggaggagcttattcccgaaaggtccgggggacaaaccgcattggcggaatttcccatgggtggagtaactatggtaacttctttgccaaacgtccattacaaacaccaatttccccaatggcccaaaagatccgccttcggtgggattggcgcataggcaaaggatagtgacggtcggagtctcaaatgtcaacatggtgccaaacacgatttctaaaatgaaactatagcactcggcattcatcttgaatacctgggtcggg

SEQ ID NO: 505200 - DNA, 369 bp, Homo sapiens
cccccttttttctaaaaatagaaaattagcccgggggggggggagaaacgggtaatcccccccccttgtgggggtgaggcaggaaaattgctttaatccgggagggggggggtgcagtgaattgagattgcccccctgccctccaggctggggggcaagggtgagaccccgtttcagaaaaataaaaaacccctttggccaaaaaggggttgggggccggggggggggggtgagagaattttccctggaaccccttttccttaagaaaaaaaagcaaaaatcccccctgcggggccctttggctttaggggggttccccttaaaaaggtacttttttttataaacggataagattaacttttcccgcca

SEQ ID NO: 505201 - DNA, 92 bp, Homo sapiens
gtcccttttgatatttttgattttccatttcttattcatttttctcatcttatcttcctagctttattcacttccccttctgtcgtcttctc

SEQ ID NO: 505202 - DNA, 114 bp, Homo sapiens
gctactcaggaggctaaagtgagagggtggctctagcacagtcatcaaggctgcaggaggctatgatggagccactgcactccagcctagatgacaaggtgagacgctgtctca

SEQ ID NO: 505203 - DNA, 282 bp, Homo sapiens
  misc_feature (29)..(31): n is a, c, g, or t
acgtaactgccccaaggcttgcagccagnnngtgatgctgttggtcaggtttgcatccagctgcaaaggaaaagtccaacccatggtggctaaaaaatagagggcacataagtctcaggcattacatttttattcctgtctgtgagcaagaatcctccttgaagattcaatgcacttgcagctgccccggagtctgcgcttctctatctgcccagggcagtgggcaggacggaccgtgctaacccaggagcagctgttggtgcaggctccttggctgcaggg

SEQ ID NO: 505204 - DNA, 336 bp, Homo sapiens
gggctctacagaggtcatattgtgctcgaggtacttctgtcatgtggctattgtgtgacgggactgttccaagtcatatgagataccattctgtacagagggtccgctattaccattctataaggcacagagaacatagtacgcaatttctggcacacgcgctatgtgtgccgagagacaggttacagagcgtataatggcctctcacaggaatgcggcccattacagtctgaaatgtacacccagaggctgaacttttggtggaactcttgattgtggcactgcgatgtaaatggatggctcgtgaatctggccagggcccatgttagctggggc

SEQ ID NO: 505205 - DNA, 1015 bp, Homo sapiens
  misc_feature (973)..(973): n is a, c, g, or t
tcagttatgaagaagggaaagctttggcatgatcttggagtgcaagttttttggaatcttctgctaaagaaaatcagactgctgtggatgtttttcgaaggataatttgtggaggcatgaaaaaatgtgactggggcatgttggacaaggcgtggtctgtgatgctgcggggatgcgatgagtgcgggggaagggctggttggcacctgggtatgtgtgtgtacgctgaatgaaggcgtgctgcgcgcggggggcttggaaaatgaagctgtggctggggtggtcagtacggtagatgcgcctagattgtgttcgtcgcgtggtgtaggaagccgtcgcttgaggttgggattgtgtttgctgggtgtggagcaagaacgccgtgtgatttgttcagctattttgcagtgtcgactgggttgttgtaactgttggtgcaacgcggatacaacgggctattgtcacacggggatgcttcgcttggagacaccagagtggtgatggtctggcgtgatctgtggacgggcaatgagtggtaggcgctggatgtgggcgcgcgggcatagagacggtgcaatggagactacgggtcgtgtatactgtagtgtttcgttggtcgctcaactattgcccttgggacgtgtgtttctgctgatctgtcgtaggaacagcatggtctaacactggtgtgggttcttttattagacggtgaggtgtacgtcgtcgctgcgttctgcacaggccattacgctggcgctacaccctatatagtcgtacatcgtgctagtggcgtatgctcgagagtcgtgttgacgagtagtatgagcaatcgagtaatgcgagatagaacgttgttggtgtactagtaactctcacgaatcagtagctgtgacgctcgtgcgtcagtgtacataagtacaatcacgttggatgggcatgatttccagagcagtgtggcgcgcacacgtcgcgnaggtgtactacagtgtctacatatcggaatatgacataaaag

SEQ ID NO: 505206 - DNA, 349 bp, Homo sapiens
aacttttaaggagaaccaacataccagcaggtccctccaaataaccatcttttattccaacatccattttatataatggttaaaaaacaacaaaatttggtttcattaatacatttggttcactaaaaggtcacatttccattgaacctatccaccattgttaagtgggaatttcccatactacctggttatctctttggcagccagttagtctccatcataacaatgctatgactatgttataaattttcttatataaatcaggttaatggattgtaatacctttggctacaatcttttctctaccaggtggccacagctatagtgcatgtgtaattttgctattata

SEQ ID NO: 505207 - DNA, 906 bp, Homo sapiens
  misc_feature (1)..(1): n is a, c, g, or t
ngattccggcgttcaagccgtggccccccgttgagccaaataataagtgttgggccccccaacaacccccaaggccctttatgggtctaatcctttttatttaggatcgtacaaccctgctgtggagcggttgcaacttttgctggaccgcgtactcgctttccaagaaatggggcgcacgccaaagggggctatatatattgaccacgtcccccgcgagggataaatgtatcatacacgcgacgtgtggcagatacttctcgggccaaaatagatgttattgcgaggacaccctcacgaattgcgcccgccttcatagagtggggggagaaataaaatttttgaaccagcgccacccctattataaacgtgttgttggtttcgacaacagaagggcttggaggctatgtaagtgccccctttatggccaccgaagcggggtcattacaaagctcttggggagtcaactaagaaataggtgaagcgttagcgccctttagggacttcataaatggttgaaatcatgccgatgcgctcctcgctctataatcgtaaatcccgtgaagtcatttctcagccgcgcacacgttcacaatctcttttttggcgagagttctttcgaaattattacgttccagattaataactcctgaaaacacaggcctcacaaaaagttttagaaacgctcctactcgctgttctgcataaatattcatgacacacatgttgatatttacccacgacaaaaatcttatgtagctatacataattccacaaaggtggtaaacctcacacagtatgttccttcgcatcacttgtatacagcagagaatacaaatacaccacgatcaggtacccactttaattatttcatcacaccaaagataaacccaaacaaaaaaaaca

SEQ ID NO: 505208 - DNA, 758 bp, Homo sapiens
  misc_feature (304)..(304): n is a, c, g, or t
taccaaaaacatcccctctagcatcactcagtattagaggcaccgtgctgcccaagtgacatcatgtttaacggccgcggtaccctaaccgtgcaaaggtgagcataatcgacttgttccttaacttagggtacctgtatgaatggtctccgacgagggttcagctgtctcttacttttaaccagttgataattgagcctgcccgtgaagcatggcggggcttgacacagcaaagaccgagaagaccctaatggagcttgtaatatctatttaatgcaaacagatacctaacaaacaccacggngtcctaaagctaccaaaagctgcattaaaaaatttcgagttggaggcgaccatctggagcaagaacccaacgctccgaagcagtacatgcgtatagacttcacccagtgcaaagcgaactagctatactcaatgtgatccattaatctgtgaccaatggaagcaagttaccctagggataacagcggcaagtcctattctagagtccatatcaacaaatagggtttacgacactcgatgtgggatgcaggacgttctccaaatggtgcagccgtattaaaggttcgtttgttcaaacgatttaaagtcctacgttgatctgagtttcagaccgtgagttatccaacggtcggtttgccaatctactgtcaaatttcctcccctggtacgaacaggacaagagaaataaggcctatattcacaaaaggccttcccccgtaaattgattttctcta

SEQ ID NO: 505209 - DNA, 161 bp, Homo sapiens
ctgctaacagtcggaaaagaaggaagaacaggtcatagcctcgacctcaggtggctgaaggagagaatgtatctcgtgtctgccatattcttggcatccttcaatgacacttttgtccatgtcactgatcttgctggcaagggaaaccatctgccgtgcga

SEQ ID NO: 505210 - DNA, 1392 bp, Homo sapiens
  misc_feature (331)..(331): n is a, c, g, or t
  misc_feature (335)..(335): n is a, c, g, or t
  misc_feature (339)..(339): n is a, c, g, or t
  misc_feature (344)..(344): n is a, c, g, or t
  misc_feature (348)..(349): n is a, c, g, or t
  misc_feature (351)..(351): n is a, c, g, or t
  misc_feature (355)..(355): n is a, c, g, or t
  misc_feature (366)..(366): n is a, c, g, or t
ggtcaagcatggagatatcaagtgtgtactaaatgaaggcatgccaatttatctgtagaccatcatgcaaaagggtcgcctcaatccatctgcaatttcaaggtcaaactttcctgcagcaatggctttctctctcctgataaactgtctttgctaggaaacaactcctcaccacgagcaggcaaggccagtggcaagagactgcatgcagatggaccaagtagaactggtggactttgatccaaatcaggaaagacggcgccactacaatggagaagcatatgaggatgatgaacatcatcccagaggtggtgttcagtgtcagacctcntaangggncagtnaatnncnctcnctgctggcatntaatgtgcagtagtgaatgagtgaaggactgtacatcataatatgctcactacttgctcttgtacccgtctcaatcaaccctatagtcagtgtttcaacaacagtccccctgcaagacatcaaccgcagactatcaccagctctcacacaacccaaccccaacaacactcacagcgcccccacatccccggcacgcgagaacaaaacaacgcaacaaaacacaactgcgcacacactcggaccccaccacacgcaagacacaccggaacgcacagacagaacacaccgaaacacacaagatggatcaaaacacaggacaggaacaacaccaataataaggaagcaacgcccgacactaagccaccaccacaatcacgaccacgagaggacaccaccgggcaaatcagaaagaaaccacacgcggacgacaagcaagccacacagacacagaacaacaagcaacacagcccacgcaccccacagacgaccacacacaagagcacgagcaacaacaagcgcaagagggcagcagtacatgtcccaccacataggaccacacaagcgacaccagcacagagaaccgccgaacacacaagccaagaccgaacgcactaagccgacaacaaacgcaaaacacaataataagaccaccgaacacacagaaatcagcaagacacaaacacatgaactaagaacgctaaccaaatatacacaacaatatcgacgcatcaaatggtagatgagtggagaggcggaggagcgatcgggaagcagggaaggcggagagcaccgagcgggcggcggaggacggtggcagggcggacacggacaggtgcgggcgtgcgcgagagacaacacgaaccgggagcaggaagagcgacgcgcgaggagagcagggaggcagaagagagaagacagaggagggagaggagaaagggaacagatagtcgagagaggcgaccgagagcgcacggaagcaggagagaggagacgagaggcgagagaggggaagggcagagtgtgggg

SEQ ID NO: 505211 - DNA, 1114 bp, Homo sapiens
gcaaggcactttgaccatgtcaattttcagccgagacatggtcagcaaatgatcagtacaaccccatggcattaggctgcaaaccatatgcaacattgcatagcatttagtagtttaacaaactgtccagccagtttcatcatggttcccacctcacatcattcattgcacagcacacattcattttccgtctcagctacatccaattcagagcttcaatcagctattatcagtatcatatttcagcatatttgcaacagatgtattatcaacagagcattatcactattcatcagcgaccaggcacccatctattcatcgcacgctagcatattactagtatttatacgaaatcatcacatcaccatatcggtagtcatagtccaacagcacataacaattcagtaaaaattcagtcaacatgaaaaagactcttccgtacatcattatttccatgctaatgtgtgtctgtgatccagaataacttctcccactcatatcttcagttcacctaatgaaatgaatggatagcaaagagccctatagaacccaggactttaaggcaacatattacaacattattgccaaaattaagaatataatgtatggtatacaatgtacctgaataagacattacaaattaacctcaatcaacctaacactttgatctgacaagctgcataaagtatatcttgcagacagactagcaatctttaaacatcagcgtggcgctgtacacactgacatatgaaggtacttggagtcaggaggtgaaatagaacacagacgcaggcacaacaaggaaagcacctcaccagtggacaacaatcgacatactagacacaccatgcaccttggacagtaattgtaaaacacacaaatgatcacaaaaatacacacaaaaacgtgtttacacacggaaatataccagataatcactatgaacgagtaatgattactctagatatatacacaaaataaagacaggcaataaattaactacactaaagtggcaaatgcattaaacgaatattaatacaaattatgagtaagctaaaactgtgtatcaatgtaacttacaaagaaatatagagacacatagaagatcaaacag

SEQ ID NO: 505212 - DNA, 413 bp, Homo sapiens
tagaggactccccaactgcagcgcgcttttaacttatgtatttattttgtagagatagggtctcgctctgtcacccagactggagtgcagtggtgtaatcacggctcactgcagcctcagcctcctgagctcaagcaatccttacacctcagcctccctactagctgggattacaggcatgccaccatgcccagctaatttcttttattttaagtttttgcggggacgtgttgaaagaaaaaccttagccaaattaagcttaacaaagtttagttaagcaaagaatgctttgcgaatcaggcagcctcctaagccagggtagctcagagagactccagtgcagccacgcagtggaagatttatagacagaaaaaggaaagtaacatatagaaaacagaagtgaggtacagaaa

SEQ ID NO: 505213 - DNA, 180 bp, Homo sapiens
ttttttatttccccccccccccggctgattttggccccgggcccccaccaaaattggggggggggtcccccccccccaaaaatgggggggggtgtgggggggggcccccttggccccccccccccctttttcgggggaaaggggccccggggtttttttagtaaaaaatttttttgttta

SEQ ID NO: 505214 - DNA, 315 bp, Homo sapiens
aacccgggcaccgcctttgctcacatttcccgcctgagctccaccttctcagatcagcagcagcgttagattctcataggagaacacaccctgttgtgaaccgtgcatgtgacgggatcttggttgcgctgtccttatgagaatctaatacctattgatctgttactttctcccatcacgctcaggtgggaccatccagttgcaggaaaacaagcttaacacgcccactgattctacattatgggtctccctctgttgtccaaggctggagtgtactagtgctatcgcagctgactgcagcctccaccttccagg

SEQ ID NO: 505215 - DNA, 91 bp, Homo sapiens
ggagaacgccatcagctcgctgcttaaagggaaatgctgttgtgagagagaatgaggagagaactaggtaaggctgtgagagccatcagac

SEQ ID NO: 505216 - DNA, 81 bp, Homo sapiens
tctgaggacacggccgtgtattactgtgcgagagaggaatatgcagcatataaaaacccctttgactactggggccaagga

SEQ ID NO: 505217 - DNA, 1143 bp, Homo sapiens
gctccgggagctgccgacggacggagcgcccccgcccgcgccggggcgaccgcgcgacagtgcggcgatgcgccttctaccaagagccacaaggcagctgaagctgcgcttgctgcgtgccgaggacgagttccgccgacctgagtcgcccagcaaaaccacatggaccaaggtggctgacccccgagctgtacgcggagctgcgcgccaagagcacgccgagcggctacacggctggacgacgtcatccagacaggcgtggacaacccgggccacccgtacatcatgacctgagggctgcagtggcagggcagacgacggagtcctacgaagatgtacaaaggatctcatagacgacacccagtcatcagagggaccggcacggcaggcatacaaggcccaagcgatgagcacgagagaccggagcctacaagacccgacaacactgacagggacggagcgacagaaccttgagaaacccaaagcgtacagattgactagaagcatcagccgaggtgccgcaacaggagccggaagacactcacgtggaatatcttggcatcaccacccagcaacatgcagagcagaagagaaaaacagcaagagccaatcacgaggaagagccacagcagcgacagagaacagcccctaggaccccaagaccctgacacggagcgaacccagaggacagaaggcccagaaaaactaacgacagcaccaaagacagaaatagaccagcacagcgcacgtcaaccgaaaaaaaccaacaccaaaacagatacaaacatcaaccgaaaagaaaaaacgcaacagaagaacaacccaccagaatagagtgagacaacaaaacaaaagaccagaaaagggaaacaaaagcaagaagaaaaaaggacaacagacaaaaaaacaaacaagaagaaagaaaaacagaaaaagacaaaaaaggaacaaacaaaaaaacaatcacaaacaaaaaaagcaggacaaacaatagagaacaagacataaaatataaagacacacaagaataaaaaacaaagtaacaacagaggaaacaccacggacaccataacagaaagagaagagaaacaaaaaacggaaaaggaaacagagatcaaaaagaaacaacacacacaaaacaag

SEQ ID NO: 505218 - DNA, 651 bp, Homo sapiens
  misc_feature (348)..(348): n is a, c, g, or t
  misc_feature (353)..(353): n is a, c, g, or t
  misc_feature (359)..(359): n is a, c, g, or t
  misc_feature (361)..(361): n is a, c, g, or t
  misc_feature (366)..(366): n is a, c, g, or t
  misc_feature (373)..(374): n is a, c, g, or t
  misc_feature (386)..(387): n is a, c, g, or t
  misc_feature (389)..(389): n is a, c, g, or t
  misc_feature (394)..(394): n is a, c, g, or t
  misc_feature (401)..(402): n is a, c, g, or t
  misc_feature (404)..(404): n is a, c, g, or t
  misc_feature (426)..(426): n is a, c, g, or t
  misc_feature (452)..(452): n is a, c, g, or t
  misc_feature (473)..(473): n is a, c, g, or t
  misc_feature (475)..(475): n is a, c, g, or t
  misc_feature (534)..(534): n is a, c, g, or t
  misc_feature (539)..(539): n is a, c, g, or t
  misc_feature (546)..(547): n is a, c, g, or t
cccaggagcctccccaccagcccctgaaatggaaaggctccagctcctgagtcagtgggcacagaggagatgcctgaggatggagagcccgatgcagcagagctccgcggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagcatggggatntcggntcagtncnagctntcctctnnaactcttcagcnntntgttntgctggnncnatgaaggcagaaggtttagccnctgagaagccctcttcttcccaaccnctttccaggagaagggctgcncnctccaagccctactgtatgtgggagtcacactgcagtgccgacagtattagctcccgtnccaantgtgacnncagagggctggagcaagctatgaactgctcgactggggccaccccctaagactggtaccatatccttatacttacactgatctcaccacagaagacatcttgag

SEQ ID NO: 505219 - DNA, 371 bp, Homo sapiens
  misc_feature (12)..(12): n is a, c, g, or t
  misc_feature (28)..(28): n is a, c, g, or t
  misc_feature (243)..(243): n is a, c, g, or t
  misc_feature (346)..(346): n is a, c, g, or t
gaaacctgaatnacggagcagcaatatnttggtttttctgaggtagatctgtgctcaaattttctgttccagcagattcacaaggacagttatgcttgtcagatcctgtgttctgatttctggtactctgtgctctgccaaagggttgattcactcttgcccacatgttcctcaggcctagcgcatcagtagaccgttgataaatgtttgttgacagtaattgctactaatcatgcaacgcanttgagtttcaaaatgcactggccctcctgctaaagctgtcttcagaatctgtgtggtaagatcaccttttaatgaggtcagggtgttttctcttcagggcgtnattcaggtttcgggatcctctagat

SEQ ID NO: 505220 - DNA, 776 bp, Homo sapiens
agcggctctcgcgaaaggcgcaaggcgtggagtcgacggctggagagaagccgggagcgagcccaggcgggagtcttgattcccattgggtcagcagtcttatagggtctgtcagatactgcactgcaagaatggacagattgtctgggatctctgtctggatcagttttgtggcagtggtctgggataatgtcatccccagtggaggctctgaaaggtctggtggataagcttcaagcgttaaccggcaatgagggccgcgtgtctgtggaagaacatcaagcatgactgttgcaatctgcccacaaagaatcctagctttgacgattatcttgtcaggtttagtcccaggaagcaccattctgcacagtgctgaggatttgtggcgtgaaatcagcgcacggatacttgtggcctggtggatgtcttggtactgaaggagccaggtagagacagtctgtagattaacaatagctaaagtgaagacagcatctaagctgtgttcagacatgactctttctgggtgttgtggaagtgaaagagctgcagcgtgtgagcccctaaccctgaggaagtacagtctgtgcgagaacagcttggtcatgaaagtgacaactgatgtttgttcagatcacaggcaaataacaaagtctgaagggggttcttctaggcagcttaggctttccattcacccaagaagtcttctccttcagtgaaaacctgctgtggacctggtgctgccacgctgtggacctctcagcacacgatatggagga

SEQ ID NO: 505221 - DNA, 428 bp, Homo sapiens
  misc_feature (418)..(418): n is a, c, g, or t
accaaaaactgggatggggcccaacaaaatgttttaaccagcccttcggtggttacagaaggatagagccagaatagactaaccactgtaacaaacattacctatacttgggaggctttgaaaaatgtttatttagccgggtgcggtggctcacgcctgtaatcctagcactttgggaggccgaggtgggtagatcgcttgagctcaggagttcaagacgagcctgggcaacatggcaaatgccgtctctgcaaaaaatactaaaattagctggtcgcggtggcttctgcctgtgattccggctacttgggaggctgaggtgggagggattgcttaagcctgtgaggcagaggttgcagtgagccgagattgcgccattgcactctagcctgtgtgacagagcaagaccctgtctcanaaaaaaaaaa

SEQ ID NO: 505222 - DNA, 734 bp, Homo sapiens
gggtttccggaatatggcggggcgttggctcttgctgcagccagagctccaggtctcgtcttcatttctgtgtccttgttcttagaggcccagcctgtgtggccctgtgacccgcagatattgggagatacacagctaagactccaggaccccctggaagcctagaaatgatggagtcttgctctgtcgcccaggctggagtgcatggcaccatctcggctcacagcaacttccacctcccgggttcaagtgattctcctgcctcagctcctgagtagctgggactacagatgtgcaccaccacgcccagctaaatttttatttttttatttttagtagagaaagggtttcactgtgttagccaggatagtctcgatctcctgacatcgtgatctgcccacctcagccttccaaagtgctgggattacaggcatgagccatcgtgcccagccctgtattatatctttatctttatcaagtgtggtctaagtgagcattggtatgatttgggatcatggaattgtgctgaggatggtggtgttctgatggcgtggtcaatttagagtatgtgacacatggtgatgagaaagatatatatacctatgtgggttcagatgaagagttcctatttgtttattagaatgtttgggcagggtgagtaagtcgaaacgggaattccggcccaagggggattagaaataattatttaaggaaaacagtcccgttagggagac

SEQ ID NO: 505223 - DNA, 609 bp, Homo sapiens
ggccgcttcaatgctcagcactcacaacgatggtgttcatctgtgaactccgaggactacatgtaccgtcgcgggaccctcgtgccgggccaaggcaggtgcagctcgcctggtcctgctccggcacaccagcactttgaggagtgggacatggcggtgctggaggacaatgttgacggtggacggcggtctagcctggtgcaggactggctgatgggtgaggaggacgaggacatggtacgcctgcaagacgctgtgtgagacagtggcacgtgcacggtctgcccgtgtagccgtctaaccgcgtgcagtacagacgcctggccggtctcgcctctgagctccgcgcctctatgggacaccgggcgaggcgcctctcagagcacgagacgtgcccttcggccgttggttcgtgtcgcggggccgttttcgttgaacgacgtgagaggcatctcccgagacccacctctgctgtgcggacaggcgcaatccagggcaggacgcctgccccgtgggtcccggtcatcctgtgggcctgcatgtgtgccaagactgagtctacctgcgaaccgagccctgggggtcaggcccagcacaggggcgggtgga

SEQ ID NO: 505224 - DNA, 192 bp, Homo sapiens
ttttctggggtttttttttaggaaaaggggaaggggccaagggccaaaccatgccaatttttatggctgaagacggtccaaaactccctggagcgagaaaaccggttctgcccgaagccgaatgggagagcccaaaagggccccaaatgggcgcccttaatttttaaataaaaggggatgatggggttttga

SEQ ID NO: 505225 - DNA, 142 bp, Homo sapiens
tattaggcctgccttgtccggggtggccattgaggtcatggggtacacgcggtcagatcacacactcgtaattttccatgacatgaagtgtcgaaagaaaacctttgaattaatgaggaggaagaacaatgactgacgaact

SEQ ID NO: 505226 - DNA, 300 bp, Homo sapiens
ggacgccagctcgccgtcgtgcgcgacgcggatgatgcggtccgcgacgagttgccttgacccgctgtccaactcgggaagcgcagcgccgacgtcgatcatgtggccgcggcctgcgcaatgatcggcaatggcgtcgatccgcgcgggcacctcgccgggcgtcgcacagacgctgtaaccgcaacccgccagatggcacgcgatcagcaactcgaccgcgcgctgggaatcgtcgtcgacgaagaccagcacgtcgccggaatcgacaccggtgctgatgatctcggcgatccaccg

SEQ ID NO: 505227 - DNA, 368 bp, Homo sapiens
tcgatctagaggacccccactctgacgattactgtagcgatgttgctgtactgggaaggtggacctgtagcaatactgtcatctcctctgccatcatcttatcttccaggaccttctccccggcctgatcggaaatagtggggggactgcgagcggtagatcttagaccgaatgacgtacccgacgaccagtaatgcctctcctcagggctctcgtgcacccatgatcctctatcctggagcctgatctctgcgaagggcccctggtgctgcggctgcggtcccggctatagctccggctccgttgccagctgagggctgtggtgctacggcttctccgcttgcttagaatacgactacaactgctgc

SEQ ID NO: 505228 - DNA, 239 bp, Homo sapiens
ggtacctaaggtccttacacgaatgtagtgcgtactggtatctgctggcatgcagtggctgttatcgatttcgcccggtaacgcgctgggctggaaagacgccaactccaccgagttcgatcacaccagcgtgcatccggtcgtgggcctgatcaccgaggtgggaagacgccaccgtgcgccggttgaaaccccgtacctgaaacctccggacctggtgcgggcaccatggcgccctg

SEQ ID NO: 505229 - DNA, 118 bp, Homo sapiens
cgaagacaagtaggaatagtggagtgagctacacgtctacgtgtcggtagtacgatgtctagtgatgagtcgctactacaatgccagtcaggccacctacggtagtacccacagtagg

SEQ ID NO: 505230 - DNA, 165 bp, Homo sapiens
tttttcctgccacacgattcccttaaagtgctgcctctttcagtccgcatcttcgtcggtctggcagtcatcagcagggaaatgcatcgtggaacagggtacgtacagtacgcagcccggtgttgcagttgcggctgtcggtgggtgtggcattggccgtcgctg

SEQ ID NO: 505231 - DNA, 819 bp, Homo sapiens
ggtttccgggaagcggtactccaaatgggtcgcagtcgcagtcgttctccacggagggaacgtacgcgttcccggtccactatcccgggagagagaacgcaggtgcccgagtaaaggtccaggtctcgggatggccgaggagtcgggagaagtgagaccgtgcgtgatccccgcaccgaatacgctcccgatctctcaccgttattgacactaggactccacattttcgcattccccttctcgactggatcagaaagaccgagatgaggaatcgaaagaaactaagcacgaaagcaaaggcagcgaagatcggcgggataatcgtgagtgaatagacgttaatagggcctacaataccagaggaccgactgtagaaatgatgatagtcaatgggatttcgccgtcctttgacctcctgcaagcagtgtatgataggtggatggctctggccttgcctatgccagtaccttgtctctcagcaatgaggatagtcttggcatgtagcatgaatcgccctacggtggtattcagcagatctttggaatttcactcgtgtgaggaatgaaggtgcagacggactgcattaatctgccccctcaatcttgggtccgagtagtggcatttcggcctagcgaatttcaaacttgcgtttccgacactaccagggactctcaagcttcatccttccttgaaaggggtaagaaaaatcttacgtcctgataatatgcagttgacgtatcttgcgctagccaggaagaacggttgcacattttccctcttattcttctagggaaaatacactgggggacgggttacccc

SEQ ID NO: 505232 - DNA, 191 bp, Homo sapiens
cccaccctttctcacattcaatctctggacgctccaacttgtaggtagaagtactggaaaactgcttgcagacatttcctaccttttctatataattctgagtttctttaagctggtccatatgataatacacccaggcatagtttccccaagtgaccagacttcgtacttcttctttatccgagtgttcc

SEQ ID NO: 505233 - DNA, 387 bp, Homo sapiens
cctttgaccatgacagaaactgactgacctattcagtgatttcagagaactagacaccaagatgcaaggctcttcattttaaacatctttatttccataggtgattagcatttaaccatcaataggaagtgaaactcagggtgtgttgaattgctgtattaaaaaaaatgcaccaatcagaatagtttgtgttcaaatgaccaaaatttgttgaactataaatctgttttagttatttaaaaaagcaaaccactatgttaaattaagcttaatttttattgtattgcttataatttatttctgtcgagagaattcatatgcttatgtaaggatatcatttatacattgtgtatatatgtgtatatataaatacatgcattactgtct

SEQ ID NO: 505234 - DNA, 160 bp, Homo sapiens
cttttaagtctgcatagaggaattgttagaactttctttttttaatttaaacgccaagcaatggttatggatggaactaaatttcttttaaatgtatacaatttggcacagtgtctataacatgttcttgctcagcaattgtgagttatcatgaatggca

SEQ ID NO: 505235 - DNA, 160 bp, Homo sapiens
tatcattttccccctttcaggcatgtgcatttcaatgtttcatcagttcatcagcttcaattaggctcttggtgcttccagggctagcacagcatgtgtcatgcagtccattggttcatcagcagcagtctttgtcatgcaggcaggaggcggcaattcg

SEQ ID NO: 505236 - DNA, 179 bp, Homo sapiens
cacgaccttagtatgctatctacgtgccaaaaacttcagcaaatgcttataggcaatgtcattttgaagcaagccttgttacatgtgtgtcttggttggctggcagtcatgggacatatcatataagtaatgctagggtgagtggtaggaagttttttcatacggagggtaccgagctc

SEQ ID NO: 505237 - DNA, 631 bp, Homo sapiens
ctaagttgggttctcctctccccccttcacacccaccttctcatatcaatatcccagtagaggtggcggttatatattctctcaaaaatacaactcatcaatcttataacaacataataatgtagtaatatcctacagtatatacccccccccccgaagatgtattcctttcccccccactctcgtagagcccccccccccccccaacatcgttctctctaattaatataagaagaggtgcatttatattgcctcgctcccccacctctctctaatatgtagtaatatgggggttcctctcctaataaaatgataggattctccctcaccacatcatacaactccttctctggctatatatatcttcgttctaatctaatagataaccactcaacacacatctcgatactcttcatatacccacctctctatcaatagacgctttttccagcacgattattattctcaaatctcgctctcaatatatggcgtgagaccaaattgaatatataaacacacctcctatacaacctatctgtataagaagaatccattaatcacccgcacaccatatacatatggcatcatccactatttttgttgttaacaaccccacaatagatacacagaa

SEQ ID NO: 505238 - DNA, 134 bp, Homo sapiens
tgcatgttctccctacggaaattccatcagttcaaataagcgcataaatgccacccagttatgttaaaataatagaggttgttcagctgtgatggagaattgccggtcctcctctccttctgttatctttccta

SEQ ID NO: 505239 - DNA, 163 bp, Homo sapiens
ttcccccccccccccttttggggaaccctttttttccccctttgaaatcccctcggtgagggggggggcccccccccaggggttatccctgtttccccgggcgagtttggggcctggggggtggaaggggcccagtaaacgtttttggagggaaaaaccctta

SEQ ID NO: 505240 - DNA, 391 bp, Homo sapiens
  misc_feature (137)..(137): n is a, c, g, or t
  misc_feature (206)..(206): n is a, c, g, or t
  misc_feature (210)..(210): n is a, c, g, or t
  misc_feature (308)..(312): n is a, c, g, or t
  misc_feature (316)..(316): n is a, c, g, or t
  misc_feature (318)..(318): n is a, c, g, or t
  misc_feature (320)..(320): n is a, c, g, or t
gccagaaggctccatattctcaacatgtgcaggtcaatttgacataaagctaccaacaaggagcaacaggcccactgcaggctgtgtttataacttgaaaattatgagcaggtattgggagccacagactgtatttnggaaccagctgcatgtcaggacaagcatagattgtggtctgtggaggctgggagagcacaatgcttgantttnatttctttgggagataagaagaaaaaataccttcctacctgacaagattgacaacttgctaaatctgattatcttcagaagtgtgctggacagttgcnnnnnaacntntncttttcaagatgatgatcaggaacatctctacgagggaccgatttaggggagagctagctttcctggcagg

SEQ ID NO: 505241 - DNA, 174 bp, Homo sapiens
  misc_feature (34)..(34): n is a, c, g, or t
gtttatacactcatgagcacatgcctcattctangtaccttttcatgcagtcagtacatattatacatttatgcctacatgttttcatgcattcatgagcacattttatacattcatgtcatgtataaatacactcatgagcacatgtattcattctcgagcccgtctatttat

SEQ ID NO: 505242 - DNA, 318 bp, Homo sapiens
  misc_feature (23)..(23): n is a, c, g, or t
  misc_feature (88)..(88): n is a, c, g, or t
  misc_feature (93)..(93): n is a, c, g, or t
  misc_feature (120)..(120): n is a, c, g, or t
  misc_feature (128)..(128): n is a, c, g, or t
  misc_feature (211)..(211): n is a, c, g, or t
  misc_feature (216)..(217): n is a, c, g, or t
tcccacccaacttcacgccgggnaaagtcccagtgcttgtatgcgcaaacagtggcgctgttcaaaccttgcaggctgaccattgccngcccntcggcgtttttgcccagccacagttcncccacggnctgccagcgggccctcagcgcatcgtcaatcgattgcccgggcaaggcttgcagtttgcgccagctcggcttgcagggcgctnttcgnnacgcccagctccagcagcggctgccagtgctgtggcaagacgttgagggcggcgcgtacctgctgttgctcgacgggcaggctgaccagttggttgagggc

SEQ ID NO: 505243 - DNA, 252 bp, Homo sapiens
  misc_feature (49)..(49): n is a, c, g, or t
  misc_feature (57)..(57): n is a, c, g, or t
  misc_feature (117)..(117): n is a, c, g, or t
  misc_feature (162)..(162): n is a, c, g, or t
taataccatattgtatgtaatccatctggcctcctaagtacctatgccntgtgtaancccattgttttccataatcatattagtatttcctattatagggataatgaattagagttncaagatgaaacagtcgaacttatttataaacagagaactgaatgnttttaggatttttagggtagtgaaactactcttatgttaatatattggtgggtacatgtcattataaatttgtccaaactcatagaatat

SEQ ID NO: 505244 - DNA, 390 bp, Homo sapiens
  misc_feature (337)..(337): n is a, c, g, or t
aactgctgaaaaggaagccgtccctggatgatctgaaagagctgatgccagccgtcgggagaagcatgcagcaattgctggactatccagaagatgacatagaggaaacattttgtctaaactttaccgatcacagttgagaacttcggtgcaacagaagtaaaagagctggttctgaacggggcagacactgctgttaatagacagaatcggcaggagtttgttgatgcctatgtggattacatattcaataaatcagtggcatctttatttgatgctttccatgcgggctttcataaggtctgtggaggaaaagttcttctgctcttccagcctnatgaattacaagctatggttattgggaatacaaattatgattcggaaagaact

SEQ ID NO: 505245 - DNA, 108 bp, Homo sapiens
  misc_feature (7)..(7): n is a, c, g, or t
gactctncacgcgcgcgggttccaaggtacctgtgtgctttgattgggtctgagggccaatctttctgtggcccgccctgtgcggccaattccggtgggcttaaaaca

SEQ ID NO: 505246 - DNA, 390 bp, Homo sapiens
gtggtctccttaatcttctccaagaaggggtacagcaggcgcagcagctgcaacacacgctcctctcgccgtgactcagtgaggcaggcgtcgttcatgacgaggtatgggtaaatcttgccattgagtcaccggatgtacagccgccgggctgcggaatatgtgcttctgcacaatctctacccggggcatgaaccgtgcaatcttgatgtaataatgcgtaggcattaggcatcagaaactccccaggaatatccacttcagctgtctgtgacgagaaattgctcaagaaccggcaatattcctctatagaggaagaataaggggagttgcttggtcttggcctccaagattttgatccactattacaacttaagaaattaagataat

SEQ ID NO: 505247 - DNA, 291 bp, Homo sapiens
aaaagcctgaaacttttttgtaaaaaaaaaaaaaaaaagaaaatgaaaaaccctttaaaaccctgagctggctgggggggtcgtcaaaaatcaaaaggaccgggaaaaggctcggtaacccaggttggggaaaacatccacccggcaactgttgcctgcaactgtcaggaccttgcactcaggcccggcaggctgttggttgaggctgaggctgaacacccctggggaggaaccaggcacctgggccttcaattccccgctcagctgccactggttgacgcaacggccctg

SEQ ID NO: 505248 - DNA, 122 bp, Homo sapiens
  misc_feature (71)..(71): n is a, c, g, or t
  misc_feature (95)..(95): n is a, c, g, or t
ttcactgttgagtggtaatagcgtagtaagtaagtaggagtgatgtgctatatggggatatagctatgttntgtatctcgatatgccattggcanagcgtagcgtggcgcctctaggagaga

SEQ ID NO: 505249 - DNA, 292 bp, Homo sapiens
  misc_feature (37)..(39): n is a, c, g, or t
  misc_feature (118)..(119): n is a, c, g, or t
  misc_feature (156)..(156): n is a, c, g, or t
  misc_feature (159)..(159): n is a, c, g, or t
ggcaagagaaaaagaataaatgtaagaaagagggggnnngagtctgagggagctacgactgacactgtcgatggatgatggaaacataagactatcaagaaatccaagctggtaattnnccaaaggggatgtgggcgtccgacaataaacttatcntanttggggaaacgggtgttccgaataatatcctggaagttatcaggacacctattttaaatataggcctgaattttgtaaagtaatatttaaggtggtccgtgataattaaataaaatgcttaatgggggtggct

SEQ ID NO: 505250 - DNA, 363 bp, Homo sapiens
ggaaaagcaggagagatattctgcatcagtttgcagttcactgcaaatcttttacattaaggcaaagattgaaaacatgcttaaccactagcaatcaagccacaggccttatttcatatgtgtcctcaactgtacaatgacctattctcatgagaaatggctaaagagattatattttgttctattgctagggtaaaataaatacatttgtgtccactgaaatatattgtcattaaatattttaagggtaggaaatattgtgaaagctctggttgcacatgttatgaatgtttttctacacttgtcatgggagtctactcatttcactctttccactgtatacagtgttctgctttgacaagt

SEQ ID NO: 505251 - DNA, 931 bp, Homo sapiens
gcgcgccgtaagtggtctcgacacgtggactagccgggttgtataggagagcgcggagtgacgtgtgccgtgctgtgtaggggataaccaatggacacccagtaaggagttacaaactccaaaagcagacacaccacatgatatagtatctgtgagcgcagtgtcgcacagaagaagtgaactaaaatctagggatccaatcagatgcagagaatgtggaattgtcacctactgtacaagaaagggactaaagagatgtgtcgattagatgctcgatgaatgctggaattcagaaggaatgtcttcaccttatactgtggattggtctcttcccatcctgatgtggtatagctgtcgatttcgcttacagtagttccgccttatcttcgggagatacattccaaggcccccagtgaattcctgaaacctcaaaacagtaccaaacgcttaatacactgttttttccatatatatagtacctatgataaagtataatgtataaattaagcatagcgaagagatttcggtaataattgtcatagaacaatgataacatactatataaagttatgtgactgtggttggcctctcttggtgtcaaaaatattttctgtacagtactcacctattttagactgtggttgactacggttaaccataacaagagtgggcactttgtgcgggggccctatgtcttaggatacagtatatcctatgattcatttaagaccaacaaaatgcgcccagagaaacttcgttaggacccttggggccacggccctggtgagggttgtactacccgccaggggggtgtccccaccctttgacaaaactcgggtgtacagggtgaacccggtggaaattgtcgcaaaaacaaagcgccgccaacataggggagaaacacgtgtaaactatagtcaacacagtataa

SEQ ID NO: 505252 - DNA, 811 bp, Homo sapiens
ttgacgataggtctccttctttgtgcttttgtcgtgtaggtggactgtgtgtgtgtgctcgtcagtttccgtgtcccgggtgtgtttcgtcttagtgttggtggtgctaggagatatcgtaaccttgggagcgtcccctggcgttagctcgcccgattctttaaactccctttagggctctttttctccccccgttgtgtctggtcccccgatcctttggtgggcaacgcccgctaatcttgctggccacacctttaagagttttcctgtgtccggtcccgcactatagcgcggtttttctcccctctcccccgggcgtttttttttttgccgacattttacaggcgtcggttcttcctctattttccgacgttcccatcccgccttaggcgtccgagaggagcgcgctgggaatgttcggaccacgaagccaagccccgtggaccaatcccgggccagccccaaaagagaagttggtcccaaggccaaattctgggaccaacctccaaaaacgtagtccttgtttgacaaaggtacctatgagtaactctgtaaggaggtccccactattaacttatgacccccgctgtggtctttgagagactgaagattcgaggcttccttgcccacggcagcccttcacggagctccctaagttaaggacttatccaactggtttccaagcacccgagctccagttaaagttacaccccgaaaataccccagggtggagaatgctcccactgctggtgaaaaagcctggataggtcccacccactggacatttgggaaaattaaactttatttaatc

SEQ ID NO: 505253 - DNA, 1201 bp, Homo sapiens
gctcatttgcagccccccatgctgcatggtacagcgagcaggcatcatcgagatgcgagaggaggcggcactggggagatccgcagagccatctacaggccggatcccagacagcctgaataactgtgtcaataaggaccatctgacagacgccatccactgggccagtcatggaccccgttcgtcgtgcacccttgtagctcaattggggcctgccttatcaggtacccttccgggcgtggtgggcgtggtccctctcgtggcatcccagctgctgtggaagtgtatcggacgcaccatgggaccagtgtacccatgatccctactggacatgaccctccttgtggcccaacgcacagctctcctacatggcactcgctatactccatggaaactaaaccctggtcagaaggccccgatgacaggaattagtaggaacaacagacacaagtggaacacaagataagttgacgcccctgggagagcgcaaatctcttactaaaggcagagtcgcccgctcccgcctgggtggcacgtacgggggcaacagcgataaacacggcggtcttgaacccattaacagtaggtcgttgggaccgcgcagagtgccactatcgttcccagtacgggctcagaacacatccatagggccaaaccttcgagcacggacgcgacataggagcacccccgaaagcaccctagctctcacatgggcaaccgcacaccgatcctgccgttgagggacaaacaccagccatgagacgcaactggcggaaagatcacgtggattagaatcagaagaaccaacccctcgcaaccgcttagaccgcactagacagacactccacgacaccgccataagctgtttctcagcacacacaggacgcgatacaacacataacgacgcttgcaggaccaataactaagaaagcctccaacgcacaacctacatctctaccatccacccccataacaacacgcctcacactcaacatgcttatcaaacttcaccaaaaacatacatcataatcaacaccaccttcaccctaccagctgacaactccattcacaaacagcaactaacaacacacccctgctcacacacaccacacccatacagcacacaaacacaccaataaacacccagtaaactcactataatcgacatcacctccacatgtatatgcaccaagctatatca

SEQ ID NO: 505254 - DNA, 155 bp, Homo sapiens
cagttgtacttgtactctcctttctcctttcttcccctttctctgcccgccatccccttgactggggtttccactaatacggcatgccggctggggaacttaagttgccgcccgttcccggccccctttacacttgcgcccgctcacaccaaaca

SEQ ID NO: 505255 - DNA, 117 bp, Homo sapiens
tctagaggatccctttctctgatcgctcactgaaaccctgtgcaaggcaggtggttagtggccccagtttgtagacaaggaagccgggtgtggtggctcacacctgtattctcagta

SEQ ID NO: 505256 - DNA, 151 bp, Homo sapiens
cggcccgtaatttggctgtatcgacccattccatttctcttatctagacagtgagataactcagagagggcgggagatttcgcgatccaaatgatagactaggtgatatatccaataagcttgtttcttaaggatttcatttaagatttct

SEQ ID NO: 505257 - DNA, 183 bp, Homo sapiens
gatgcatcagaggatccggacgaggtgatggagacttgctcacaccttcctgggaatcacggtcttggccccagacccagagaaggcgccttcgatgccatggacgggaccagacgacgggtaccgccatcggtgcatgacggatgtctatccttgttggctgtgcaggacggactctgcgcc

SEQ ID NO: 505258 - DNA, 523 bp, Homo sapiens
gatacagcgaggcggtggcccttatgtgggtagagggagtctgcgggatataccaaggcagatgagaccatatccatgaggagcctctgagcccaggtattgatgctgagcgcctgactggcggagagcgctaaccctgagacaacggcgcccgacaacatgcaagtgcaggaaaacttgaatatcacttggacatatgggaagtggtacaaccagtgcaacggtatcacctggccctggctgtacaacataatggactggaagacagtgagcaccctggtgctgctagagggcgctacataggctcataacagtatgaccagcacttgaagggggtaaaggttcctgagaagagaccactttagcttatatgagacatatacatgatggaaggtatgtataatacatcaaatgaagacaaacatgagttctaaggggtcacaacaacttgagaaggaacccctttcttgacaccaacctccatatgggccgcatttctggcaagcttggcgggggccgtggg

SEQ ID NO: 505259 - DNA, 1229 bp, Homo sapiens
atcccatgagtcacagctatcctctgtctttaagaatgactgttttatagcttacatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaatgtgtctagagtctttcttcatggggtctaggtagtcttctgagcccacaggggtctggccagtgaacaccagaggagtgccttcctatcagtcagccccttcttccagagggctgtggaggccccagtggccaaactcggctctgttttccctttctggctgttgggggagagggcacctgtaagtgatccctgtggaatgaagtagaaaatcctgccagttttccgctctcctctccctcagtacaggctgaatcattccccaccacagatagatcccagggttgtggtagagtactgatataaatgtcccaacccccccattctgagacctccggacccctccaaagcagacatgggaatgtagggctgtgggatatggcagggtgaactccagcttcacgggagccctaagggttatgaagagacaacttggggcagaaacaagtgtggagtctaatctcaagggtgaaggacaggaaat

SEQ ID NO: 505260 - DNA, 348 bp, Homo sapiens
cacacttcaagtacaggtttataattcaagtcaagtgcttcgctccccacacttaaaattagatgggtaggagaagcagatgacatgccggtcaggtagctgtccacattccatgcgatatggcatgtggtgaggacaccaatcacatcagggagaggaaagatggtctggccagagaataaccagaccggagcctgtactaggggggaggtgctatatacgcaagggtcagttctattttacacgacgtgatgtcccatccacaccagaaatacagcatcgattacctggtccgggcctaggctaggacggaacgggaccgatcggggtgtgaatcagttcagcttc

SEQ ID NO: 505261 - DNA, 376 bp, Homo sapiens
ccttggctggccgctgggggggcctctccgcgcgcctccctggccgggccgggactccgccttcgccgtcgcccgggaggcccgggcgctccccgtcgccggcacgttgtccgagcattacccgccgtcagcggccgggcgcccagcgtgtgtctgccttttttcctcccgccgccttctcagctctcggaaaggtcagaggccaccgcctctgaccaaccggcgccggcacatctaggccctctctccctgtctggcgcggcggggaaacgcgccgcctcggggctcaccactcgagtcatctttgggagctctcgcagcgctgcccgcgcggtttaacgcccgcctgtggagggtatccccagctcgcgggctc

SEQ ID NO: 505262 - DNA, 411 bp, Homo sapiens
gtcccattattattgacagattgcaactaagagatgtcctcattgttctcttggtgtgttcacagagtcattaccagctccagctgtgccctggtgcagactgccccatggttattcgggtacaggagcctagagctcgccgagtacagtgcaatcggtgcaacgaggtcttctggtaagagtgagtgtgagtgctgagcagccctgggctcatgccccatcctccaaagcaccactgctgttgctccatgtgagggcggcactggaagaggcagggtctctgagccaacagaacagctgtgctccaagtgggtaggtttatgtccagcatctcatattccactaggtcttcaatacatgctcagtctggaggcaaggaagtgacacaggctcttggaaaatgtgttgtgg

SEQ ID NO: 505263 - DNA, 166 bp, Homo sapiens
cgagattccactttctcctggagatgctggataacgccttcttatcagctttaggcaagttcttgcgtgacgttctgcctcttcccattctctcatgagcgggacattctctctcgggctggcctcaagcctctctttggctttccgaaaacggcatcttcatcgg

SEQ ID NO: 505264 - DNA, 377 bp, Homo sapiens
  misc_feature (15)..(15): n is a, c, g, or t
  misc_feature (25)..(25): n is a, c, g, or t
  misc_feature (58)..(58): n is a, c, g, or t
tatttatttggtccntaaaagggantaaagtactgatacatgctacaagatagatganccttgaaggcaagtaaaagaagccagacacaaaaggccacatactgtatgaactcatttatatgaaatttccaaaacaggcaaatccataaagacagaaagcaaatttgtggttgccagggacttggggaggaagaatggggagtgactgctaatgagtataggatttccttttgagtgataaaaatgttctaagattagatggcagtgatggttgcacaactctgtaaatatattacaaacaatgcattgtacactttcaaagggtagatttcattgcacgtgaactatatatttcaataaatctgtcacaaaaaagt

SEQ ID NO: 505265 - DNA, 407 bp, Homo sapiens
ttgttggcttggataaaaggaaaattttgaacatgggaccctgacttaatgaatatttgaatgtttttcttttccaattttaagtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacggtgagttccaagcttggtgtgtaaggcccagtggcactttcttgtggttgggtctccgttactatttaagtgagtacttctgccatgaaatgacaaaacatagaagaacctcagtcacttaacagtcacagt

SEQ ID NO: 505266 - DNA, 1353 bp, Homo sapiens
cgggcctcgacgggggcttgcacacggggggtgaggctgctatctgggtggagaccttctttgccggcagtttcgcccgctcgtgtgccgcctcccccgtgaagtttgctgggttttcgttgggagaccaccctcttggtttctttgcctgacccaggggccagccccgagtgtgccgagcactttatggggggtttcccacaagtttctccttggaggaaaccttgggtgccccggaggggcacccacaaaggcgccctgggataaaagaggagtagccacttggcaaaaaggggcgtcccaaaaacaccaagggttggctccagcaaaacccttttggggaaccccttggggtggcttctgcgcacctggggcgtgcacaaaaggggaaattttacgcctttctccgaaccctttccccacccaggcgcgtatctgcgttagagtagaaaatgggtgcgcgcccccccctttgtgggggaaattccaccccgggttttctaaggagccttgcgagaggttattgcccccgacccaattgacaaatcgggaggccccgttttctaacccaccacagggcacattggggggaagccattcccctgagaagggtggacacacctgcgcctatggacctctccccctggtgtcccagccattatgaacccacaagggtgataaagaccggtatgaaaagagaggcttcgtcgggagcctcacttcgctttgggtatatataatggagaagtctccaaagcggtgtataacagggtctttatagagtgggcctctcacttcgctggtgtatagcacacacaccacggagagaactcgggtggtgccacacaagtggagaccctcccacaccctccaacatgccccctgggcccaccccgccacacaggaccgggcacaagcctgcacgccttctcggagaattgagatcccctgagccgagtatcttatcctattctctcccgagcccttctcctataagcccgctggagaagagattgtatattcccacagagatgctatgcttatagagaggtcacaagtacacagtctcctccacatgagagaacactatggcctacaatcacacattaagagtctatgagaattgtgagaaaaatgtgtgcccctctgtcacccttgttttgttgccctaaataagcacatctgaaatgtttggttggtggggcgggtttctgaagcacaatgagagaaaatgcccctattataggaaggaattaacttgaagccctggaaggtccaaaggctgaaggtgaagcccactgagattactcccctgcactccagcctgggccacagagcccgggcctgtatcca

SEQ ID NO: 505267 - DNA, 110 bp, Homo sapiens
cgtagcggaccaggctgcgttcttctggggttctgaaaagcagctcctctagctatttcaacttatgtccctaatatttaaaacataaagataggttgaggttgaagtct

SEQ ID NO: 505268 - DNA, 90 bp, Homo sapiens
catcctggtgtaggagtttggtgctagctattgtaaggaaaagggaccttccagaaagcatcgtgaggaaataaatggcctgcgcaagga

SEQ ID NO: 505269 - DNA, 320 bp, Homo sapiens
  misc_feature (260)..(260): n is a, c, g, or t
  misc_feature (306)..(306): n is a, c, g, or t
ttgttggcttggataaaaggaaaattttgaacatgggaccctgacttaatgaatatttgaatgtttttcttttccaattttaagtttcaagtgtcgtcagatgtatcacgcacccacagactgtgccacaatccggaaatggctcacgaagtgtgcagacgactctgaaacagccaactacattagtgctcacactaaagacgtaaggaccgtattttacctctcatggatttgccctccttagtgctgcccagggcctngccttggagatttgccatctgagagcagaatacccagagccccagnacccttcctgagga

SEQ ID NO: 505270 - DNA, 964 bp, Homo sapiens
ggcagacactgaccttcagcgcctcggtccagcgccatggtgccctccaggaagtgcttcgttgggggaaactgtagatgaacgggcggaagcagagtcctggggggagctcatcggccactctgaacgcggcatacggtcgccgcggcgaccccgaggtggggttgggtgttcccccgtattgcctatattctgattcgcccgggaaagaaagcttgaggatcccagaagattgctgtggttgccgcaagaattgctacaaaaggttgaactaaatggggcttttacgtggggcggagatcagccccttggcttgatcaaaaggattggcggaggccagcgtgttttgctcctgggcgcactcagacgcagaatgtgcatggtctgcggagagaagtcaggatagaagctgtagtgggggcagaaaaagggtggggcgcatgtcttcgtggcgcacgcacgggaactcggaaatttaactcggccatggaatggggggagaagggctatatgacaggggaagcttggccatcacctgaagaagtgttgtttccgacgcaagaaccaaaggtcaatccgcagataaccgtgaaggcgtggagccaggtcgtcgtgccttaatgagcctggttgttggcccattgtgttacgtggcaaagatttggaacaccccaaaggcccagggatgacacagaaaagtccggcgggatggtagagtccaacgtctcagaagcgggggtcaagagcacacgatcatttatggagggcttgtgactggcgcacttggatgagttgcacccgcctgggtgtgggacgctcctttgtgggggggttcccccaaagccgaattcgtgcttatattgaacaaagagccatattttcctacctttgcgagcggataaacgaaacaagatgctcctggataatgagagacggctcggggccaaagttcttggataccgag

SEQ ID NO: 505271 - DNA, 4095 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 505272 - DNA, 4394 bp, Homo sapiens
tgaccagatagcggctgagaaacaatggttatctgctccactgacgccaggatgtcttctccgtgcccgatcccggagtacaaacagtgaaatgagaagccggtgagaaacgcgctggttaaaaacatctcgacgggagacgctggtaggcgaatagtggctccagacgcggtcggcgcctgccgtaccctggtcagactctgggtcagagcgctaagtttcaaggaggcggcgctaaacaggccctctagccgggagcctgtcgcgacccgagcgaccgtgggtcgaccccgatccggaagtgacgcaacggcgccaagcacttccggagctgtggggacgactcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 505273 - DNA, 250 bp, Homo sapiens
ttttattttttgggggaaaaagaggggcccttccctgcctaaatcccttcctgggggggatcaccattatttaatgttttttaaatcaggcctttttttaaaaggagggctataaaccttggactttaaaaaacttatttttttattcccccccgggggccattggcagattaaaaaaagggaacttcataattttttccccaacccccaaggttttttttaaaaaataaaattaaaaatggaaagggga

SEQ ID NO: 505274 - DNA, 4584 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattataaaaatgtgtctagagtctttcttcatggggtctaggtagtcttctgagcccacaggggtctggccagtgaacaccagaggagtgccttcctatcagtcagccccttcttccagagggctgtggaggccccagtggccaaactcggctctgttttccctttctggctgttgggggagagggcacctgtaagtgatccctgtggaatgaagtagaaaatcctgccagttttccgctctcctctccctcagtacaggctgaatcattccccaccacagatagatcccagggttgtggtagagtactgatataaatgtcccaacccccccattctgagacctccggacccctccaaagcagacatgggaatgtagggctgtgggatatggcagggtgaactccagcttcacgggagccctaagggttatgaagagacaacttggggcagaaacaagtgtggagtctaatctcaagggtgaaggacaggaaat

SEQ ID NO: 505275 - DNA, 437 bp, Homo sapiens
  misc_feature (66)..(66): n is a, c, g, or t
  misc_feature (184)..(184): n is a, c, g, or t
  misc_feature (387)..(387): n is a, c, g, or t
  misc_feature (433)..(437): n is a, c, g, or t
aaccatggggtggggctgcaataaagtctccggaatggcccggccaccttcctgaaagcagggccntggccccacccaaaggtccctggggcaggcgggcacccgtcattcggctgccattggcttcctcagatgtatttcaaggactaaagtgggctcctaagatctaagatggcccggcgcnggttgtcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattngccactgcactccagcctgagcaacaaaagcaaaactctatctctnnnnn

SEQ ID NO: 505276 - DNA, 793 bp, Homo sapiens
  misc_feature (793)..(793): n is a, c, g, or t
caacgactgtctcttctggttcacaatgtttctgtaatgcatcaatgtctctggactaacatgccatagatgatgagcattggaaagccctgatccatcgaaatgagcacctagctttcggagtctactatataagtgtgctttctgattatcaatgagtgaagactatgttgagaagattctgatatacccagatataccactatgaatgcaggattccattgtttgaataggctagtactcaacattttgttagtttctccacggagagaggccttagtgtggtcctcgcaattccttctgtaattaaattccccaggggggcctaaattactttggaatcgaaaaggtttttccccattccaacgttgccaaattgttgtttaaaggttttctctaagagaacctcggaacacttggaattggctcgtaattttggagggcaaaccaactttcctttggcggtgatatatcccccaagggaatttccctttataccgttgggaccgataatgcggcccgaacaggagttccgacgatcgaaactccgcgcgctttagagaggttttttcttcacacttgttgaagcgccatattttggggatacccgcccggtgggccaaaccaaaaaggagagcggcccgattccctttccgatatctttttatatccctttgtgggggcgataaattatctcccaatttgtgggggctttttgaaccaaaccttagggggtgtaagttttgggaggtgggcccataccgaacacgagaaagaaacccccgctttccgn

SEQ ID NO: 505277 - DNA, 129 bp, Homo sapiens
  misc_feature (124)..(124): n is a, c, g, or t
gcttcttttagattttttgtgtttgtgtctcctgtgactatctccttcttcactttcatggcgacgtctactattacttcgagaagacttatgtctggtttcctctttctcccttctgtcgtcntctcg

SEQ ID NO: 505278 - DNA, 4232 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctggtaagagtgagtgtgagtgctgagcagccctgggctcatgccccatcctccaaagcaccactgctgttgctccatgtgagggcggcactggaagaggcagggtctctgagccaacagaacagctgtgctccaagtggtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggggagctaactgtgaatgaggagagtacctgctgcaggacctggaggtcaggtgtgaatgctgtattggcacagggaataaatatcctggcgtctggagccttcacctctccgtcaagtccttcctgtgatactgccatggcacaggatctgagttgcagctctgcaccctaaatcacaccctgggcattgtctgggctgcagggctgccaggttctgtacttgtgtccagctgtggccctggatgctggagctggagggttttctgtgctcagactgtagcctgtagctcttggcctgtgtagagccccctcctgtgccctcagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 505279 - DNA, 3768 bp, Homo sapiens
  misc_feature (22)..(22): n is a, c, g, or t
  misc_feature (29)..(32): n is a, c, g, or t
  misc_feature (34)..(34): n is a, c, g, or t
  misc_feature (36)..(37): n is a, c, g, or t
caaataaggctaggtacgaggnctgggtnnnnantnnggcacgaggcttctggaggaagcagcgcgggcttgaccggcgtcggcccgccgcctccgctgccgcttcgccccaatccggtccctctggcccggcctgacccggtctggcttgttcgggctcagcggccgcgaggccgcagctcccgatggaaatcatattatgtagaatacttgggtgacatctgcctgagagatctccaagaattacagaagacaaaaatactaatgcatttgagaaagcggtagttttggggggagggggaaaaagcaactgctttcctgatctgcaacttggctggatgctaagatgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggtatctcattcagttgctaaacttatattagttaatttccactggcaagtttcagagatattggacagatacaagtccaattctgctcaactgcttgttgaggctcgagttcagcctaatccatcaaaacatgttcccacatcccatccccctcaccactgtgcagtgtgtatgcagtttgtgcgaaaggaaaacctactctctctggcctgtcagcaccagttttgccgcagctgctgggagcagcactgctcagttctcgtcaaggacggcgtgggcgtgggagtctcttgcatggctcaggactgtccactccgtacaccagaggactttgtgtttccattgcttcccaatgaagaattgagagagaaatacaggcgctacctcttcagggactatgtggagagtcattaccagctccagctgtgccctggtgcagactgccccatggttattcgggtacaggagcctagagctcgccgagtacagtgcaatcggtgcaacgaggtcttctgtttcaagtgtcgtcagatgtatcacgcacccacagactgtgccacaatccggaaatggctcacgaagtgtgcagacgactctgaaacagccaactacattagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacacctacccatatgcatattacatggagtccggacccaggaagaagctgtttgaataccagcaggctcagctggaggctgagatcgaaaacctctcatggaaagtggagcgtgcagacagctatgacagaggggacttggagaaccagatgcatatagcggagcagcggaggagaaccctgctgaaagatttccatgacacctaagttgggatgtggatgtgccggggtgaggaagatgtggctgcaaggtctcccggctgccatactgcatgctgcaggctctgcctttcatgaccccaggcaacagccagggccccactcctgagagacactggcaacacctcttagttgatttctgttttcttctcttttcactttttgtttctaccagggtagaggccatgttgaactggcctcttttcaggacttttatttccccctggatggttgttgggagggagggaaagtgttttctgaatggctattaatagtattagatcattacaacttatgtaactttcaaaggttgtacaattatacaaaaaaaaaaaaaaaggcaaactataggataacacagagccctttttgaaaataaattggcattggagtgttttaccctctagctgttttacttagaatgtaacatatgctgcctacccacctcaaaatgtctgtactgcaagagggccctgggcctctgctttccatattcacgtttggccagagttgtagtcccaaagaagagcatgggtggcagatggtagggaattgaactggcctgtgcaatgggcatggagcacaaggggtcacagcatgcctcctgccttaccgtggcagtacggagacagtccagaacatggtcttcttgccacggggtgttgttgtctctggtggtgctgcatgtctgtggctcacctttattcttgaaactgaggtttacctggatctggctactgaggctagagcccacagcagaatggggttgggcctgtggccccccaaactagggggtgtgggttcatcacagtgttgccttttgtctcctaaagatagggatctacttttgaagggaattgttcctcccaaataaatttgctttaccttggtcctttcttttgtgccagtattcaagtggtatagctctgagcagggtcacatttggccaaacctgacactgtcttgctgcattctcctttggcaaacatcagggtcagaattcaggatagcccttcctagggcactggactttctggcatgggggctgtgtttgcacaagttattttcatgttacctggagagtgtccagaggctgctctgaggctgaggtgtgttcccccttgcctggttccagctgtcagagggataccatcctagggtctgggaatccaaggccacgagactccttggtttgtggtccgagatcctgtactaaggagggtctggccagaggaacagaccagcttttgcacaatgaagcgcaagggaacaagtggtttgcctggtgtcctacctgtcctgaacctggtcctgtgggccattgaaaagttagatctgtgatctctggggtttttgtggctttgttcaatgcttccactctagggcaggcagagcagtctatactctcccaagcctgcttgacctccaagtagagctgatacagagatctgtgaatattgtgatagaaattctttggtattcatacatttcagctgcaagtcagcaatttcccaggtaccatgtaagctataaaacagtcattcttaaagacagaggatagctgtgactcatgggatcatgaggtccatggctggttgcaggttccctttttccttcctcaggttttgtctcttcctgtgttgtccccagcaagggagagactgtggggtggattgggagaacagattaggagtatagcaaatgaacccagaatggaacagtggctgtcgtttgttaacatcatcaggaagatgggaaaggtcaggcagaatttttctgccctacaaagggtggaagagaaaggacacagtattttcatgaatttaccatatatctttgtttttcttcaacgaaaaagttaattgaggcaatgtcatctgctcaaagttgagtggtttattcacaataaactgtaagtttctgattat

SEQ ID NO: 505280 - DNA, 124 bp, Homo sapiens
acctcccaccccacctcatgccaagtgggcgtgtgtcctgacagagaacagtcacactgggcctgcgggcacatatagcagcatattttgctcttaaccccacccacctttttaatcacactag

SEQ ID NO: 505281 - DNA, 927 bp, Homo sapiens
aaacgctacgtggtctaagaacactggatcagtgctgtctacctggggtctctcaaagacacatgtgtcctgtcccctgcaactgctggcagtagcagcagctgacatctgcccctctgaccccccagtaaaaaaagaacacacacatcccagagaaacatgatccatgcacgaggaatctgagaccgacgtgatattatcttgtacattgacgtgaaaggtcagcgtgaagcgacaagacaggaaattgtgaaatacacaagaacaagctacagcacaagcattttgcagatgcttgatcaagacaacagcatattgaaatacacccacaacatgcgcacacaactgcctagggcgacaagagcaccctatagtccaacaaataatttagcccaacaactgtgataacagaaatgaccacactctaagtgcccccacgattcgcaagctcacacaacatttatgcctgcaatacacaagcccgattggacaacttcgacaaccagaatagagcatactaatcatacaagcacacaaggacaagcgaagatatgacctcaaacatacacacaactctgcgtcaacgacatcacaaggcacttctcttgttgtaagcccacgctagggcagagaacaacgacgatggcgcttcagaccatggcaaaaacaaaaaatcacaaaacaaacagaatagtagagcaaccatatagaatatttaataaagatagaacgacctatagtccacaatagaactccaagcaacaggcactacaaaaccgataacgaccacgcagaacaatgcataccttcaacacagacacgcacatagaccagcacatcccgtgacactagatagaaacaaaagcacaattaccacaagacaaacatggaaagagaaagatagaaacaatagaagaccaaaaccag

SEQ ID NO: 505282 - DNA, 541 bp, Homo sapiens
tgacctagagttacccaggcaaagctctacattgagtctccaagtatattaagcaaacattaagagatctaaagggggctgacgcggtggctcatgcccgtaatcccagcactttgggagaaaagaccaggtggtctggcgtagtgggtcaccccctgaaatctcagcacttttgggagggccgaggtagggtggatcacttggagatcagcgccgtttgagaccagtcctgggcaactacgtgtgaaacagccatctactactggggaatgcaaaacattggctgggcgtaggtggcgcaaagtctagtggtccccagctgcttgtggaggctggaggtggggagaatctgcttgtaacccgggagggtggaaggttgcacgtgggcccacgatcatgtcattgcactccagcctccagcctggacagagagagcatctgagagtctctgtctcaaaacaaaaagaaaaaaacaaaggaagagaccaaagagccttacttctcttggtccaccaagtgaggatatggcaagaaggcagcc

SEQ ID NO: 505283 - DNA, 1057 bp, Homo sapiens
cattgtcctcactgggatggctcgaccaagatctaggtgtgttgcatctttagcaactagaagggcaaatgtgggagaaggtaacggttcactatcgacctgtcgtcttgggtgagaatctttgcgggccgaagtccagcacgtagatggacatgcctgattctctaattgcgggggcttcggcgccagatccatggaagaaatcgcaaaagtggtccgcgtgaatatggtgacgcgggctcatttcaaatgctatgtcgggggatctcagatacactgatagcctgagactttgaactggcggacgttcacaaattgatctccttcctgtggtggaaaaatctagaattaacatgcccgtggcacatatggtggacggatcccatgcagattgcgcgcatgtgatcagctgaagaattttattctaattagtaatgaatacacctgagagcgttttcatgaacgagggctgtgcatagaactagctttagcaagatgcttagtcggggtgggtagatttggcaggctggggtagtcgtcgcacgaattggggacgtactcccgaagagacgtgccctttctagtattacgaacacgaggagttgtgtaaacaaaccctaagtttggtgcggtagtaaacatagaatgttgggattccaacagttgatgcaccccataaagggcagcaagaaccattatgcggacgacgttggtacctggacagcaggccctatagatggagcaaacgtgggttaaaagccgcaaacaaggagcgtgtgggacaccacatgccgggtttgggagtgcagccacggaccaagctggaagccagaggggtccatgcactgtggttcagggcgggatgtgtcccgcgagacatgacacggccggacacaccggatggacagacgtgacaggattcttacacaaacgcgtgattgtgagacctgatgcatgagggtgagattgtcacacactgttggtgtgtgtgatccctgacgcacgatcagaggctaacacgtgtgcacgtggtgggaccagaaaaacaagcacacga

SEQ ID NO: 505284 - DNA, 343 bp, Homo sapiens
ctctacaggatctaatgcagctatccggttcaatcgataaagtagaacaaacaggtacataccatgaagtatactactcaacaatttaaaaaaaaaaaaaaaaaaaaacataatggggcccggcaggtggctcacgcttgaaatcccaaaattttggaaggccaaggccgaggccggaaaataacctgaggtccggagtccaagaccagtctggccaacatggttgaaacctcgtctccattaaaaatacaaaaaaataagcggggtgtgggggtgcaatgcttgtagccccagataatatgggaggctagtggcaggcgaatcatttgaacacaggaggcgg

SEQ ID NO: 505285 - DNA, 799 bp, Homo sapiens
agataattcattagtaataggaattaactgaccccttttgatgggggagagcatcaggctggggtcaggtaagtgtaaatggccttctgagcatgctcttctaggcggactcccagccctgacttgaaaccattagcgctaacttgctctgttttgagaaaaactttccaaactttgtgcatgagaaacctagaaacaggaatgtatgccacgtaactggattacagaaatgagttaatgtgtctctgtgataaaacaaaacaaatttgaaatatttcttatggaatctactattttgggtctgtgaagcatttttcataagtggatagaaggtattggtctttttaccttggtgggataccctcttagcatatattctgggctatccttaagatcttaaacaaaatcattcttggtcagtcaagtatagtggcgcaaacaatgtgtcaacatccttgtgtctttatctacacggaacaaatttttggaggttacccatttacagcaatcagcacagcagcacagatgttacaaccagaatgttgtgtgggcgccactacggcgccccagggaaaagcgcttgtaagaccccaatcgtcgagtggaccgcagcggccccccaggcagctgaaagctaacccgtggaccaaggggcgggtcacaagagacaacaccgggcccaacacaaacgggcgggaattcccccaagtaaaaagggcgggggcaaccaggctttggaccacaccaagggagcctggagcccacagggcctacacggagggccaggggctgatataag

SEQ ID NO: 505286 - DNA, 273 bp, Homo sapiens
  misc_feature (66)..(66): n is a, c, g, or t
  misc_feature (156)..(156): n is a, c, g, or t
  misc_feature (241)..(241): n is a, c, g, or t
gtcacgcaccatctctcgcgcgggcgcgaagcgcggcagcgggcgcgtgccgggggccggcatgtngtccacgccgtagggcgagacgccatagggagtgcgcgtcatcacgatcggataggtccgcgtgcgatccttcgggacgtaggcgtccgngtagagcttctttccgtcgcgcatcggaatgcgaaactcgtacttcgtgtagaactcacgcaacgcgcgcgcgtagtcggcctcntccttgatctcgtacgggacgaggggcttgtc

SEQ ID NO: 505287 - DNA, 412 bp, Homo sapiens
accagcgcaccgcatccagtttttattatcctgagatcaagcccacgcagccatccaacagccaaaacacaacaaacaactaacgccagtgccaatctcatctggtctcctgcgcaagtaaggtcaggtcacgaacggctgtaacgcaactcagtcatagtccgcctagaagcatttgcggtggacaatggaggggccgaactcgtcgtactcctgcttgctgatccacatctgctgtatgtgtgtacagcgaggccaggatggagccgccgatccacacggagtacttgcgctcaggaggagcaatgatcttgatcttcattgtgctgggtgccaggccagtgatctccttctgcatcctgtcggcaatgcctgggtacatggtggtgccgccagacagcactgtgtaggc

SEQ ID NO: 505288 - DNA, 396 bp, Homo sapiens
tcgacagcatgctccttcagatgcttcacattgtttcttacctcaagcacagagtacagcgcataacgattatagacatggtgttatatagacagggagcagctttccgaacgcataaagaggccacacatgaataagctcaagatggtcaaagtcgtgctcgtatccacatgataggtttagatgcttgtagtcgatatgctataagcctaagtcagcagtacttgaatcatcgagtttcgaacgctctatgagcacacgcatgtccacatgtggtcagagtacagcctttattcaaaggtcaaatacccgcataagagctttcagtggctcctcagagacggcggtcatgtgtgtccagatctctacagagcacagtgtgtatcacaagttctc

SEQ ID NO: 505289 - DNA, 186 bp, Homo sapiens
accctgtatcccagctactcgggaggctgaagcaggagaatcgcttgaacggggaggcagaggttgcagtgaactgagatcacaccacggcactacagcctggcaacagagcaagactccatctcaaaaaaagtgactgctatagattgaacaaagcaaatacaaaagtagaggagcaccaccaat

SEQ ID NO: 505290 - DNA, 215 bp, Homo sapiens
  misc_feature (13)..(13): n is a, c, g, or t
  misc_feature (22)..(22): n is a, c, g, or t
  misc_feature (41)..(41): n is a, c, g, or t
  misc_feature (50)..(50): n is a, c, g, or t
  misc_feature (53)..(53): n is a, c, g, or t
  misc_feature (55)..(55): n is a, c, g, or t
  misc_feature (76)..(76): n is a, c, g, or t
  misc_feature (105)..(105): n is a, c, g, or t
  misc_feature (110)..(110): n is a, c, g, or t
  misc_feature (115)..(115): n is a, c, g, or t
  misc_feature (147)..(147): n is a, c, g, or t
  misc_feature (152)..(152): n is a, c, g, or t
  misc_feature (155)..(155): n is a, c, g, or t
  misc_feature (167)..(167): n is a, c, g, or t
  misc_feature (170)..(170): n is a, c, g, or t
  misc_feature (191)..(191): n is a, c, g, or t
  misc_feature (206)..(206): n is a, c, g, or t
ggaaattcgaatngcgaggatngcaagaaaagctggcaacntcctatgtnccngncagaacccaaattggcgtttnacatcagaatcagaggtatcaatggagtnagccnaaagnctcgaaaggtgttgcagcttcttcgccttcgncaaantcntcaatggaaccnttntgaagctcaacaaggcttcgnttaacatgctgaggnttgtagagc

SEQ ID NO: 505291 - DNA, 748 bp, Homo sapiens
tgtgcccaaaaggggtaaaggggggtgaaaaggggaaaaacgggccccatttaaaaaattttaggggaaataattttaagggagagggaataaaaggtggttgggccccaaagttttaaaaatgggggggtttaccccccggggtgggtcttagcggaacaagcgggttgcggtaaaacacacccgagaaacgtgcgcttctttgtataacacccaacgggggggagacacccccgcgtagccgccgcaaacacgtctgggcgacggtacataatcatcacacaaaggggggctctcaacgccgggagcgtcacacccgaaggagggcgcagacgatcaaagagaccgcacagactcgccggggaccgacgaacaaagggggcgacaaaatagcacgaacgaggaaacataacccccgcgccaacacggggcgaccacagaaggtgcacagccccagtggggcgcgccagacgtggatctggtgcgacacgggagaggctactaggacacccccgctgtgtaattacaagagagaccccatacggacagcggccgggggacaacgtgaccaacaagaattgagtgcggagccaagataacatccacgggggacaactaccacgaggcggcgccgaaagtgcagatcaagaccacgactggggttatactaatgtacaagcaaacggggacaccggggcagtcaagcactgaaacggcacaatagcataggggggggccacacagcagc

SEQ ID NO: 505292 - DNA, 326 bp, Homo sapiens
aggacatgtattcaatcactagtactatgccccatgctccggtgtgactcgtgcagccatcgacagtgacgctctaggtagaagctgggtgttgccctcaggcgcggatctcgatctcgttggcgccctggaggagcagggccttcttgagtgttgccagtctgctggtccatgtatgccacgctgttcttgcagtggtaggtgatgttcttgtgagtgcctcggtggacatcaggcgcatgaaggtcagctggattgccacatcggcagggtcggagccctggccgccatactcgaactggaatccatcggtcatgctctcgccg

SEQ ID NO: 505293 - DNA, 132 bp, Homo sapiens
gcggccgcctactactactactgctcgaattcaagcttctaacgatgtacggggacatgaacaaattctttagtactcaatgtttctggacattctctttgataacaaaaaataaattttaaaaaggaaaaa

SEQ ID NO: 505294 - DNA, 445 bp, Homo sapiens
cccccacgttacaccagcttcaattactttctatataattcatgttgcagaataaaaagacttaccttaacataatcttccaatgcactgaattttaaacactgcctgcaaaaggtttacggttcaatatggacatgaagccagctgtctgaataagtgattaacaaataatatctttaccaatctttctttatatcataattattaatacaattataaattttccatagtattatttttatactctattcttcgaaagaaaaaattatttttattccttgaatttgttttcattcattcaaatcatttactgaatacctcttgttatgctagatagttggaatacaatgatgaacgagacagaatctgttattacaatcccattgagatatgctgcccggttgagaactactagtatagtagaagatgagtatgggctgacagt

SEQ ID NO: 505295 - DNA, 350 bp, Homo sapiens
cagaatgtttgcgggcttagaattttatttttgatttgaagtatacaagtctctcgagtaaatttctaggaggtaagtgtatacttaaatttcaaagaaactgccaagctgtttccgaaagtagtcgtacaattcctatcagcagcatgtgagagtatagttgctccatatcctcactgtctttatccatttatgatactataacaaaatgttccagttctagtacacatatatacatgcagaatatataacaagcagaatataatcttttatcttttaactttaatcttttctgactctattagtccgttctcatgctgctaataaagacataattgaaactgaaaaaa

SEQ ID NO: 505296 - DNA, 169 bp, Homo sapiens
cgtacacagtccacatgtgtaaaggactaggagaggtgacagtacctttgtgtcagatcgagaagtgctagggacatgtgggcatgagcttagttgtcaggctcctcagagggagggaagcttgcgcaaagggaagtgagtagagtccaggaggaggaggaattcgccc

SEQ ID NO: 505297 - DNA, 1362 bp, Homo sapiens
  misc_feature (1084)..(1084): n is a, c, g, or t
  misc_feature (1088)..(1088): n is a, c, g, or t
  misc_feature (1106)..(1106): n is a, c, g, or t
  misc_feature (1114)..(1114): n is a, c, g, or t
  misc_feature (1143)..(1143): n is a, c, g, or t
  misc_feature (1233)..(1233): n is a, c, g, or t
  misc_feature (1237)..(1237): n is a, c, g, or t
tctcgatccccagagtaaccgttccccgtttaccgaagcccacttagtgccctgtaatactgaactgttgtccctgtgactaccttacctcttcagcgcccgagggcacccgtgggcctcccggagcctctgcccctggcggggtggagacccggacccgcagccccctccactggcgacacaactgcaccttccctcatttcagtctcccgcacacttattcctcctcccctcttcccggtggcacctctccacctgtacccgcccccgccccccccccccggcccctctggaagagttgttgcccgacccgggttttgggggaaacccgtcttgacacttccaaacccttttcttcccgatcctggacccctccgttgactaatcttgcctgggttgtgtaggtctgcaggaaggaaggctgaaaaagcggacgaagattttgacttaagtgggacttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaaagtaagggggtgagcagttaatgggtattcattccacatacaatatctggtgtaaaacggatttcctggtagaagtagctttaatgggttttggctctagaataccggtaggtctatccttagagcactcacgccaggctttcttcccggggtttaaacttcatataactttcagaaattgggagagcaaaaattttggctggtcactggcacttcattataaaaaagcttatttaaccttattcaaaaggtattttattggccaaactatggcttttttgggtaaatttgggtccatatttatcggggatgacaaatccatagaatatatcctttaatggtcaaattatggatcttcatattaatcttaaaatttgtggacggtgtcttttcccttttttcccacaggtttaactatattatccttcaagcgacatttttggtacctttacacttttggggtnattntcattttacacacactgnacactttnctttacgcaactgcaacaacctggtgggntacttatttagaaatccccctttgggtggctgcaattgggttcttctcttagggcttcacactaggctgatgtttgtaagtctgtgcgcncganggaacactttgttggtcaagggaaaaaagaactgttctcggctcagaatcccacatggggggacggggtcaggttgaagcgccaagggtactggcgggttttgggtaaaattgggcacaaagagg

SEQ ID NO: 505298 - DNA, 882 bp, Homo sapiens
  misc_feature (835)..(835): n is a, c, g, or t
  misc_feature (841)..(841): n is a, c, g, or t
  misc_feature (855)..(855): n is a, c, g, or t
gctgaagtgggaggatcacttgagctcaggagttcgagaccagcctggccaacacggcaagagctcatctctacacaaaagatgaaaaaaaccgcacgtgcacctctgaatctaaaatttaaaaataaataaaatacagttagccaggcgtggtggtgtgcgcctgtggccccagtcctactcaggaagctgaagcgggaggatccctggagcccaggagttcgaagcttcagtgagctgtgactgcactgctgcactccagcctgggcaacagagcaaggccctgtctctaaaaccaaacaaaaaacaaagctggcgattgctgacgtgcactcggggcattaaacactttatgccagacgctgctctgcaagccttagggccgtcagctcatctaccctcacagccggcctgtgtggtgggaactgtgaccccgtttcacagacaaggaggcagagcacagagaactcccgaggcagcgactccagagcctccctcagcccctctcccacgggcctcttggatgggggcccagggtgttgcatttcagatttttactgaatgttactcctaacaacctcttgcaccaaattactccagccttcacctcacagtccagaaaattgggcacacaaaccccgagagacgtggcttgcagtgaagccaggacttgcatttactgcagctctggtggcttctccaccatctgttcttcctctttgcagaagcatttcttatggtgtggcggaactgattggcagcttggaacacacatctctttgggcccacatctcctgtattcactgaaaggcaggaagactgcagtatgccgttngtgtcnagagcttggccctnctgggagaagcctgcacacgtgtccca

SEQ ID NO: 505299 - DNA, 1399 bp, Homo sapiens
tctcgatccccagagtaaccgttccccgtttaccgaagcccacttagtgccctgtaatactgaactgttgtccctgtgactaccttacctcttcagcgcccgagggcacccgtgggcctcccggagcctctgcccctggcggggtggagacccggacccgcagccccctccactggcgacacaactgcaccttccctcatttcagtctcccgcacacttattcctcctcccctcttcccggtggcacctctccacctgtacccgcccccgccccccccccccggcccctctggaagagttgttgcccgacccgggttttgggggaaacccgtcttgacacttccaaacccttttcttcccgatcctggacccctccgttgactaatcttgcctgggttgtgtaggtctgcaggaaggaaggctgaaaaagcggacgaagattttgacttaagtgggacttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaaagtaagggggtgagcagttaatgggtattcattccacatacaatatctggtgtaaaacggatttcctggtagaagtagctttaatgggttttggctctagaataccggtaggtctatccttagagcactcacgccaggctttcttcccggggtttaaacttcatataactttcagaaattgggagagcaaaaattttggctggtcactggcacttcattataaaaaagcttatttaaccttattcaaaaggtattttattggccaaactatggcttttttgggtaaatttgggtccatatttatcggggatgacaaatccatagaatatatcctttaatggtcaaattatggatcttcatattaatcttaaaatttgtggacggtgtcttttcccttttttcccacaggtttaactatattatccttcaagcgacatttttggtacctttacacttttggggtaatataatttgaaaaacatggaaaaattattttaaaaaattggcaaaaaagtgtgggataattatttaagaaattccccctttggtggtggcttggcaaatgcgagttcactttctcttaagggcctttcacaattaggactgtgaagaactgtatggttacaagtcctgtgacagtacagaaggaaacacaacttttattgtataggcttcaaaaaggggggaaacaaacagaaaggggaggaacccttttgggattacaaggtggccattctaagagaatttccatccaacgagttaggaggtctgggatccca

SEQ ID NO: 505300 - DNA, 506 bp, Homo sapiens
aacagtatgactcacgtgacacgagtactggggccagaggagtggctggctagtgtccctgcatcgcaacaaagccttgcccaagcctctaccagcaagtgcaacctaagccaatgaagaactcacagttatcactgatgctgattacagccaaagaagtcattatgaagactacgctaatgtgcctacccagaagcaaagccaaagcacccttcccaaccaacaccattatacatgtataggaataaagactttccctatgaaagtcaatagatagaatgggaagaagtaacactaaatgtgcagcaatcaccataaggacaccagaaaacatggaaaggaaaggaaacataacacttccaaaggaatacaataattctctagcaacagatcccaaataaaacttatgacttgtctaaaaaataattcaaaataatgatcttaaaggaatccagcaagttgcaagagaatgcagataaacaatacaaagaaatcaggaaaacaat

SEQ ID NO: 505301 - DNA, 406 bp, Homo sapiens
  misc_feature (202)..(202): n is a, c, g, or t
  misc_feature (310)..(310): n is a, c, g, or t
actcgggaagagacacaggtaagaaagtggaaacctaccctgtcagataaacatgctgggatggggattaatgaccagattagaatcccgtaaagagaaaagtttaatgtccctcgaggggcacagcaatagaaactatcaaaaacaaaacacagaggcccaggcacgggttgcacgcctgtaatcccagcactttgggagnccaaggcagctggatcgcttgaggcccaggagttcaaaaccagcctggccaacatggcgtaaccccttctctactaaaaataaaaaaattagccgggcgtcgtggtanacccctgtagtcccagctcctcaggaggctgaggcataagaatcgcttgaacccaggtggtggaggctgcagtgagccaagatcaccccagtgcac

SEQ ID NO: 505302 - DNA, 209 bp, Homo sapiens
gccaagaggcaaccacaccactggcagatgaaggcagggctccaaagacaaaccagaaagtaaaaaatcttggtctggtctgctctggtttggcttcaaacattgggttttctcttctgttgatgagacaggtgttgattccaaataacgtcagagatctgctccattcaacacagcctgaggcacgaccagaggcagaactgcctaaa

SEQ ID NO: 505303 - DNA, 1431 bp, Homo sapiens
  misc_feature (295)..(295): n is a, c, g, or t
  misc_feature (821)..(821): n is a, c, g, or t
gggcgacttcatatccgactgctgggagatctgcccctaggaatcctcatccctcggaaacgcggcctagtgcagtagtacgctgctgtaactgcagagagggcctaatctgccgtagccagagtgcgccacccgtcatacagaaagagacgctatgtggacccgacgttactatgtaggctcacgtgtagagcctaatatagctgcaggctatcgtcgatgcatggagccagaatcgagcgaacacctagggataggcgcgtcatagccacgagcggacattcatccttgacangtccaaatccgtgccatttggccgtggacttcgaacccggcaggtctcctgtgtcgcaaagactctcatgtctctgggcacatcctaggcacaggcctaggccttgtgtggctaggacacgaacacgagaaggagactagataggcctcttcaagcaggtagctctttgggtaggcggacctcccaacatggcgacgcgccgctcgtagggcggcgagaacgacccataggtccgggggtgcgtctcgacgtggccccttgggaccaataccggacgtggtgtgcagtagttcgggccagatcaatagcagaggcgccatcggcaatcgcatatgacaagcaagcattgagatccaaaggttacccccatttgccgagccatctcctctcggagctgcagatcacagggcctcgttctaccttcgttaccccctctatagtgagttccccattccgtgcccctaacgcgggtgcacaatccccctctgttgcaaagagggttgtccgccagcggcacgtggaaagnagcgtggtgagtagcttactctatgtatcatcctcactacaattaggtcgctttttacgccctatctagccataaggctacctagtgtccccgaatgggggtcaccgcgttcggtacatttacctctgcgttccaattatacccacattttgcgcttaaggataccacccatagaggtttctggtggcagcggccaagaccaggattccacccccaagacaaacgaggacggccaacaaagctttggggcaagggttccccaactcgttgtagagaagggcgctgtcacacgcccagctacatatccgttgcaacccaggaccaacagaccaacgggccacccattaacgctctgaagcgtacaggccggatttggaccccggctgagaacggcgaaagggttgggacctggaaggagccaggggcgccaagccggataaaggactcaccacgggccagtggcggccacagcccacaacgagtgtaccagagggcgcaacgaggacacccaagagacacacaagcgagagagccaagcagacgcggagcgaagaaacatcccagagggctggtcctcaagcaagatgggggcgacccagcgcaccaccgc

SEQ ID NO: 505304 - DNA, 335 bp, Homo sapiens
ccaacagaccagcacaacagcgcagatccccttaaaagccctaaaccagggctgggaccggtggctcatgcctgtaatcccagcactttggaggctgaggcaggtggaccgcttgaggtcaggagtttgaggcgagcctggccaacatcgtgaaaccccgtctctactaaaaatgcaaaaattagctgggcatggcagcaggtgctggtaatcccagctactcgggaggctgaggcaggagtattgcttgaacccaggagacggaggttgcagtgagccaagatcatgccactgcactgcactccagcctggatgacagaggaagactctgtctc

SEQ ID NO: 505305 - DNA, 916 bp, Homo sapiens
  misc_feature (33)..(33): n is a, c, g, or t
  misc_feature (37)..(37): n is a, c, g, or t
aaacggaaaggttcggaatttgcctctgcgccntctntttttgcctgttacctgtgacgtccttgaaaatgaaaagctttcttaagacaataggacgggccgggcgcggtggctcatgcctgtaatcctaacactctgggaggccgaggttggcggatcacgaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatctttaaaaaaaaaaagaacaaaaaaaaaaagaaaaaaaaaaaagggggggggggcaataaaagattccccgcggggggcccaaattatacgggacaccaggtcatctgggcgcacaaaggggcgcccccaataaagagggaggcgcggatatacaacgaacatagaacacgggcaccgcgagattaaacaaccggtgcggatcgtgtggaacacctggatcgctgggagacccttgggaagagggccaccacactcgcggggaggcgacaaatggggcaacacccacagag

SEQ ID NO: 505306 - DNA, 516 bp, Homo sapiens
  misc_feature (33)..(33): n is a, c, g, or t
  misc_feature (37)..(37): n is a, c, g, or t
aaacggaaaggttcggaatttgcctctgcgccntctntttttgcctgttacctgtgacgtccttgaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaa

SEQ ID NO: 505307 - DNA, 277 bp, Homo sapiens
cgcaatgcgggcatgcctatctgctcgtaggtgctgtagacaccgcataccttgtcaagcgtatcggagacaatcaggattgaatgtgtattagactcgaggcatgctagtgagctgagatggcgttaatatctgctgattctggtgagagcatggatgcatggatcaactaagctgacgcataggatgatttactgcgtgtttttgcatccatatgcgatacggtgtcctgggtactctgtcgagctgttgctgacatttgcctggacatatggtc

SEQ ID NO: 505308 - DNA, 819 bp, Homo sapiens
  misc_feature (33)..(33): n is a, c, g, or t
  misc_feature (37)..(37): n is a, c, g, or t
aaacggaaaggttcggaatttgcctctgcgccntctntttttgcctgttacctgtgacgtccttgaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatctttaaaaaaaaaaagaacaaaaaaaaaaagaaaaaaaaaaaagggggggggggcaataaaagattccccgcggggggcccaaattatacgggacaccaggtcatctgggcgcacaaaggggcgcccccaataaagagggaggcgcggatatacaacgaacatagaacacgggcaccgcgagattaaacaaccggtgcggatcgtgtggaacacctggatcgctgggagacccttgggaagagggccaccacactcgcggggaggcgacaaatggggcaacacccacagag

SEQ ID NO: 505309 - DNA, 129 bp, Homo sapiens
  misc_feature (10)..(10): n is a, c, g, or t
cctgcgctanttccagaccctaccagcactacctaaccctcagccgacactctcagaatcaccgacccactttcttggcatatagccccacttaagaccctcgctctcacaaccccaacagcactaacc

SEQ ID NO: 505310 - DNA, 575 bp, Homo sapiens
  misc_feature (33)..(33): n is a, c, g, or t
  misc_feature (37)..(37): n is a, c, g, or t
aaacggaaaggttcggaatttgcctctgcgccntctntttttgcctgttacctgtgacgtccttgaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaaaaagatgcggccgtacttactctactccttaccccatctcccacaactcggacgattgt

SEQ ID NO: 505311 - DNA, 1062 bp, Homo sapiens
agctaccgtacttcctgttagttatcactccaattaaccggcagttactcccagtcatgcccgagccctcaaagtccgatccatgccccgaagaaaggctccaagaaggccgtgacaaaggcccagacgaaggacggcgaagaagcgcaagcgcagccgcacaggagagctactccgtgtacgtgtacaaggtgctgaagcaggtccaccaccgaaaccggtatctcgatccaaggtccatggagcatccatgacactccttacgatcaatgacatcttcgagacgcatcgccggagaggcttcccgcctggcgcataaacaacaagcgctcgaccatcacctccagggagatccagacggacgtgcgacctgatgctgacagaggagagctggcacaagcacgcggtgtcaggagggacaccaaggccgacagcaagtacaccagtaccaagaagagacacaagaagatacacagagcagcactcacgcaggcccatggacttcagacagctcaagataaggctacaattaagagtcagcaaccaagtctccagcatgcacatatcatatgggcaagcacatgcaatgccgcaaagcagaatccagatctcttaccataaaccacgggcatagcacagcatttgcaaaactgtaaacagatgtcactcataaacataaaaaaaaatagctaataaaactaaactatgtatgctaaattaaaaatggatacataacaggcacaaaagacaatgacaattaaccaaaataagaaggcaacacaatataatacgggaactgtcaaacacaatacctaacagaaaacaaatcatgagcaatgcaaagacccaacaaccctaatatggcaataaaccagcgatcacacgagcagcccagagaaaactcaaaaagaaaggcacaccacaaaatcacgacagaaacaacaagcagaagcacgaccggcacaaacgcgacacacaaaacagccccaggacaccaaaaaaacaacaagaacaacaaacagagagaagagcagacacacaaacaacaacaagcagaacaca

SEQ ID NO: 505312 - DNA, 84 bp, Homo sapiens
tcgatacgactttttttttttgcacacgacatggtcactgcccattttcttctttgtgcactacttcccttctgtcgtcttctc

SEQ ID NO: 505313 - DNA, 937 bp, Homo sapiens
ataaccaggctcgctcgggcttgaagcggcctcgctttcttgaaaattgtaaatctgctgccccccacgcaaactttcaacacccccttcaatcaaccttctgcggtcggtaagaggggcaaaagttgttcgccttgtccccgtcagacctgaacactttttcgtggcttcaactcgtgtcttaatcaactttgggctttcggggggcacagcaagcaactcttctttggcgtcaacattaacgcgcgtctttcttcccacatttggaacatttttgaaaattccactcacaatgacactgggaaaaatggggtttttgccccacatggaataaagggcgttcctttggtttaaatcgatcttttttgtttttgtgccaaacctttcttcttattttttttctggcctctaatacacactctgagttcctatctaaataacacgctgccctatataaaaagccctaaaatgggtcagacagggattaaaactaacttataatagaagtggcaatttttttgggagaataacttctcatcacaggagaatataaatacctcggggttcttttcgtattagcaccgttcgcccccttaagaaagggaaaggggggacgtacactacgttattatctaactcgactctttagacttaggcgtctggcagttgctcttagttgggaacccccacatggtttaattccaacttgcagttacgaatatggatatgttttatcactagtggtggctaaataacccaacatttgtgtaaaagaagaaaagccaagatttcattgtttgttgaatatttcttaagcatgccccttggcccataaagaggaccgcttcttaccaagcctgtaaactatgcatgatggatattcttgtatctatttaggaatggctgttgttacttaacacatctgtgatcagctaac

SEQ ID NO: 505314 - DNA, 173 bp, Homo sapiens
cagcggtgacagttccactgcacacagaaatagcaagggaatcatcaaccattggctggggaggctaaggtgggagatcacttgagccagtgaggtggaagtggcagtgagctgagatggcgcctctgtactccagccaaggtgacagtgagaccttcccagctggctcagag

SEQ ID NO: 505315 - DNA, 841 bp, Homo sapiens
ggacgcgtgggtcgacccacgcgtcgaaaaaaaaaaaagagaaaaaaaaaaaaaaaaaaaaagggggggcggaaaaaaaagaaaacccaaaaggggcccaaaaaaaaaaaacgccagatttttggcaaggggggccccaaaggggctttatagaggcacttggagccgcggcgatttaagcacgccagcagggagaggggggagcaaacaccggcagacgtgggagcactctgtgggaacggagcccctaactgttggggggggaggcaatagtggggcgcagatcatccaagagcgaaaaaacgctccaagggggagacactactatcacaatgtaaacggggaacagggggaacaaagcccgaaacgtggaggggacagttgggtacgggaagttagcttaggacaaattttatccccggggcgtgctcaaccgtgctagactaaacacaagagacacacgacaaatggtagaaacaagacacagaagaataaaaaggcatgtatcaaaaataaagaaaaaagaacaacaaatgacacaagacaagaagacagaaagataacaaaaaaaaagaaataacaaagaaaaataaaaatatgagtgaaacaagaagaaagaaaggagaacaatagaaggcgagaaaacagagagacaggagtagaagtgtaatacgaaaaaaatacagaagggcggaaagcaaatatcaattaaaaggaagatatagtagcaccgagacgaaagcaagaaaacacggaaaaacagaggaaataaaagatgcacgagaaagacacaagcagaaaacgcacaaacatcacaaagtagaagaaaaaagccaccccc

SEQ ID NO: 505316 - DNA, 225 bp, Homo sapiens
  misc_feature (131)..(131): n is a, c, g, or t
  misc_feature (147)..(147): n is a, c, g, or t
  misc_feature (223)..(224): n is a, c, g, or t
tcacttgtctagacagagctcatcgggaacgctgcggagtcaataaacaggcttagtatttaattccgtagcagaaaactacgagaatcaacatgaattaacagaaaaaaaagtcctttaccaaatatttntggagcgtctggtagnagagatacatagatacagcatgttaacaaaacagagttgtggcgtgcctacgtttatcatgtgtgtagaaattganna

SEQ ID NO: 505317 - DNA, 349 bp, Homo sapiens
ctgaactcgagaggagaaaactacataagatagagcaagtttaaaagctgcagaaataggatgtggatggttgctgacttaaattgggaggactccaagccgtgaaggaaaattccctttaccagactgtatcaattgtaacaagttatggcctgaaagcaggtaagtccatacttagcactgacatacttttaaccttctgtgctaaggtaaggtatccaccctcgatgcaatccaccttgtgtctacttagggtggaatgtgatgttcagcagcaaacttgcaacagactggccttctgtttgttactttcaaaaggcccacgtgatacaattagagaattcccacc

SEQ ID NO: 505318 - DNA, 326 bp, Homo sapiens
actgaaaagagcaaaagtgagtgcactttgtgaaaatggagtataagagtcgacaaagggtactctcgtaggtatagtcttgctgagttagttttgaactactttctttctctttccaccaatgacaaaaatgtgtgtggccgatctgttgctgcgatgaagggataaagtgtggtggtgcctggatctgaaaactctggatatccacaagatccgctctcttgcgaagtcgatgtcgaggatccgggtttttttctttcttttctctgctcttttcttggcaacccggaaccacaggtaggcactcacgggtgctcgcgtcaatc

SEQ ID NO: 505319 - DNA, 1571 bp, Homo sapiens
  misc_feature (690)..(690): n is a, c, g, or t
gtcctgatatgtcgcgtctaggaccactatgcactacttgcacgttgctagttcataggatgggagtcccatgtgtctggtgctggctcctggaatctagctcccaatacgggagtctgataccaacacaaggtcactagggctatctcgatcttgtaatctgtctcgaggctatccgaactggaacgatggcatgggagatgtataagacgcacatgatggacatgactgaagaaatgagagtagaaaggtgtgctgctcctattcgaggagattaattggccctggaggtacctgtgaaaatcaaacaacatggagaaaaggcatagacgtcggatagaagaacggtagggtaactacgatctccattattgaatcaaacctacacgtgtggaaacgtcaaacagtaaattgcatcttctcgaatccttgtggaccttaattggtagatccgttagtactagtatagtatcgacccgctagggtgaatcggaccgaggcatgccaacatttatccagtgccaaaaaatagatcgattcgtactactcatctactgggtggaacaatttccatcccaaggcgtccgttggaaacctcggctaggacatttgcttctccataaggaggtttgggtttcccgaacattgttctcgatgtcgattttggggaattgaacacattctctccgnaataggacctttgcgttttctttcttcccccacggggaaatttagggcgatctatagatatctcctcggcccaaagcaggaacgttagaacccccattttacatatgtgggcttgtgacaagcaaaaggtagggctctgggatctgtataatcgaccataattaaatccaattagagtcgagagcaactagggggtttttccactggggagagggccagttgattctattctcttaatcctaggcaagtttctccgataaacttcttgtataccccaggacccaagaagccccagaaggaagccaattaattggacaagggaaagagggggttccggagtcaaaaccaggagggatcagtttgtccttaagaccaacttgctttggtggccaagagcttgtggaattggaacaaataatgttccgaggcaagtggcctgtaaaacccgctccgaaagacctttggaagagacatgtttcctaattttcctagggtgggaacacaactcatgtcaaggtctctgggattgggacatactcacttgagagtgaatcctataatctattttgcccctttgaggaatgggtccaaaagccctattcctctatctccaaattaggaacctcttatggagtttaatttaccacacggggggcaaactttgccgtgtacacattgatcacttactcccaccgggattaaaccgctgaagccgcgtgactctggatcttgcacaccactgtgctcaggggaacaacttccacacactatggctctgtgaccaagagcagaaacgcgactttctctgggcggcaccatagcgtctggttatctcttaacagccgggactcgaacccttcctgttaccacaaactcggggc

SEQ ID NO: 505320 - DNA, 649 bp, Homo sapiens
  misc_feature (329)..(329): n is a, c, g, or t
atatggttggacgaccgacaagcaccacagcaaaaagatgctccccagaacacatggacaccccaatccccgtatcattagactctcccagaggcacgtatgtactgcttaatgcagagactcacctgaggcacactgatgcaccccgcatgacacagacttgcccccccataaggactctactatgacacacagacaatcccaacatcacacactgttcccacatcacacgaacccattttaggaaacacacagcatacagacttaccccatagaacacggcttccccgacaagcacacatactctcaaggccagtagactcaccccncagcacacagactttctctagagtgtacagcttcttcccacagcaaacagactctccccagggcacacagacacccctgacatcacatactctcaccacagaccatagactcgtcctagagcacagggactcttgccaatgaaacagactttcccgagaatagactcatgagacagcttgaagacccgcatcatgacacaaagactctcccacaacagacagactcaccccattgtgtacagacaagcaccataggccacagaccatcacctcaggacacagacttgcccagcaccacacagacactctgcagagcacgt

SEQ ID NO: 505321 - DNA, 198 bp, Homo sapiens
  misc_feature (161)..(161): n is a, c, g, or t
acaaccccggacaaggccgaaggctctgagtaccaggtcctgtacatcgctgatgacaatgagatccgcagcctgttccccggccacccccattcggcttacgagcaggcattccagtggtgacgagaagtgtccgcattgtatgctataggatgtccatngttcaaggctggcccgtgtctatttggaccacactgg

SEQ ID NO: 505322 - DNA, 388 bp, Homo sapiens
atgaggtgcacatctcccagctccagcatgagaagagcatcctcaggggagacccagatgaaggcaagcttgaggatccctgtcccctctgcatgttgcaaagctatgccatgagggccatggcagtgagttaccagctggagcgctgtatcgtaagagcagtcagctggtggcgacatcgaatcaatatgaacacacacacgcacgtatcaagacatcactcgcagcatgcctgctgccaagagcccgtcggcccaacttatggagcaagtggctcagcttaagtccctgagtgacaccgtcgagaagctcaaggatgaggtcctccaggagacagtatctcagcgccctggagcaatagtaccagcagaattctcttagcaccagg

SEQ ID NO: 505323 - DNA, 182 bp, Homo sapiens
gcggccgctttttttttaaagtggaaaacatgtttattaacattcaaactcccctcatacaaggcatataaaaatccttagcattgattatcttagtctaccttctacatagtacaatgatgtataattagctttcatatacggtcatacatcatagctgtaacagtcactctcatcatacg

SEQ ID NO: 505324 - DNA, 89 bp, Homo sapiens
  misc_feature (51)..(51): n is a, c, g, or t
ttgtttttttctttttggtgtaatgttttacaaatcttttggcttgagaantaatatgttaattgccttaaataaattaatagaaattt

SEQ ID NO: 505325 - DNA, 992 bp, Homo sapiens
ttgctattctcggtgttcttcgtgtctgggtgtttctctcttggtggcctttctcgtgtttgtctactctctctttgtgctgtctttctcggtgtctgtgctgtctttttttgcttgctctttgtgttcctccttgttaggctgtcggttcttctctgtctttttgcttctcagtggtgctcgttttgtcacgtgcttgtgtgtgttcttctgctgtctctctgtcttcttcattgcttgttgttcttgcttgtcgtgatttgtgcctctgattatgcctcttctgttgtgtgtcttctcgtttctcttggtgtctgtggtgtcgctttgtttgggctctcgtttgccttggcgctgtccgctgtgggcgtaggcgtgtggctactttgtccattgcgtcgattgcttttgtttctggtcttctgttgctcgttggtccactgtttggctcgctcgtcttgcttccctgtgttctagctgcgtgttcacttttcgcgggtctgcattttggcggtgtcatgtggttcgtctgtaccgttcctagatgtgagtgcctctcgaaatcttttgtgttctcaagtcacgtcgacggctgtcggttggcaacgtgatgtgtgacgatgggtgggcgcagctcgcatggcgtggcaacttgaccttgggggaatatttcacatccatccagagctcggaatctactagcgtccagccactttccagcaagacgcgcgttcccattccggagacgttgtcaaccgtgcaagcgggtaaaggctgactgggaaatccattttgggtgggcaatttccttcatacgaagccggaaggcgaggttagtccgcggcggggcccagcttgcctgccaggttttcaggaatctcaaactctcatcttgtgcaatttatcaggtgtggaacatgttctactgctgccgtgatggtgtgcgtcgtggtgaataagatgaaatgtatataaaaaccaaggtatctcta

SEQ ID NO: 505326 - DNA, 225 bp, Homo sapiens
gcactgctgtcgctcacgtgtctatcatcttctattcctatggacctacgtatttgaggctccctgccacagtcccggtcctcagccgatccatgaacttcacgctgctggtccaatgctcgccagagttaaagacagcggaaatagagcccaaggcagatgggaggctggagggcaggagctgatgtcggcctcatctgctctgccggcggccatctagagccc

SEQ ID NO: 505327 - DNA, 1354 bp, Homo sapiens
  misc_feature (657)..(657): n is a, c, g, or t
cccagctactcgggaggctgaggcaggagaatggcgtgaacccaggaggctgagcttgcagtgagccgagatagcgccactgcactctggcctgggtgaaagagcgagactccgtctcaaaaaaaaaaaaaaaaaaaaaaaaaaaatatacggtataaaccctttaaaaaaggtgtgggtgtgttcagaaactctcttataaccttctgtggcccagttgtgaagtgatccggggttttaacactttgtggacttcttatataaacggtgtgttaaatgtgttgggccggggtgtgcaggggcgcctcaacaaccggtgttaattcccaagcacattgtggcgaaggcgccggaggtgtggggggaccccttgtgagacggatgggcgatgtttggcaaacaccaagcgccgtgggccaatgttgtggaacacccccatatcttcttaactaaacaatatcaccaacaatggttaacaccaaagcgctatgtggtggacaaagggcccccgtgggaacacccggggggcatcacccaccaggggaagcgctgggaaacaccggggatagcaacgggggttcacaaacacctgggggggcaggcgtagcgagagcgtgtctggccacgactgaaccccgcaggaaactatcactctgncgccaacttggggacactccccaacgctcactgggggggacaacagcggaagtagggtcgaaacctctgcggcgctctgccaaatataaacgccgacacgtaacaacaacaacagaggggggcggcgcgcacgcgcgccacacagaacaagaattatcaccccccccggaggagggggggcccccaagagaaatctatcagcgcgcagatacacccacaagatactacatactcgtgagggaaccacaaaagtcgggtgggcgccaccagaataagagtcagcgaagcgcagcaaacatatacataaacagggcgcagctagagcagcactcggggacccacgagcgcggtacttcaaaaacaccacggcgtgtgataggaccggtggcaacaacaaagacccgcacagacccacggggcgccaccatcggtggcgcaggaagcagcacacccacctcaaacacccacacggagcggcggcgcaccgccaccccacaactctggcgagccaaaccaccaaacgcctaacgagggaaagcatacttcaacgggcgcccccaagaagcagcacacaatactataaccaacgtcctcacacgacgtgtctacacatcgtgggcgctacaaacaaacagcagcgacaaatactgactgagcagcgcgcagcgcaagcgatctggccgaccacggcgctgat

SEQ ID NO: 505328 - DNA, 199 bp, Homo sapiens
  misc_feature (4)..(4): n is a, c, g, or t
atantatccgcaatagtctgtcatcgcccacgtggaccatgggaagccgaagtagacagataccctggtgtagtaaggcgggcatacatcagcctcggcccgggcgggggagacttactatcactagatacccggaaggacgagcaggagcgttgaatcaccatacaagttaactgccatctaccctacttctacgagc

SEQ ID NO: 505329 - DNA, 581 bp, Homo sapiens
  misc_feature (343)..(343): n is a, c, g, or t
  misc_feature (347)..(347): n is a, c, g, or t
  misc_feature (353)..(353): n is a, c, g, or t
  misc_feature (420)..(420): n is a, c, g, or t
  misc_feature (577)..(577): n is a, c, g, or t
gacaagagcttcatgggcacgctgtccttttgagccctgcctgtgaacacgcgtgcacatgcgcactttcatatgccaccccatgtgcctttagtcccgggcccccagagcaccccaaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaanaaanagcttnaggtgggagcggggctgggaggaagggatgggcccccccttcctgggcagcctttccagcctccggntgggtttttcttcctaccctccttccacatggacataaactgtcactttaggaagaagacaaatgacagattttgacatttatatttgggtattttcctggatttataggatgggacttttttgattaaaatatttaatatattgaataaaaaatanacat

SEQ ID NO: 505330 - DNA, 679 bp, Homo sapiens
tctcattaaactttttaaatggggtctcaaaattcggggacaaatttggggtcaagtggtttccattaaaaggtatcggattttaaaaatctaataatcttaaaacggccacacgcaaaaaagaaaaccaaagtgggtccacaaaaacattctcctttccttctgagggttttacgatgcatggttatcataaaccagtctttatactactaaagcttaaagggccaactggaaacaaacagttctgagacggttcttcacaccacgtgattaagaggtgggggtggcaggtatcaagggataatattcatttagccttctggagctttccgggagcagactgggtgcgacctggccagctccagcagcctatctggtccactggcttaggatgacacccaccggcaactggtctggtctcatatcacagaaccagcaaagcgacccaaagggggatagtctggagaacgctctcaaaaaaacatggggctggccagggaaccatatcaagcaagggcagcatcaccagagcttcaagaattcagggccatctccccagcgtttctaaccagaagggggacccaactcttgaccctcacaggctccagccacacttggcatgcacaggtgacgccgttgtggacaacccaaagtacagggggggcatagccgggaggca

SEQ ID NO: 505331 - DNA, 719 bp, Homo sapiens
  misc_feature (343)..(343): n is a, c, g, or t
  misc_feature (347)..(347): n is a, c, g, or t
  misc_feature (353)..(353): n is a, c, g, or t
  misc_feature (420)..(420): n is a, c, g, or t
  misc_feature (577)..(577): n is a, c, g, or t
gacaagagcttcatgggcacgctgtccttttgagccctgcctgtgaacacgcgtgcacatgcgcactttcatatgccaccccatgtgcctttagtcccgggcccccagagcaccccaaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaanaaanagcttnaggtgggagcggggctgggaggaagggatgggcccccccttcctgggcagcctttccagcctccggntgggtttttcttcctaccctccttccacatggacataaactgtcactttaggaagaagacaaatgacagattttgacatttatatttgggtattttcctggatttataggatgggacttttttgattaaaatatttaatatattgaataaaaaatanacatctcattttaacttatcaaataatactccaattcactaaccatcgttttacaacattcttcactatcgaaatccctagcattaccgaactttaatctcgtatgcacacattctcctttgccccacctatccatattact

SEQ ID NO: 505332 - DNA, 124 bp, Homo sapiens
aaggatcccatggagaccaggctgagcaacatggtgaaacaccatccctacaaaaaatacaaaattaaccaggtgtggtggtctgcgtctagtgatcctagctactcgagggactaatgtgggg

SEQ ID NO: 505333 - DNA, 527 bp, Homo sapiens
  misc_feature (32)..(32): n is a, c, g, or t
  misc_feature (151)..(151): n is a, c, g, or t
  misc_feature (155)..(155): n is a, c, g, or t
  misc_feature (161)..(161): n is a, c, g, or t
  misc_feature (228)..(228): n is a, c, g, or t
  misc_feature (385)..(385): n is a, c, g, or t
actaaggactcagtacagcaggcgctatgtgntaaaacggtttgtctatcccccaagctaacccggcctttatgttttttgtaagataaaccgtttttaacacatagcgccgtgctgtaaataagcccagtgctgctgtaaatacaggaanaaanagcttnaggtgggagcggggctgggaggaagggatgggcccccccttcctgggcagcctttccagcctccggntgggtttttcttcctaccctccttccacatggacataaactgtcactttaggaagaagacaaatgacagattttgacatttatatttgggtattttcctggatttataggatgggacttttttgattaaaatatttaatatattgaataaaaaatanacatctcattttaacttatcaaataatactccaattcactaaccatcgttttacaacattcttcactatcgaaatccctagcattaccgaactttaatctcgtatgcacacattctcctttgccccacctatccatattact

SEQ ID NO: 505334 - DNA, 823 bp, Homo sapiens
gattccgctactgcgcaaagatggtggaggaggagaacatccgcgtgttcgttgtggcggcaggagttgaacttaggagagctgtgtctctgcagatctaagtatatctctgtgtctctggagacttggttaaagtttacaggcacagttacaggaagagtgtgtacactatactgcatggacacagaaatctggtgactgaatccagttaaccccaaaacatctacagctgtattcttgtcccttgatggcacaattaaactgttgggactatatagatggcatcttaataaagcacttccatagtttggatgtaaattcatgccctctttatcttgcccaagctagaggattctgtctttgtaaatagtgaataaaggaaaaaccagatatattcagctgttcagtgaaatgccaaaatcctcaagccaggaagtagaacgccagggagctgtccttggttcttgattacataaaccagtcacccaagtgctggcttgggaaacgaggagtatatgttgctgcaggtacggcaattacttgtctggtatttttcaaacagacaacaacatcaggtactttatcatccatcagaaataagaaggctgctacaacattacgtgttagcttgtacccacgggaatggctccgttttggcctggttgacactcgcttggggatttatgtgaagagattgggactgtttcttggccgatggtctggttggttcacgaagaccctcgagggggatacttaaggcggacaaaagagttcgggaatgatcacgggagagccgcaaaaacccggcgagacgacaggcgtg

SEQ ID NO: 505335 - DNA, 240 bp, Homo sapiens
agaaacattccaagcctgtgataaactctctctttctaaaatcaataaaaactcttagtgcataggagcaagcactcctaaccaaaaaaaaaaaggaaaaatttgtccagaggcccctctcaggtttattctccaaaataaacttgtcttggactgtggagccacttttcaggttccttttctctttcttaacttctaacattgggggctgaaacctgggatgggtgttggggataccat

SEQ ID NO: 505336 - DNA, 452 bp, Homo sapiens
ggtcgtgacttggcaaaaccttgcgcggctgtcgaggacagagtggatctcacgttcaggaaaatgtttaataagtgagcactgcccataaagaataagctgcacaggtcaggggtgtatacctcatttaggcagggcctggaaaggccagatagtgggaacattgaagagactcaggaactggcagaaaactgagccagattatatttaacatccttttattatttttgtgggttttttttgagacagggtctcactctgtcgcccaggctggagtgtagtggtgcaatcacggctcactgcagccttgacctcccaggctcaagtgatcctcctgcctcagcctcctgagtaactgtttgccaccatgcccagctaattattttttctttctttcttttttttggagacagagtctctctctgttacccaggctggcgtgcagtggctca

SEQ ID NO: 505337 - DNA, 973 bp, Homo sapiens
ctccaattgcgactccagtaaaatgactcaaaagtgggaaatgaacaacatccatagtgtttagaaaaaataaaaggaaccaataacctacctactgacacgtacatttatacaggactgaaaatcgcctgaaacctgctgcaactattattaactctgtacagctccgaacccagaacctcctgatcagtttgaaggacgttgataaactgtgattttacaataacattatcatctgcagttactgtttacaaaactgcttttaccttaaacttgtagatgtttacatcttttttgttttaagatgatgtggtaattgtgcatttagctctgttttatttagaatagagttaaaagcattgtgtcttcttgggattacactcaggggtctgaaaggcagttgattttttttttttaacacactctgaaaaaaggtgggagtaaccagactttcatatataactgggtgattatcaaccggtggtgtctttattgaatttcacatccttatgaagcacggcacaggttcttagccaagggggccttccttcacagtcatgctgcttttacgacaggtgaatttcacacatttagtggctcttcattctcagtatatatttcaagagctttctgttgaactttataagaccgtactggatggaatggcatctggtggaagaaaaatccttactgtctcaaaagcgaattagggtgcaccgtggtctgaactgcatggtgcttgggctgacacagcactcgggatagaacatcaggcaactacggaggcgaaacatatggcacaagccgtactgtagcatccacacgggagggcccagaaacagggacacacggcaacagacacgaccgggaacgcaccacaccacaacctaggaacggcggcggacaccacgcaacagctcacgaacacgaacacaggaacacgaagagtcacccaaccagccccttccacccg

SEQ ID NO: 505338 - DNA, 666 bp, Homo sapiens
  misc_feature (193)..(193): n is a, c, g, or t
  misc_feature (221)..(221): n is a, c, g, or t
  misc_feature (559)..(559): n is a, c, g, or t
gccaatacacaggggctgccttgaactcgttcatacaatccatttataacctgtttataacttgtttataacccatttataccacatacccctaaagcaaatacctagcagatagcatgcagggcctatttgcctggcctccttcaatggcatcacattctccaccaccacgatggttaatatggacgagccntagcagctgcccagtgaagtccacacgntactgcccaaaccagctcaagtccttagttgtcatgaaaataatgtgagttcccacagccgtaaaagggaaagcagcaagagccacatgagcatccccggaaccctgggaacagtcatcagtgtcatcttcagggtcatgtccctacaagcagttctcaggctcctgctgagggtcagaacagagccgaagtcacaggatatcaaaaatggataagcccaacctcagctcgcagaggaattgctcagctgacagatgattgtgttatctcagtgaagccagatgacaatgtacttggccaacggaacatcttggtcaatggatctccaagttggttanaaaattaaagcaaaataatgccattatatgtaagatgtcattgattgtaagatgctcctttatttgatgtaccactaataaataaaaacactgacatttaaacaaaa

SEQ ID NO: 505339 - DNA, 177 bp, Homo sapiens
  misc_feature (37)..(37): n is a, c, g, or t
ggtcggacacagttgtttagtaataagttctcatgcnttggaattctctgttttcagtctcatcaaattcaagactacatatttctcatgacctttctggaagggagaggagagtagtaaggatgagtcttgtagtcttctagtcttcagttgaaattaaataacccaaccaagatg

SEQ ID NO: 505340 - DNA, 181 bp, Homo sapiens
tatgcttcacagcgtctcacagactctatatgagacctctcaaacgtactgtctctgtctctgtccctctccctttcaacagaactagaacttagtctctctctttccatctccagaatgtccgttacatgccacacggaactgaatctgacacgttcatcactgtacacttccccttgga

SEQ ID NO: 505341 - DNA, 857 bp, Homo sapiens
  misc_feature (53)..(53): n is a, c, g, or t
  misc_feature (55)..(55): n is a, c, g, or t
  misc_feature (67)..(67): n is a, c, g, or t
  misc_feature (70)..(70): n is a, c, g, or t
gacgatgctacgcgcgcccggctgctcctccggacctccgtagcgcctgccgngncctggctggcgntgntctcgtcgcttggcgctgctctcttctagagccgagggacccggtggcctcgtcgctcagcccctatttcggcaccaagactcgctacgaggatgtcaaccccgtgctattgtcagggcccctgaggctcctgtggctgtggaccctgagctgcagtggagggtgtgacctgcaccccgggtgcagacatggtcagccctcattctgcacacggaaacacgtaccccacggtcaaacagatccgcaagctgaggcagctgcacgggtttgctgcaggccacgcgggtccaagggatggacggggctagatagtaccagggacagccgcagacctagggtgcagcgctggccgactggccttatgttggtacgcggacttgtgatggactgggcaagatagatagagaaggggacggaagggatatgcagacagcattgtgtgcatgagtattggcctcagctctacccggaccacattatcaagcacgtgagaactatggactgactgagggatcatcaacagtgaccaagcaacacgagtgcatgcgaataagcaagacgcacagcctatcactggcagggagctggtgggcaaacaactaaacacccctgggattgacagcgagcggaccgtcggaaacataatgggacgagggaacacacaacaaggtaaaatgatacacacaaatggagaaaaaagacacactgaaagaggataaaacagaagagaaaaaatgacacagcaataaaaacaagcaacctcacactgggccgcacacacacaatt

SEQ ID NO: 505342 - DNA, 134 bp, Homo sapiens
agaccaggtatcgtctcatcctccaacatctagcatctatcagcattttactgatcatgtccacaccctgtgtgggtaaggaggactctctcggacgtagtagaggcaggcccagccagaagtgcgcctgggtg

SEQ ID NO: 505343 - DNA, 627 bp, Homo sapiens
agctgaagaccgaagcaagagctggttcaggtggcagccacagcagcctcagtgacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggactggagaacgggacgctcttccagactgaaagccctcagtctggcagcacttctacacagcaggagactgaggctcaacgggcaccctggcacaggctgatgctccgatggtgctgcgagcctcctggcccaggcagacacagctacgctccacgggcagacctgcaggagaccaccgctgcgtgacacggcctgcgcgaccagacacacaggacctggaaggccagagccctccacagagcctgccttcaacccccaaagcacgcttgcgactcagcgcacggagggccgcctgctccagcagctgacgatgacaccgaccgtggcacctgcacgggctctgcgcgagaccgcggggccgcgaggccggacccactcaagccgcgccagc

SEQ ID NO: 505344 - DNA, 241 bp, Homo sapiens
taagagtgttggttgatatagactgctggagggtggccatgttcagtggaatcctgctcaggattgtgttacaactcacctgccgcatctactagtcctttaaaattgcatgcgctggagcgtcgggcccttatccgggcgtcgttggtagtcgagagtgtactgaaggctgtgttcgctaaggatgtgttcgctaaggatgtgttcgctaaggatgtgtgcgcgaaggatgtgtgcgcta

SEQ ID NO: 505345 - DNA, 391 bp, Homo sapiens
gacgtgggctagggcatttttaatctagacatgtttgaaaccagtcactttgtgtctaaaattagctgtagcacatggatgtggtcgatattaagctatcggctgtttgaattatagatgcgtctacagtatttgtgtgggcatagtttttgtaaaaaaaagattaaaaaatatcaggatggtggaaaaactagatccgtgtatctctgttttggcatgcatttattcagtatcttctagcaatggtttttctctgttgatctaccgtagtatcctatttttaagtttattttatttttaaggagtattgtcatcacttttcaaggtgtcttgacttctacacaaagtatatatattcaggactttaaaaaatagcagtacacatttaaca

SEQ ID NO: 505346 - DNA, 129 bp, Homo sapiens
cttctttcatgggccaaactcccgagttactttgttgtagaatccagcctactgaattattttatgatatctctgtttgagacaggagtttctctgctcacccatgctggagtgcagtgactcagtctt

SEQ ID NO: 505347 - DNA, 611 bp, Homo sapiens
ggtgttgtggtgcaagtctcgtacgcgtggccgtcagtgtcgtcctgggcgatgtgccatgcaatgttgtgtgccagtctttatacacaggggatttctgtttgggatggggacaccatgttgcccccgtggcctttcccatgcgtgttttctcccatgtcgcgtaggtattgctgatggcctgtatttcctgcgttcgtgtttgataaccggcgtcctgttttgccccccggtgggccactcccgtgtgggtttcccagcgcagtacaacccatgtgtgagatccccgtctcacatgcccctatggggtaaggcactacctaactcccacgcgggggggagcccactcacacacgcgggtgataactttatctacagcacctttccaataatagaagacaatcttttgacagaggatatacatttggtccagcaggaagtatccgtatgcttgcttacttggcacctgtggagtctacgacagctgcacccgtcatctttatcaggagcacaacaaatgccccggtgttgagacccatacccgctgttgctggatggaaaatttgattcaagcgtttcaaaaaccctttgtttttaaacactgacaaaac

SEQ ID NO: 505348 - DNA, 157 bp, Homo sapiens
cgttcccttcatcatactaccaactaatgacaaatgaaaaaacgaagttatgggaacgacacaacaacatgaatgaaatggtgacgggaaatgcgaatgcgcacaggcaagcaataatgcaaatgtgcagcggcacaggcacatggaatgcaacatg

SEQ ID NO: 505349 - DNA, 81 bp, Homo sapiens
attccagttcagttaagaatttagctgtgtgtgtcggcttctacttccatcagcttctgcatgaaggctacatgatggcat

SEQ ID NO: 505350 - DNA, 976 bp, Homo sapiens
gcaaaacaccaaagtggctggatgactgccgtgtgcagctgggtgtgtgtgccctgtgtggtgccctgtgtgtgccctgtgtgattgggtgaacctgctgtgtgtgcttcctgctggatgtgtttctgtgcatgtgtgcatcctggtgtgccggggtctgctgtgcctgtggactgtgggcctggtggcctgatgtgcctgctgtgatgctctgctgtgatgtgcaatggcctgatggactaaagtgacgttggattgccctgtcaccaagtttgtggccgcttggtcaaggacatgaagatcaagtccctgtgaggagatctatctcttctccctgcccattaaggaatcagcagatcatttgatttcttccttgggggcctctctcaacggatgaggcgtttcgacacgattatgccagtgcacgaatgcatacccgtgcctggccagtgcaccaggttcaatggcattttgtatgctatcggtggactacaaatggccaccgtcggctcttgggtgttaagtgctccaaggagtgtgtgcaccgccatccgtggggccatcatcctggccaatgctctccatcgtccccgtgcgcagaggctactgggcggaacaagatcgcgaagccccacactgtcccttgcactggtgacacggccgcttgcggctcttgtgctgggtacgcctcatcccttcacccaggggccctggcatcggtctcgcacctgtgcctaaggaagctgctcatgatgcgctggtatcgcatgactgctaccactccagtccggtgctgcattgcacgctgggcaacttccgcaaggccacctttgaatgccatttctaagactaaatgttacttagccccgaagtctggaatgagagtgatttaccaagtttccatatatgacgttactgacaaatatgacaaaacaagcaaagtctcgaggaggcgacgaggtacacatatggcaac

SEQ ID NO: 505351 - DNA, 167 bp, Homo sapiens
gttcaagtaagggccaaggtaagttctaggcagctgtctctttgccgtgtgtgggcccattgtgggccagcgggtgttaacttgtgggtattggaaaaggattggattaggtgagccttcaggctggtcagcggggcggtcactgggccctttgatcttctttatat

SEQ ID NO: 505352 - DNA, 305 bp, Homo sapiens
acccgtccagtacgggtgtgccagaatagggatatcatagagacagaaagctgaatggtgatgccagtgactagggagaacacgaatggggagtgactgctgcactgggtatgggtcttcttggggcagcaaaaatgctctaaaattagtggtgatggttgcacaactctgtgaatatactagaaaccattgaattaggccaggctcagtggcttatgcctgtagtcccagcactttgggaggccaaggtgggtggctcacttgagcccaggagttcaagaccagcttgggcacacattatggag

SEQ ID NO: 505353 - DNA, 380 bp, Homo sapiens
ccgagcgcggacctgcaggcatggcagtcaccgaccaggcagcccgcaagaaggagcgcgtcctctggctgttggacgtggacgggaccctcacgccggctcgccagatcgcagtggagggcggctctgactactgtcagaccgctgagcagctgactgacggagatgaagtcattgagaagattgattatgtgcttgccgagagcgtgacggtgcaggataagcacggacgactgctctacaagcagaccattcagaaccacctgggcaaggagctgcaggaggacttgatcaactactgactcagctacatggccttgatcaggctgcccaagaagcgtgacacatatactgagttacggaatggcatgctgctctcc

SEQ ID NO: 505354 - DNA, 344 bp, Homo sapiens
gattgaaggcaagcacagccacacaatctttcttttttctttttttttggaggcggaatcttgctcttgtcgcccaggcgggatctccactcactgcaacctccacctcccaggttcaagcaattttcctgtctccggcccccacgagtagctgggattacatgtgcctgccaccacacctacctaagttggtattattagtagaaatggggtttcaccacgttggccagacgggtcttgaactcctgacctcaagtgatccacctgcctcggcctcccacaatgctgggattacaggtgtgagccaccgtgcccggccagccacacaatcttaacgagaaggc

SEQ ID NO: 505355 - DNA, 310 bp, Homo sapiens
aattgagaggactgcacaccacggcctgctctgaaagaggatattacttgcttctaaaactgcaggtgcacttgtcctctccaacaaggtgtgaagcaggggcagctggttctcactggtctttgaagtggccttctcttttccacaacgcggtatccctctttccggtcatcagtggcaaaggttgaataaagagtttcttctccaactacttccttctgtaatgtcatttcaaagctcgtgcaggactttcaggcagcccacctggccatagtatgcggcctcgtcagcggcagccagccctccttgt

SEQ ID NO: 505356 - DNA, 513 bp, Homo sapiens
gggaaatctaggcgaaagtaatggggaagattagaaagaattagccacccgggctccagttgatatttaaaagatccctttaaaacaagctgatagggggtggttaagcaggacatcttgggcatgcaaaaatgaattccccccccccccctcttttttcaattaatggaaaactgttaagggaagctgatacaaagagacaccttgctcctttccctcagctttataataaactgtttaacgggaggtttcagtagccccttggttttgcctctttaaattatgacgggcccaaacctttttttcaatgcaatgcctttgaaagttttgaaacctggaacctttttttttttttgggtgcaattgtttaagaatcatggatttattttttggaactctttgggtattgtccttgggtatcctgacagcgccatgtgggtcagcccatgtccatcaagatgggtggttatgaaatgccaggcttctaaaataaatgtttaggaattcacaaca

SEQ ID NO: 505357 - DNA, 241 bp, Homo sapiens
gaggcaccttggggccttctttttccttttgggggtcctgggggccctcattaaaatgtgtgaaataccaaaaatggacagccatttggtaaaaaagttgggccagcaccttttaccttggatggaccggctttccttggagcacttgaaccccagcatttatgtgggcctacgcctttccagtttgcaggttgggaccaaggaaaacctttacctgcacgccaacccataaaaaaaaaaa

SEQ ID NO: 505358 - DNA, 904 bp, Homo sapiens
  misc_feature (62)..(62): n is a, c, g, or t
  misc_feature (70)..(70): n is a, c, g, or t
  misc_feature (80)..(80): n is a, c, g, or t
  misc_feature (257)..(257): n is a, c, g, or t
  misc_feature (278)..(278): n is a, c, g, or t
  misc_feature (293)..(293): n is a, c, g, or t
  misc_feature (300)..(301): n is a, c, g, or t
  misc_feature (372)..(372): n is a, c, g, or t
ttaggaatccataatatcaaatgcaaaaaaagaccccggccggatggtgaggtctgtgatgnagctggtngttctgactngagcgccgtaacctatcgtggacccatgtaatggcggccaggatgatccggtcgtaacgcttattcaactgattgagtcgttcacttgtcgcgttgtcatcagagcatgctctgaccaccatccgctcatggcgtgacagagcacgtcgcaaacgttgacccttttcgcctcgccanacagcgagcggcatcgcgccngcgctggcgggtatngtggtgnngcttcccattatgcaatctcctgaagttgcgttttcgtgtcttcaggaaatgctccaggcaggtgtaaatnggcgcttctcaagcctgtcgtctggggctgactctattcaagatctggctcgtcgaatgaaaaaatcgggagaagttctttttcctagttagacggttcggcggattcgagcgagcttcaccggcacagtgcccaagcgatagctgtcaccaaacaatgtcgcactcatgaaaccatcgcgtttgatgtcagatttgccgacggtgcgaagttcgccgttgtggagaaccgtgtcgccagggcggatcatgtcgatgtgagattcaaccgtttcatagttcgtcatggggctttcctagtgctggtggaccgtcgtaacgggcttggggataagtagaaatcaaccttgcagcaaagggccgatgtcacctctaacaacaagatggcatttgaacagtctgctgttgcaggacatgagcaagacggcacattggcgtcgatgaaaacgcgaaagttactttgccagggcttaactttctcatctcgcctcaaagagagcggcatctccccagcaatagcggatatcgtggta

SEQ ID NO: 505359 - DNA, 577 bp, Homo sapiens
  misc_feature (112)..(112): n is a, c, g, or t
  misc_feature (244)..(244): n is a, c, g, or t
  misc_feature (260)..(260): n is a, c, g, or t
  misc_feature (265)..(265): n is a, c, g, or t
  misc_feature (376)..(376): n is a, c, g, or t
  misc_feature (506)..(506): n is a, c, g, or t
ggaacgaggcactgcaacaactcaatagaggggtacatcatagtcagagttcagattttttatgataggagtatcaagttcgtagtctggggtatcagatatgtgaccaagnacgggaacttctccacatcgtagcactacatgactaatctgaaaggaataaagcactgaatcggctactatacattctgatagggtggacccctgaggagtgtacagagagcatcatgaggcgcccacaccnacagcagagcggggtnctcanacaggggaatctcccagtctggtagcgagaaatcgtcttttcctcatgtagctcataatactgacatctctcaacagtcaagatgaattctcacaccagatcctacccctntcccagagccacatgtgtcacacaagtgtagtagaatggcaggggatccaccacaagatggaggatggccaggacaaacccgtgcctgttcctcctcaaacgcgttttttaggcactaaggaatctcttntattctttcaggtaaacccggccgcggattatcttactacttggagggggcccctccccaacttttccatc

SEQ ID NO: 505360 - DNA, 132 bp, Homo sapiens
gagtcgagctggtaccagttcaatagcacctagcttttagaagtttcaatagtcctagttttagaatgtttcaatagcaccttatatagtatgtcgtcactgaagacttgattcagaaaagaaaaacctctt

SEQ ID NO: 505361 - DNA, 686 bp, Homo sapiens
ccttgggactcgaactgagcctcaagctcagctacctggaagagtgtcgatggatggcacctgtgatcctcagatgaccccagtcacgtcgggaccacaatggggcatccgattatgagagcacagagtgtctgccaacaagcgttttacatattccatgctaggcgtgagccaccacaacgtcatcttggcgaaagcagcctcggcgatcgtcagcgctcagtgctgctatggcctgtcgatgagccgccagcactcctcttagactggctaacgccctgccgttgctccaggggttgggtatggcagctgcaaggccagcacgacgaggcctgacggcttgcgggcacgggtcagctggctgagccgtttaccgtgctcacggcccccattctctggaggtcgtatctggagtggtcaagggacgcaagggcagacactggccgatggctctacacgcgtgtggatagctcagcaaggtgtaacgctgggacccagggacaggtagtagcgcctgcgttgcggttcatgccgatgccgtgcgacgcatgatccctgacgatcgtgactacacactgtgagtggcatctgttgccatgttcctttagtagcctctcaatttggatctgagttgattctccgagaacacattggagacattcacgttagatgcttcgggaattaat

SEQ ID NO: 505362 - DNA, 984 bp, Homo sapiens
  misc_feature (188)..(188): n is a, c, g, or t
  misc_feature (984)..(984): n is a, c, g, or t
gctgcttcctcctgtttccccgtgcgccgacgccgccatcatgagggagcatcgtgcactggacagcgccgagagcaagtgcgggtgaccaaatcggtgccaagattattgggatgggtgatcagcgatgatggcacgggtatcgatcctccacgaggtcatcctaccacgagggtacgagcgacctngcagctgggaacgcatcatcgtgtcatctatcggatgtaggccgagcggcgggtaagtacgtgccccgcgccgtgcttcggtgaggatcgatggaagcctcggcatccatggactccagtgcgcgtcgagcggcggcctatctgggcagagtcttcacggccggcgagaactttcgttctactggtcatgaagtggtagctcgggaacaaactggggcaacggggcatctaacaaacgtaaggcagcgagatgctggatggaccctcaggtgcatggatctgttagtgagcaaaggacggcctgtatgagtcctgtgatcgtgcctgtggatggggtttccacgtatgaacaccagctcccatgtgatggtagcggcactgggcgctctgtagtgatgtgcggtaacccatccgatggattccgacccaaaaatcccgggggaaggacagaatatgcactgggacaagttgaattcaatgcccgacaaccgcgttgacagtgatgcgatgttgcactttcgacccacgaacagcttgtgttcgaactaaacaagtgtgggtgtcgccaggaacccaataccagttgggccacaaaacgcgcacctttcacgaaacacagcggaattcgggcccgattcagcattaaatattaactacgcatacgatccaaactcgaaatgtgtgctctttcgagataagcacagaaacggtcttactaaccttgggcgtggcaatcaagggcctcgcacaagaatttctcggcaaatttaggggcacgaaggcatccggctgtggn

SEQ ID NO: 505363 - DNA, 110 bp, Homo sapiens
acgaagcctcgatcagtaagtaaactttaatgtaatacttctctgtttcctggactttttctttttcttcattactattattattgagacagggtctcgctctattaccc

SEQ ID NO: 505364 - DNA, 708 bp, Homo sapiens
acgatggcgctggcctgaagtcggaaagattggccataatctactaattgcatgtatcgagatgggctgcttgggccatgacatgatgagcgcgataatatcgtacttttgtagcatatcactgacttagtaacaattagcgaccatcgccagcgagacagacgaatctctatgactcgcacgcgtatgattaatcgagggcagactcttacacgagtctttaggttgaatttgatcatactattagttcttagaggcgtcaaagtagtccacgtgctactattagacaaagtgctgacaaacgagttcgtactaatctacctacacatgaacatggtcaaggtgtactatgactacgcacgcatagacatcgtaggattactgatctgcttcccgccatgaggccatttagtgtagtatggcgtgacctgttatgagatgcaggaattagtactgaatcaaagcgataaaaacttcttctacaggcctgaaaggctatcatattggctgcacggacttccgactgaccttaagctaataggaaagcgacaatgactaatagtagtcatgtcaatctatgaatactcccatgaccatattgtcaacaccctagatacttttagggccctatgcaataaatttattgactactagccgaaggaccactcactttctgtcgatggctcaccagtaggtacccatttcccc

SEQ ID NO: 505365 - DNA, 109 bp, Homo sapiens
cggatatgtactccccggggacagtccccacatgattacaaaagccaggtgcctcatcaccacgttaccctgacctgtccacttgtatatgaataaaccttcagtctcc

SEQ ID NO: 505366 - DNA, 298 bp, Homo sapiens
agatccccgaagcgtggctgggtcattgtgcacaatgacccagaagtggagaagatgcaggctggaccaccgggggacatggaggctgcggcactaccgtgctgtgaaatacaatgcggattaagttcctggtcatcgccctcaagagctccgtgtgggtgtatgcctgggcccccaaaccctaccacaaattcatggccttcaagtcctttgccgacctcccccaccgccctctgctggtcgacctgacagtagaggaggggcagcggctcaaggtcatctatggacccagaccagg

SEQ ID NO: 505367 - DNA, 133 bp, Homo sapiens
tttagacaggcaatcccaggatagcatatgagaacagctgctgctttcacgaagggatcgtggcataagcaatgataaggctggcaagatgactgtaccaataccgagcaccaggaatcagacacactcctac

SEQ ID NO: 505368 - DNA, 190 bp, Homo sapiens
  misc_feature (151)..(152): n is a, c, g, or t
ggcggcgctacagccgaaagccacggtataagcttggaatggggtcattctattatttcactacaaacagcatagaaagcaagagaagtcgggaatttattctaaaatagaatggaggttgtcatctacacgcagcactcctcactcctcnntgttgccatttttagcagagtactcccttgtccgagca

SEQ ID NO: 505369 - DNA, 1160 bp, Homo sapiens
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatat

SEQ ID NO: 505370 - DNA, 304 bp, Homo sapiens
  misc_feature (87)..(87): n is a, c, g, or t
  misc_feature (190)..(190): n is a, c, g, or t
  misc_feature (192)..(192): n is a, c, g, or t
  misc_feature (195)..(195): n is a, c, g, or t
ttcatagagtggccccatcagagaggtggtaaatctcaacagttatctcaagattacagaaacgtcaagtcctctcctttcaaatancatgggaagggcacttcagtacaaaagaactccccatctttgtacagaagtgttaaataaacatcataatagatttggagaaagaacacacactccacccatncnctncttcttactccaagggatacagcagcaaagaatttctgctcctacaggcaacttcaggggattaaaaaaacagtaactgccagctggagggatagattaagacacatta

SEQ ID NO: 505371 - DNA, 1210 bp, Homo sapiens
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcaatggagtttcagtttcctggaggccatctgtggagtttccagggaacctgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatat

SEQ ID NO: 505372 - DNA, 4218 bp, Homo sapiens
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacactttcaatgtgtcttccatttgatgaatttgtttttctctctttatccccgcaaggtggagtttcatgtcctcggtgaaaccagacagtgtgaatctgttccagcccaaatctgcagcattagggatgagttctcagaagtgattctgaactgagcacgcactcatgtctgcatggggaactctggggagaagagccttccttttctttcccttgggcatttgcctttccttgtcgtcttactgaggcggaggcaggaggtctctgtcttccaggccctggccaggccatcctgccatcaggaaagatggaagagtaggcctccgtctagcagccctggctggaaatcccccctctagatcctgctgcaagactgtacaaactcacaggggccatgtccacccaggcacatcatcagaaccagggagcacagccttgccacctagaaggggcctcagcagccgtgcaactttctttccctatctccaatccagagagggatcctctaacattctctagcaacctcatctgcacccccaccaccttccttgtaagaaagaccacgtgtgactaaaatcccttcacgctgcatttacccaggttactattgtgcgcgcaaaatgttttcacagtgttctcagcctttgctcctccaaacagaaaacgtttcccctgcgttactgttacttccctatttttgagtcctggggtgactgtctcttaaatgtgccaagatgtgagcaagctttaaaacatgacagctcagtgttaaggagacagaaagcttcctctttctctgttctattgcaactacaaattctacagtcatgcctaagatcctttagctaacacccttttcaagaaatcatcagactcttggattgacttagaattcattcattcgttaagtgcttaccgagtccccgctctgtggcaagcactgttctatatcaacttctcatgagttcagccaattctaggtgcaccagccaaggaaacttcatgcctgccctctctgagctccatactctgaggtggtggtcttatcaagatgggatcgccttgtacatccctgtgtagccaagtggaaggccagccaaccaagaatgcatctcactgggcctatgggacatactgtgcctgcactgctcctccacgtgactgcatcaggttaaactggtcagagccctggatgaggagctggaaaacatgcatccagtccaagctctgccacttgggccaagtgtgctcttgaacagtcacttaatatatctgctttgatttgtcttttaaagaaaatatggaggcaggaataccagtgtcagtgtagcctgcttcttgagtgttggcacaagtgagataatgtatgaatcagtaaaatgctgggcaaagcaaagaagtagggctgcctgggagtggattcctttttatggtgagttaagacgacttcacaattgttagctgtgatgcctgcagtgtttgaggatggcattgccttcatcctgtgtcagctctgaagaagttggcaggagcaaagctaagcctcaagtgtaaatcccagcatcatggaacgcaaatggatgagcttttgttttaggatcttcttgctgattcctacccagaggacttccccagcctagagaccagaaacctgggcaatagttatatcttcagtggccctaggagttgttgtgtctccttggggaggagagaaccttctaaaacaggccagagacaggaggtactgggagggccatgggctcacctgcatctatgcccagataacctgggacagataacctctgtcccaatcacttgctttgcctggtctctcaaggagtctcttggtaccccaggcccacggccagctccatgctcatccctgtccccaccttccagtcttgatgaaaacccaccttctctttcatcccttggctgcttgataagacttaaaacaattccctgattttagggaaggccactgcgtgcacagatggtgagtttgtgcaggcaaggaatgtgccctccacatcacgtggcctccttgcccagcctgggtcatgggaagggagtgttgaattgaatcacgtctttcgttggtagattatgttcatcttcaatgtttctattaagtctaaaaagtggatacaaatggtgcctccaagttcttgtctaattgcttgtctactgcttgacaaaatccagaatggaataggccaaacaagttaaccagcaggacagaaactgctctaagcccattattccttgagatgaatagaacagtgagctgaacgcctgctctaatgaagccactaaaggggtttacaggaaggttaggagcccagatgggttttgagtccactgctgggaaacagattcttcacttcctgtggaccctggagaagccatcagattacattaacatggctccactgatgatggcctgagaattactattgtttgtgtttcatctgtgtccttgccaggtcttcccccacatccttacttcacaggatcaggggctgagaggagaccaatactctggcccaggcctggtcaagggatgctggttgttgctgatgcaaagtcacattgcctggtcctgagcttggcaatcaggcatccagagatggccaaaccaaatatccctttggccaggcactcaggcattccctgtaatgttgtgcacttaaagcatcttgggctgatagtctccaccgaatcacagaagaaaactcaatctgccgcatcactcaccagctggataagccatttactgtacacagtgtgtgccctcttatcaatacattggcacagaaccatacaccgtagaagctgctgtgatcactaaaggcaatgcccgtttagccctgagcacagtgcttggcatgtggtaggcaggtttgtgtcagctctaactgatggagtatggtggaggtgatgccatgcaact

SEQ ID NO: 505373 - DNA, 906 bp, Homo sapiens
agttcaggaaaagcctggtctccaagtaaagtatctgtatcatctcatttgtcggctttcgttatgaagaatgcaccacagtgttaaagcgaaatcatgctgagacttatttgtagctataacccgagtccagttctcatctacggcagatttgcatccagtgaaacgtcgagtacttgtggacattagaggagaaatgtccataggaatttaagagaactagcatggttgaccacaaatgttacccacaaatacctgatcacctgagagaaccattcttagaagccactgacaattctcatctgaggtccgatgccagcaagcttccttcctccttcatcagtgaagaaacgaggtgtacttcttttgggagacgcatataatatgaggcatccacttacgggtggaggaatgactgttgcgttttaaagatatagaaactatggagaaaactgctgaaaagggtatccctgacctttatgatgatgcaggctattttcgaggcgaaagaatgcattttactgggaagaaaaaagtctcattcctttgtcgtgaatatccgtggtcaggtcttttatggattatttggtgcacagatgattcgctgctatcaggtagaaaagctgtttctttatttcaacgttggtgggaatgggtgcgggtccgggggatggttctggatgggtcttaacatctagttttattggggactgttggtgggaacgagcggagtttgggtagatcaactgggttcaaagtgggcactcttgtgggggttgcaacaggggctggggattcccattcggaagaaatgtttggagggggaagttgaattataattaccagaattggggagtataacacacagagggaagcgaggggggtctttattataggagaaagtag

SEQ ID NO: 505374 - DNA, 4217 bp, Homo sapiens
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacactttcaatgtgtcttccatttgatgaatttgtttttctctctttatccccgcaaggtggagtttcatgtcctcggtgaaaccagacagtgtgaatctgttccagcccaaatctgcagcattagggatgagttctcagaagtgattctgaactgagcacgcactcatgtctgcatggggaactctggggagaagagccttccttttctttcccttgggcatttgcctttccttgtcgtcttactgaggcggaggcaggaggtctctgtcttccaggccctggccaggccatcctgccatcaggaaagatggaagagtaggcctccgtctagcagccctggctggaaatcccccctctagatcctgctgcaagactgtacaaactcacaggggccatgtccacccaggcacatcatcagaaccagggagcacagccttgccacctagaaggggcctcagcagccgtgcaactttctttccctatctccaatccagagagggatcctctaacattctctagcaacctcatctgcacccccaccaccttccttgtaagaaagaccacgtgtgactaaaatcccttcacgctgcatttacccaggttactattgtgcgcgcaaaatgttttcacagtgttctcagcctttgctcctccaaacagaaaacgtttcccctgcgttactgttacttccctatttttgagtcctggggtgactgtctcttaaatgtgccaagatgtgagcaagctttaaaacatgacagctcagtgttaaggagacagaaagcttcctctttctctgttctattgcaactacaaattctacagtcatgcctaagatcctttagctaacacccttttcaagaaatcatcagactcttggattgacttagaattcattcattcgttaagtgcttaccgagtccccgctctgtggcaagcactgttctatatcaacttctcatgagttcagccaattctaggtgcaccagccaaggaaacttcatgcctgccctctctgagctccatactctgaggtggtggtcttatcaagatgggatcgccttgtacatccctgtgtagccaagtggaaggccagccaaccaagaatgcatctcactgggcctatgggacatactgtgcctgcactgctcctccacgtgactgcatcaggttaaactggtcagagccctggatgaggagctggaaaacatgcatccagtccaagctctgccacttgggccaagtgtgctcttgaacagtcacttaatatatctgctttgatttgtcttttaaagaaaatatggaggcaggaataccagtgtcagtgtagcctgcttcttgagtgttggcacaagtgagataatgtatgaatcagtaaaatgctgggcaaagcaaagaagtagggctgcctgggagtggattcctttttatggtgagttaagacgacttcacaattgttagctgtgatgcctgcagtgtttgaggatggcattgccttcatcctgtgtcagctctgaagaagttggcaggagcaaagctaagcctcaagtgtaaatcccagcatcatggaacgcaaatggatgagcttttgttttaggatcttcttgctgattcctacccagaggacttccccagcctagagaccagaaacctgggcaatagttatatcttcagtggccctaggagttgttgtgtctccttggggaggagagaaccttctaaaacaggccagagacaggaggtactgggagggccatgggctcacctgcatctatgcccagataacctgggacagataacctctgtcccaatcacttgctttgcctggtctctcaaggagtctcttggtaccccaggcccacggccagctccatgctcatccctgtccccaccttccagtcttgatgaaaacccaccttctctttcatcccttggctgcttgataagacttaaaacaattccctgattttagggaaggccactgcgtgcacagatggtgagtttgtgcaggcaaggaatgtgccctccacatcacgtggcctccttgcccagcctgggtcatgggaagggagtgttgaattgaatcacgtctttcgttggtagattatgttcatcttcaatgtttctattaagtctaaaaagtggatacaaatggtgcctccaagttcttgtctaattgcttgtctactgcttgacaaaatccagaatggaataggccaaacaagttaaccagcaggacagaaactgctctaagcccattattccttgagatgaatagaacagtgagctgaacgcctgctctaatgaagccactaaaggggtttacaggaaggttaggagcccagatgggttttgagtccactgctgggaaacagattcttcacttcctgtggaccctggagaagccatcagattacattaacatggctccactgatgatggcctgagaattactattgtttgtgtttcatctgtgtccttgccaggtcttcccccacatccttacttcacaggatcaggggctgagaggagaccaatactctggcccaggcctggtcaagggatgctggttgttgctgatgcaaagtcacattgcctggtcctgagcttggcaatcaggcatccagagatggccaaaccaaatatccctttggccaggcactcaggcattccctgtaatgttgtgcacttaaagcatcttgggctgatagtctccaccgaatcacagaagaaaactcaatctgccgcatcactcaccagctggataagccatttactgtacacagtgtgtgcccattccaatctctgcccacattgcagattcatgagaaaaataaatgtcactgtttgggggtgaatcatgacacagttacagtacttgaaacattttgcgaagccaggcatgaatgtcatatgaaattctaataaatccattttatttgtggcccccca

SEQ ID NO: 505375 - DNA, 174 bp, Homo sapiens
acattatccgtcagatgccacaatatgttctattcgtagaaaactatgtagttttgtctttgttggatagcttttaattacatttcagagaggtgtaattttgggtagatgctcattacatttttgaaaggtttatgattccaaaataaagatttatatgactgttgtaactgg

SEQ ID NO: 505376 - DNA, 479 bp, Homo sapiens
aaacaggtcatcagtataatgtacttgtatggttttgagtgaaatagcattgtcttgacttctaatgtgattgtgctgtcttccaagagattgtttgtaatgatttcatttctttgcctttgctgaggagtgttttactgctgattatgtgatcagttttcaaatatatgccatgcggccataagaagaatgtacattctgtttcttggggatggagagttaggtagatgtctatcaggtccatttgatccagtgctgagtttgggtcctgaatatctgtgttaattttctgtcttgattatctgtctaatattgccagtgggtgttagactcccacacaataatagtcggagactttatgtctctttgaaggtctctaagaacttgctttataaatctggatgctcttgtgtcacgtgcatttatatttaggatagttagatcttcttgttgaattgaacccccaccattatctaatt

SEQ ID NO: 505377 - DNA, 4268 bp, Homo sapiens
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgccgggaaggcaatggagtttcagtttcctggaggccatctgtggagtttccagggaacctgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacactttcaatgtgtcttccatttgatgaatttgtttttctctctttatccccgcaaggtggagtttcatgtcctcggtgaaaccagacagtgtgaatctgttccagcccaaatctgcagcattagggatgagttctcagaagtgattctgaactgagcacgcactcatgtctgcatggggaactctggggagaagagccttccttttctttcccttgggcatttgcctttccttgtcgtcttactgaggcggaggcaggaggtctctgtcttccaggccctggccaggccatcctgccatcaggaaagatggaagagtaggcctccgtctagcagccctggctggaaatcccccctctagatcctgctgcaagactgtacaaactcacaggggccatgtccacccaggcacatcatcagaaccagggagcacagccttgccacctagaaggggcctcagcagccgtgcaactttctttccctatctccaatccagagagggatcctctaacattctctagcaacctcatctgcacccccaccaccttccttgtaagaaagaccacgtgtgactaaaatcccttcacgctgcatttacccaggttactattgtgcgcgcaaaatgttttcacagtgttctcagcctttgctcctccaaacagaaaacgtttcccctgcgttactgttacttccctatttttgagtcctggggtgactgtctcttaaatgtgccaagatgtgagcaagctttaaaacatgacagctcagtgttaaggagacagaaagcttcctctttctctgttctattgcaactacaaattctacagtcatgcctaagatcctttagctaacacccttttcaagaaatcatcagactcttggattgacttagaattcattcattcgttaagtgcttaccgagtccccgctctgtggcaagcactgttctatatcaacttctcatgagttcagccaattctaggtgcaccagccaaggaaacttcatgcctgccctctctgagctccatactctgaggtggtggtcttatcaagatgggatcgccttgtacatccctgtgtagccaagtggaaggccagccaaccaagaatgcatctcactgggcctatgggacatactgtgcctgcactgctcctccacgtgactgcatcaggttaaactggtcagagccctggatgaggagctggaaaacatgcatccagtccaagctctgccacttgggccaagtgtgctcttgaacagtcacttaatatatctgctttgatttgtcttttaaagaaaatatggaggcaggaataccagtgtcagtgtagcctgcttcttgagtgttggcacaagtgagataatgtatgaatcagtaaaatgctgggcaaagcaaagaagtagggctgcctgggagtggattcctttttatggtgagttaagacgacttcacaattgttagctgtgatgcctgcagtgtttgaggatggcattgccttcatcctgtgtcagctctgaagaagttggcaggagcaaagctaagcctcaagtgtaaatcccagcatcatggaacgcaaatggatgagcttttgttttaggatcttcttgctgattcctacccagaggacttccccagcctagagaccagaaacctgggcaatagttatatcttcagtggccctaggagttgttgtgtctccttggggaggagagaaccttctaaaacaggccagagacaggaggtactgggagggccatgggctcacctgcatctatgcccagataacctgggacagataacctctgtcccaatcacttgctttgcctggtctctcaaggagtctcttggtaccccaggcccacggccagctccatgctcatccctgtccccaccttccagtcttgatgaaaacccaccttctctttcatcccttggctgcttgataagacttaaaacaattccctgattttagggaaggccactgcgtgcacagatggtgagtttgtgcaggcaaggaatgtgccctccacatcacgtggcctccttgcccagcctgggtcatgggaagggagtgttgaattgaatcacgtctttcgttggtagattatgttcatcttcaatgtttctattaagtctaaaaagtggatacaaatggtgcctccaagttcttgtctaattgcttgtctactgcttgacaaaatccagaatggaataggccaaacaagttaaccagcaggacagaaactgctctaagcccattattccttgagatgaatagaacagtgagctgaacgcctgctctaatgaagccactaaaggggtttacaggaaggttaggagcccagatgggttttgagtccactgctgggaaacagattcttcacttcctgtggaccctggagaagccatcagattacattaacatggctccactgatgatggcctgagaattactattgtttgtgtttcatctgtgtccttgccaggtcttcccccacatccttacttcacaggatcaggggctgagaggagaccaatactctggcccaggcctggtcaagggatgctggttgttgctgatgcaaagtcacattgcctggtcctgagcttggcaatcaggcatccagagatggccaaaccaaatatccctttggccaggcactcaggcattccctgtaatgttgtgcacttaaagcatcttgggctgatagtctccaccgaatcacagaagaaaactcaatctgccgcatcactcaccagctggataagccatttactgtacacagtgtgtgccctcttatcaatacattggcacagaaccatacaccgtagaagctgctgtgatcactaaaggcaatgcccgtttagccctgagcacagtgcttggcatgtggtaggcaggtttgtgtcagctctaactgatggagtatggtggaggtgatgccatgcaact

SEQ ID NO: 505378 - DNA, 246 bp, Homo sapiens
acgattggacctcgtaaagctattgacataaacaaatatgtatgaaataaactacaagaaaaatggcacctatagacttgttctatcaaagtggttgccacagatgttcaattatgttaaaaatgaaaatttgcagtatcttgaaaactacaatgaaggagaagcacaaaaaacagggtgtgcctgtgattttcattgacaggtacaactcttcttggattttttgggagaggggttttcgccctg

SEQ ID NO: 505379 - DNA, 799 bp, Homo sapiens
caagttcccccgagacatgaaggccatgtccccagaagaccaggagtatctcgagaagcgatcggtggccacctgtgtggtacctgaaggaggaagatcattaccagcgggcacggaaggagcgtgagaaggaggactacctccatcctcaagcggcagcccaaacggcgttggctcttctggaacagtccatccctccccgtcttcctcggcagaactccgtcgcgtcatccccatcttcctcctcggctgtggtctgagatgcatgcctaccgctcttctgaccctgctgcgtgttgtccccatccgggcttcacccctctgtctcgttccgcgatcgagcccatccaccttaccaagggaccagggggaccacgtaatcaggatccagagggtggagctcttcttatccagccaccgtggtctcagctcagagaggagctgagtccctgtggagacagaatcgggaagccaccgtgcagaggtccccagagccaaagctaggacgggagacaactgcttggaggagcgaagagccctggcattttatctctgggtttgagagccctagagtcaacagggaaagcctcccaggctccagggcttctctgtgtgtctgggtagctgactctggacaggaggcagccccactcccagcaagcagaagtgatcctcgagggtcctggcccctgtttggcagtatctttccatcggacggacttgagtgtagcaatagtttagagggaattccacaggaagcctagtccaaccctcatggagaagtcaggttgaacatggg

SEQ ID NO: 505380 - DNA, 1164 bp, Homo sapiens
ggtcgcccgcgcatggactaccgcggcactcccggctgcacgctctgcttggcctcgccatgccggtggacctcagcaagtggtccggtgcccttgagccgtgcgaagaagatggacgagcagcctgcagtgacccgcatgacatgtcaccatacagccagggtgcgtgcgggtggacgagactgggcaaagtgctgagcgcccacccaggttcacggaatagacccaccagcatattcgtgggcatggtccttgcatttcagtggcacaagcgtctacacacttgggtcctgaccaggagcccgggcattgcgtcccaagccgatggaaacgggactcccaaaaatacatgaagcaaatggcaagtcacattgtccttgggtgggtccaacgatgaacaggggggcacagtgaccattcaatgacaaagtgggacaacaaggatcacttcattcgcagcaatatagttgttagagagcatacgtgtgagcccttcccacaaagacggggcaacccagtgggacattccaaccccgggataaaatggttatagggcacatgagatatgtgccagacagcaacgacgacacaaggggcactgcgttacacaagattggttgcacggacgggctccatgttccgcgtccagcacaagaccccacacgtccttgggaacgcgaccgcaaccccggttgtggcgtacaccattttcaaccaggggactgtgaccgtgtcccagttatcgccagcataccacaactgattaattgagggccttccaacggagggcccccagaggatagagccatgggaccaacggaattggatgagacacaaagggtgccaggaaggatgaggcaaatggacccttactagttggcacgcggaaaacaccattggattacccgacaaggcccatggactctgtgctctggttggggcgaaaacagcgcttaaagcggggaaggaggatattaaaggtccctttcagggtgagtgggacacacacgttggccagaaacaatgggatgcccccgtaggatggaaggggtcacaccgcgacagtggactccgacctgtgtgtttgcgcccccagcagggagtattacaagcgcatggatattggcgccatatgtgatcatatgcacaatacgcgaaatttat

SEQ ID NO: 505381 - DNA, 392 bp, Homo sapiens
ctgagagggtgtcactggaagggattggcatgtgaagtggactgagcggtgcaaaatcctctactcgctgtggcaaggcacactccaatcacctaggggaccaggtagtaacagacaagcagaaaggagtaaaatgggctctctctctcgcactcactcttggaaagttgacctggccagggagatcagatctccaggttgtatgctcttgggtctctcgagtgtaggaccagtcaaccctttatcctcccacctcctcctctggcccctcaggcctttggccttggtctgagacaggatactgtcttccttggctctccagcttggaggtggcctctcatggatcttatcagcctccataactatgcgagccatttccactaataaatccg

SEQ ID NO: 505382 - DNA, 3945 bp, Homo sapiens
  misc_feature (54)..(54): n is a, c, g, or t
tggggagtacgggacttgcttccgtccctggaggcacgggagaggctgtggaantgcatccccgacaggatgggtttccatcctgaaaatcagcaggtccagagaggactcctgggtggagggcacagcaagggatgagacgcgatcactgtatcatggccatttccactgggctgggctctgcttacctgcctggcgctcgtccccagcacctctgctgcagatcataacacagctctgctgttgccttcacagggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacactttcaatgtgtcttccatttgatgaatttgtttttctctctttatccccgcaaggtggagtttcatgtcctcggtgaaaccagacagtgtgaatctgttccagcccaaatctgcagcattagggatgagttctcagaagtgattctgaactgagcacgcactcatgtctgcatggggaactctggggagaagagccttccttttctttcccttgggcatttgcctttccttgtcgtcttactgaggcggaggcaggaggtctctgtcttccaggccctggccaggccatcctgccatcaggaaagatggaagagtaggcctccgtctagcagccctggctggaaatcccccctctagatcctgctgcaagactgtacaaactcacaggggccatgtccacccaggcacatcatcagaaccagggagcacagccttgccacctagaaggggcctcagcagccgtgcaactttctttccctatctccaatccagagagggatcctctaacattctctagcaacctcatctgcacccccaccaccttccttgtaagaaagaccacgtgtgactaaaatcccttcacgctgcatttacccaggttactattgtgcgcgcaaaatgttttcacagtgttctcagcctttgctcctccaaacagaaaacgtttcccctgcgttactgttacttccctatttttgagtcctggggtgactgtctcttaaatgtgccaagatgtgagcaagctttaaaacatgacagctcagtgttaaggagacagaaagcttcctctttctctgttctattgcaactacaaattctacagtcatgcctaagatcctttagctaacacccttttcaagaaatcatcagactcttggattgacttagaattcattcattcgttaagtgcttaccgagtccccgctctgtggcaagcactgttctatatcaacttctcatgagttcagccaattctaggtgcaccagccaaggaaacttcatgcctgccctctctgagctccatactctgaggtggtggtcttatcaagatgggatcgccttgtacatccctgtgtagccaagtggaaggccagccaaccaagaatgcatctcactgggcctatgggacatactgtgcctgcactgctcctccacgtgactgcatcaggttaaactggtcagagccctggatgaggagctggaaaacatgcatccagtccaagctctgccacttgggccaagtgtgctcttgaacagtcacttaatatatctgctttgatttgtcttttaaagaaaatatggaggcaggaataccagtgtcagtgtagcctgcttcttgagtgttggcacaagtgagataatgtatgaatcagtaaaatgctgggcaaagcaaagaagtagggctgcctgggagtggattcctttttatggtgagttaagacgacttcacaattgttagctgtgatgcctgcagtgtttgaggatggcattgccttcatcctgtgtcagctctgaagaagttggcaggagcaaagctaagcctcaagtgtaaatcccagcatcatggaacgcaaatggatgagcttttgttttaggatcttcttgctgattcctacccagaggacttccccagcctagagaccagaaacctgggcaatagttatatcttcagtggccctaggagttgttgtgtctccttggggaggagagaaccttctaaaacaggccagagacaggaggtactgggagggccatgggctcacctgcatctatgcccagataacctgggacagataacctctgtcccaatcacttgctttgcctggtctctcaaggagtctcttggtaccccaggcccacggccagctccatgctcatccctgtccccaccttccagtcttgatgaaaacccaccttctctttcatcccttggctgcttgataagacttaaaacaattccctgattttagggaaggccactgcgtgcacagatggtgagtttgtgcaggcaaggaatgtgccctccacatcacgtggcctccttgcccagcctgggtcatgggaagggagtgttgaattgaatcacgtctttcgttggtagattatgttcatcttcaatgtttctattaagtctaaaaagtggatacaaatggtgcctccaagttcttgtctaattgcttgtctactgcttgacaaaatccagaatggaataggccaaacaagttaaccagcaggacagaaactgctctaagcccattattccttgagatgaatagaacagtgagctgaacgcctgctctaatgaagccactaaaggggtttacaggaaggttaggagcccagatgggttttgagtccactgctgggaaacagattcttcacttcctgtggaccctggagaagccatcagattacattaacatggctccactgatgatggcctgagaattactattgtttgtgtttcatctgtgtccttgccaggtcttcccccacatccttacttcacaggatcaggggctgagaggagaccaatactctggcccaggcctggtcaagggatgctggttgttgctgatgcaaagtcacattgcctggtcctgagcttggcaatcaggcatccagagatggccaaaccaaatatccctttggccaggcactcaggcattccctgtaatgttgtgcacttaaagcatcttgggctgatagtctccaccgaatcacagaagaaaactcaatctgccgcatcactcaccagctggataagccatttactgtacacagtgtgtgccctcttatcaatacattggcacagaaccatacaccgtagaagctgctgtgatcactaaaggcaatgcccgtttagccctgagcacagtgcttggcatgtggtaggcaggtttgtgtcagctctaactgatggagtatggtggaggtgatgccatgcaact

SEQ ID NO: 505383 - DNA, 119 bp, Homo sapiens
ctagaggatcccgtaacgctgcaaattattccatagcacggataccaaatctgtggtttgtccgatatgtgcctcgatgccctggggagaccccaactaccgcagcgttccacagcgtt

SEQ ID NO: 505384 - DNA, 104 bp, Homo sapiens
ctcccacctgggagatgggttgtttctggtgtgcactctcaccttgggctaatagaagcatgatttgaaatcaagtgcaagaggccgcattttcacctctgtga

SEQ ID NO: 505385 - DNA, 649 bp, Homo sapiens
cggagctccgggcactcagacatcatgagttggtccttgcacccccggaatttcaattctctcacttctcatgctcttttcattgtcgtctcgttccaaccatggtgtcagccatatgttcgctacccagcagaccaacgtgctgccatcgtatcagcatgacacagcattccggtcagcttatctagtccaactcacctggtggccattgcagcatttccctgatctcacttcatccacacacgcaaaagtcagcaacaagcgcatcttaccacgtacttcttggcaacgaccatcttcacatccaagtttgacaccaccacaacaccatcaggaacgtcaacccagccttgcatcacaccaagccaaatccgacactccactttgcatacatcccttgatggacattcccattccaaaacacagcccaacaatcactcggcatccagccaccgcgtgccgttacttctgagcacacgactcccccaaggaacacaccatggtttcagccaagcaccattcattgcacacatcatgcccaacccatcggcgattgcttcacacccaccattgactcccaccggtcatttccgacatcattttggcgagggacacactcataatccatttccgaacattcaaattcaaa

SEQ ID NO: 505386 - DNA, 275 bp, Homo sapiens
  misc_feature (14)..(14): n is a, c, g, or t
  misc_feature (127)..(127): n is a, c, g, or t
  misc_feature (145)..(145): n is a, c, g, or t
gctgatgttacaanatattgtaattcaatcctttttacaacctttactactgtccgaccatatcttgttttaattatcattagaatttctcctaaatggtctctctgctcctctctttcttttctantgtctactctttacatgncatctagactgaccatttaaaaatataaatcatatcatgttattcttctattcaaaaccctataaagactcctcatttcactcagagtaaaagtccttacaatggtcaatgggcccacattaatgttttc

SEQ ID NO: 505387 - DNA, 333 bp, Homo sapiens
acattctccgttctaaggaactgctgatcttctttctgtctctgtagattagtttgcattttctagaattttatataaatggagccatataatatgtactctttttttggtctggattctttccatcaacataattatcttgagatttatccattttttgcatgtttcaatagtttatgcctttttattgctcaacagtattccattgtatgtatataccacagactgtttatccatttgcctgtagatggatatttgggttgtttctagttttgttgttgttgttgttgttgttgttgttgttaccaataaagctgctgtgaacatttggca

SEQ ID NO: 505388 - DNA, 969 bp, Homo sapiens
ttgtgtgtatggtattattagcgcggtgctgttctcgctactcttttcccgccaatttgcgtttttcactgtgtttatctgttaccttcttgtggctatcttcctgccgctcgtgggccgaccaccgctggtcgatcatggttgtgaaagcgcaaaacgtccggggtggtttcccgcaggacacgcgcagtttgactttcgcgggggcgccaaccgtggacggtactccttggccgccctttgtcccggtgtccgcctccggcctgctgacttccgtggtcccaaccccgggctgtggggcggcccgtgatgtcttgcctcgttacattgggccccctgccgcagttctcgtttcagagtgagtccgacggtcgtcttgccacgcgggagcaggccagttcacttctttgtttaaggtactgcggggcaaacgcaagtttgatggtcacgagctagttcccccaggcgtcttccaaaccaacatgtttggtcccacggcgattatcgtcggccgcggatagagtagtaccccctgtgggactcccctctgggcacgaactgtgtcaattttccctcaaccaccggtgttgaaaatcttcttgatgggggagacaacatagttgtgtttgccgccccccacaaggtatcctttaaccagacgggcagctattttggatgcgcttatgttgcaataaagcaaatttgggatatcccataaggggtgagaggcgccggagcaagtgctatctttatgggggccagccacccgcgcactcagtggtttttttgtgcagcccccacctttggagcagggttcccctcacgttataataagaattttcttctaagaatattcaactgagttttcgaataaggggttggcactacacatgagaggaggtgcccatttccatgaagtttctggagtgcccttttaaacaaaaaggattgacattcgaccacaaaaca

SEQ ID NO: 505389 - DNA, 436 bp, Homo sapiens
ctttcccacccttaattcgggcagtcacttggatagataatcctattgaagtatatgttaataacagtgcatgggtaccaggacccacagatgaccgtgccctgcccaacctgaagaagaaggaatgatgataaacatttccattgggtatcattatccttctatttgcctgggaaaaacaccaggatgcttaatgcctacaatccaaaattggttggtcgaagaacctactgtcagtgccaccagtaaatttacttatcatatgataagtggaatgtcacttgggtcacaaatgaataatttacagcattcttcctatcaaagatcattaaaatttaggcctaactggacaccatgacagaaggaacttaacgacgaatcaaaagacacacaactcctagactgggaagacactacggctgaacctgcaatacac

SEQ ID NO: 505390 - DNA, 750 bp, Homo sapiens
  misc_feature (43)..(43): n is a, c, g, or t
  misc_feature (70)..(70): n is a, c, g, or t
  misc_feature (73)..(73): n is a, c, g, or t
  misc_feature (77)..(77): n is a, c, g, or t
  misc_feature (80)..(80): n is a, c, g, or t
  misc_feature (83)..(84): n is a, c, g, or t
  misc_feature (115)..(115): n is a, c, g, or t
  misc_feature (125)..(126): n is a, c, g, or t
  misc_feature (128)..(132): n is a, c, g, or t
  misc_feature (134)..(138): n is a, c, g, or t
  misc_feature (169)..(169): n is a, c, g, or t
  misc_feature (173)..(173): n is a, c, g, or t
  misc_feature (177)..(177): n is a, c, g, or t
  misc_feature (180)..(180): n is a, c, g, or t
  misc_feature (190)..(190): n is a, c, g, or t
  misc_feature (202)..(203): n is a, c, g, or t
  misc_feature (210)..(210): n is a, c, g, or t
  misc_feature (219)..(223): n is a, c, g, or t
  misc_feature (227)..(227): n is a, c, g, or t
  misc_feature (388)..(388): n is a, c, g, or t
  misc_feature (414)..(414): n is a, c, g, or t
  misc_feature (416)..(416): n is a, c, g, or t
  misc_feature (669)..(669): n is a, c, g, or t
  misc_feature (676)..(676): n is a, c, g, or t
  misc_feature (688)..(688): n is a, c, g, or t
  misc_feature (727)..(727): n is a, c, g, or t
aaaaaaaaaaaaaaaaaaaaataaaaaaaaaaaaaaaagaggngaaaaaaaaaaaaaaaaaaaaaaaagnagnatgnggnaannaggtcagcatggggacttaggagctatcagnaaggagtaannannnnntnnnnngggacacgggatggggtgaaaaaaaaggtantgtntttnaanaggatttttntttttatttctnnaccccancatattttnnnnntggnaaggaagggggctcatataaagcaggagaccctgagccccgacacaggtggcgtgggggaggacacgcagaatgacgaggataaaaccggctcttaggaaccgtggcttctgtcctgaggtctcagggcacacgcgcgaacacatatacaacacaagatgnttctggcatgaggggcagggtcccananaccccaccctcattcaagctaaaaactgggaggggctgagcaggggctgggaccaagacccatgttttaccagtggggcgagtttttttggtttttctctccaaaagggaaatttaaaaatctacaacaaatcacaccaaattcattaaaagtgataaaaacccagcctccccctcctcacttgagcttcagaccgggccagaaaagctcaacgatgaagaaagaggaacatgcccaggttcaggtctccccncccaaanacaagtcccggngtgggaagcttggagctgggatggcatgggcagccccanccgcagcgtctgttgactgccaa

SEQ ID NO: 505391 - DNA, 126 bp, Homo sapiens
cccccccccccccccctttttttttaataaaagggcccttgcctgtgttgcccccgtccccccccccgttaggtggttttccaatttttttcccttggcccccccctaaaaagacccctttgttta

SEQ ID NO: 505392 - DNA, 562 bp, Homo sapiens
taaacacgcagcagtatgaaaccggaggggatgacgatgtctcacacccagagaactcttagtgaacatagcatcatgagcaggccatctgtcaactctacaatgggaacagcaggcgcctctgagggagataggcacgtagctaaatgatggacaatattaaacaagatagcttagaagattcatatttattccaaatgggaggctgaatctctcagatgtcgattttgacacattggcactattttagtttctgatttattgccttggccgtaagtccaaaggcaacaataaagtgtactttcattaataccaccatggactttcgagtattaatatgacaagaaaagacaactattcatttttttgaaggggactggacacacaaacttcaggagggaagaatcccctctcccattagaatccctccatcttgatacaatggttgctttataggtcagattttggacttggatcgtctgttataatattaatagtacacagcatgtaagattttctgcgtccatttgaaattcctaataccaaccatcttttaatttat

SEQ ID NO: 505393 - DNA, 417 bp, Homo sapiens
atgtcttaaaacatttaatttattcatttagttatacatacatactgcaaatcacatgttctctaaaataatatattaatttagaaaataccccatttttgccaccctccctttcacgaaatcattttactctgactcctcaccgtcttcaccaacatgggaaccctgtttgagtcatcagacagtgtcaagacacacccagtcacttccatccgagctctgcacgggcgctcagtgacgatccctttatgaggctctattagaaaggggtaccagccataagaccactttgcagaaattaggacgattctcttgtcgtttttaatctggcctggacgtccattttacccccttaagtcatactttttaaaacacccttaaacgtcttttttttaaagcacccaaaatgtcatgggg

SEQ ID NO: 505394 - DNA, 550 bp, Homo sapiens
tggaactgcatcaacgtgtactacaatgatgtgccacctgtgctggcaagtacgtgccccgcgcctgtgctcgtgtgatctggagcccggcaccatggactcctgtgctgctctgtgtgtgcccttctgggcatgatcttcctgtgcctgtgacagacttctgtatttctgtgtcatgagtgtgttgcttggtgaacaacttgtggccaatgtgtgtgcactacacagaatgtgctgcggagctgtgtgtgactctggtgctggatgtatgtgagaaatgtgatgtgctgagatgcttgtgacttgcctgcatgggtttccatgcttgagccaactacgcctgtgtgttggtgtgtgtgacttgggtcttgggatgggtaccctcctcatcagcaatgatcctgggaggagtacccagacatggatcatgaacacgtttagtgtggtgccttcgcccaaatgtgtcagacacagtgtgtggagccctacaatgccacctctcagtccaccagctcgtaaaaacacagacgagactactgattgataacgg

SEQ ID NO: 505395 - DNA, 83 bp, Homo sapiens
tttttttttttatattacatcaaaaaaagttttaatggtcccaaatatatatactcaacaactaagcatacactcaggggagg

SEQ ID NO: 505396 - DNA, 340 bp, Homo sapiens
ttccataccctttgagaggcatcactactccttcgcactcactggtgtttgctattcaagcaaattattaatgtggctgatcttattttgaggggtttattgctgatcttcacagtttaaaaacatcacggtataatatggaatgttttagttttgtgttatccaagtccctcctgatctgcttatatgaagctctctttgaatttctgccttctgcttttattcccaaggaaggaactaactgaacacacttttcccctagtcttttttaattcctttttatgtgaaggagatactatcttcttcctgtatggagaaagcatcccttttcatagccctt

SEQ ID NO: 505397 - DNA, 218 bp, Homo sapiens
gacgtccacgagacgcagctccacgctcaccgcggccttggcggcggtagggcgaaggaggcccacgtcgtcgtcctggcggcggaaagcgatcttcgagatgcggcccacgatcacgaggctcacgccccatttctttccgttctcgctcacgcgcgccacgtcgagcttgtcggagtcgaggtagaaatcctgggagcgaagcggaacttcctttt

SEQ ID NO: 505398 - DNA, 145 bp, Homo sapiens
gatgtggagatggagtgtcagcatgttggtcaggctggtctcggaactccgtgacctcagtgtgatccacccgacctctggcctcccaagagtacttgggattacatggcgtagagccacgtgcactcggcagccctcccagggt

SEQ ID NO: 505399 - DNA, 1276 bp, Homo sapiens
caggattaggcacgagcaaaacatactcctacattactacctagagctccttacgactaacacattatgcacgataagggtatagagcccatacgactagttgcacaccttgtactacgagtcagtatatacgatcaccagcaacaggatgacaagtgatgacaagtaatatagtgaggcacaaatgacaataacagtgataagctcacgggtacttctgcgcacctttactatacgcctcacagtgactatagcactgcacctctgcaactcgtcaggcacacgtcactacctcccatgcccacagcgccagccagggggggacacagcctaacacgcactcgctcgcgaatcacaccccaggcaattcatggcgacacccatcaactgcatacatacgcgtacacaccatccagccccccaagcgcggatccatcgagtcgctcatccgacaccacatagacaccgtggactgtggcattgtactcacggcagcgtaaggcagtgaccgaacacacagccctaacctgcgcacagcgacctgaggtgaaataaggactagcgcttagctaccaaagcgtcatagtacattgctctgacagatcacaaagcgggagcagcgactctctggaacacgaacaggcaagcgcacctgcctacagactccgagcagtatgggaacagaacttggaagcactggtaccacctaccgaaagcagagtatacacatcaaaacctccctatagtagacaatgttcgcagtaagctactgcacaccataatgcgcttcaccagcgagatagctcagatcaggttatgaagccatagccgtcagagtagtcgtacgtgcacagtaaacacatgccgatgcgaagtcacacagtcactggcaaaggcagacttcgaagaccgtctgagaaattccaagcaaccttgagagatgcagtacagtcacacagggtcttcacattgggagcgagcgtcacacagcgcaaactatcgcagcaagaagaagaacacaccctaacacaaagacaccatacaactatagtcaaaatctaagaattatagagatatcatcctctgtcattagccttgagtcacacatagaaaccactgatgtaaccatgaaactgtcacgtagtgtatcacataaacggaggcatgcaaacacgacctcaagagacaccataaaaaggatgtctaataggaaaggtagcagaaacaaacagacagcaggagcaactagaccaatacggatacagctagtcatctc

SEQ ID NO: 505400 - DNA, 173 bp, Homo sapiens
  misc_feature (5)..(5): n is a, c, g, or t
gtgtngcaataggattatccagtccaaatccaagttgattatttctctaccaccaaactttttttgtggttttttttcttggctctgtctcctaggctgggagtgcagtcgccatgactcatggttcattggcagcctcaaccttcgtgaggcctcaaggtgactcttcccat

SEQ ID NO: 505401 - DNA, 125 bp, Homo sapiens
  misc_feature (80)..(80): n is a, c, g, or t
  misc_feature (100)..(100): n is a, c, g, or t
ctgctgctggtgtccctgttctgtgccagagcgtggccccttgccattgtccggcgggctgccgatgcaggtgaccttcnagactgttgaccggccgcgnctgtccactacatcatacctttctt

SEQ ID NO: 505402 - DNA, 329 bp, Homo sapiens
  misc_feature (173)..(173): n is a, c, g, or t
  misc_feature (195)..(195): n is a, c, g, or t
ggcccggcaataaattgaagaagtgcaatgcccccttttgggggaaagcctttagaaatgatataattattaaagatattaaatagacaaaaaataattttcctaataatgatgataataaaagaatcctctgaagtgagtattagaacttctgactacttctaactattggncctacccagccactgatgaacnccaatcatatagtctcaaactgctcacttggtgtttctttgcctccatttgcctttccgtgaaatgggaatttaaaacaaaaattaaaaagcccacgactgttgtgaggacaaataaaatggtacatggctgaa

SEQ ID NO: 505403 - DNA, 1966 bp, Homo sapiens
  misc_feature (384)..(384): n is a, c, g, or t
cggcgcagcccgagagcctcccgcggtgcccggagcggcagccctggagggcgggacccgccggcgggtgccggtggcggcggtcgagctcccgggggcagccgcggaggaggcgcccggctgcgagcccagcccctgtggctgcccccctgactgtgctagggacgatgactgctgtctgcctgctggacgatgctgctggccgagtctggcggcctgggtgccccgctgtgtagccctgcctccgtcgtcctgaccatgcccgtgcttccgaccctacgcggtcgcggggagcgcggtgtgcgcagagcagagcacagagggccacccggggagcggcaatgtctctgaagccccaggcagcggtcgcaagaagcccgagangccggcagccatctcctacgaccactcggaagaggggctgatggcgagcatcgagcgggagtactgccgctgaggacagcatgctccacccccgccaggcctcggaggcacctgctggctggggcaccctctgcttgcacagagctctagcaggagctgaaccacctccaaaacgcagtcactcccggatattcaaagctgccctttcaaatccactttcagaccgcgctgacctgggccagccactggcggtcatggttgctggtgggggcgattagctgtgtagacccacaggtgcgtgggcctgggccgccggcgcctcctccccaacgcggggagcctgcccagttcttctggagcctgaaatgcgtgcccctcttggttgcccgctctccacagtggggagggctcacgaggactaggtgacacaagcgagcccctcctggcatccgcgccacaacacttccggaaggttctgctgtggaaggtgcacccgcgctgctccctcagtctcgggcccatctctccagggtggccgggtcagcttagtgcttctcaactttaactccctaatgagcagcctgggggtgctgttgacttgcagggcctgaggttctgtacgtctaaccagctcccagcccaggcccgagctccgaagccccaactgcactttgaggagcgagaaccccagctctgatctgccttgcagtgggaggtagagctcgtcactgcctctctgggcctcagtttccctctctggaaaatcagctctggcagctcttggaggccctccccagctctgacaatctggaactgctgccactgctggtcccctgccccaggcacagcagtgccttccctgcggggagccagcgcccaggtccaaccgggagagggtctgcctgatactggctttccagttctccctctcacaggcagcctggccagtgcctgcggggcttttaaattctcttcctgcctgggtggaaggtgggaaagccacagcagtgaggcaggaagagccttggaatgttcctggttgacagatgggaaaactgacctgcccaggacgccctgggaacagggggcggagctccggctagaggggactcctgtgtgggcgggcaggtctggagcctgggcccaggtgtggcctgctgggggacagctccgggggagagctgtggggagaacagcggtctagggaggcaggaggcaggcggcaggctcctccccagcagcctgcagggcatcaggacagagcgggaacggaggagaccgaagggaacgaagggagatagagggggcaggaagaaaaccagggcgggctacgtgcatgacacccagacaagacctggtaattggcctgacccgcacacacggaagccacccaccgataggacaaaaccagacaaagagctcacgaccgcaggaccagacacagcagagcacaagaagcacaaaggaacaaggcaaccgtgcggcaagcacgaaagccaggcgcagaggcacacgaaaggagatgcctcaacatgagactgctgacagggaaagggcaacactggaacaaggcacgccccag

SEQ ID NO: 505404 - DNA, 713 bp, Homo sapiens
  misc_feature (3)..(3): n is a, c, g, or t
  misc_feature (25)..(25): n is a, c, g, or t
  misc_feature (33)..(33): n is a, c, g, or t
  misc_feature (47)..(47): n is a, c, g, or t
  misc_feature (51)..(51): n is a, c, g, or t
  misc_feature (72)..(72): n is a, c, g, or t
  misc_feature (83)..(83): n is a, c, g, or t
  misc_feature (130)..(130): n is a, c, g, or t
  misc_feature (140)..(140): n is a, c, g, or t
  misc_feature (169)..(169): n is a, c, g, or t
  misc_feature (224)..(224): n is a, c, g, or t
  misc_feature (231)..(231): n is a, c, g, or t
  misc_feature (302)..(302): n is a, c, g, or t
  misc_feature (317)..(317): n is a, c, g, or t
  misc_feature (327)..(327): n is a, c, g, or t
  misc_feature (351)..(351): n is a, c, g, or t
  misc_feature (355)..(356): n is a, c, g, or t
  misc_feature (370)..(370): n is a, c, g, or t
  misc_feature (418)..(418): n is a, c, g, or t
  misc_feature (477)..(477): n is a, c, g, or t
  misc_feature (512)..(512): n is a, c, g, or t
  misc_feature (516)..(516): n is a, c, g, or t
  misc_feature (524)..(524): n is a, c, g, or t
  misc_feature (530)..(530): n is a, c, g, or t
  misc_feature (567)..(567): n is a, c, g, or t
  misc_feature (616)..(616): n is a, c, g, or t
  misc_feature (633)..(633): n is a, c, g, or t
  misc_feature (678)..(678): n is a, c, g, or t
ganggattttgtgtggacgcgaggngccgttcncttagaacataggnttgnacatgtggagatgtggaattntttatttggcnatgatgtgtctttttccgtggagacccatggttatgattgttgacanagatcctganttttttaattgatcattctctgaaaagtngcaacgagtggtggagccaagatcatcgaggggtctggacgcacataacactatntaacatncaccagctgatgaacaaagtatcagaggatcatgatttttctcattatagaaagaaatggagtcagtgccnaaagcatcccatggntatggagttngtttttgattaaaaagagacctantggnnaatagtgcagtggnccatgagtatgtttccgaggtggagaagcactcttctcagacggattntgccaaatttttgggggtaagtacggagttgagatttgatatgtgcagacaagttatcngtcggctttgattataaagtagaagtggagaagcncacntctcatanagattnctctcgtggctttggtggccggtacgtggtggagaangataaatgggacaaagcagctctgggatatgactacaagggagagacgnagaaacacgagtcccanagagattatgccaagggctttggtggccagtatggaatccagaangaccgagtggataagagcgctgtcggcttcaatga

SEQ ID NO: 505405 - DNA, 661 bp, Homo sapiens
gcgagggggtggctgtcggtggctgccgctgactcccgagcctgtgaggctcccacgcggcaccgtcggggctgggcgttcctggggattcagagtcggcgctgggcctcctggagccaggaccgccgaagagcttgctgcatctctgtgtgactgctgtggccatggctcctctgctgctgtggccctcggccgcttcttccgcggccgcgggtaagacgcctccgtctcgggtcccagctggagccgtctgtccagacgcggcgcgtcgaagctgccgggagagctggctgaacctgactggctgagaggctgcggagctgggctgctggctgcgctggggtgcgtgccagggggcaccagacgcccagcttggacactgcgcccgagagggcatggcccctggggcagcctgtggatcggccgggcacgatggcgcgtcgcctcaagaccgggggtgtccgtgtcctccttccctcatgccctgggggcctgcggctccagcgctccaggcagctttgaaccgagactgctgcgtgtcaagctgggtgccaggggtgccccgtcctgacatagtggctgtaactcactcctggtgaggtactgggctcgggacagccgcggccgaaacacgacctggggccagacactccactacgaa

SEQ ID NO: 505406 - DNA, 1870 bp, Homo sapiens
aaaatgggccaagggccccgggcttggaagggcaggtggcgcctagacccagcgttcccgctccacaggtctccaggagttcgcccggcgtttcctctgcagcgggtgctactctagggtctgcgacctcccgctggactgcccagttcaggatgtgacagtgactcggggcgaccaggctatgttttcttgcatcgtaaacttccagctgccaaaggaggagatcacctattcctggaagttcgcaggaggagctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggccccgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggtgagttctggggactccggagccccagcatctagctccccgctgtctcagatcccaccgagaagtctgggttcccaacaacctccaacccaggaggtcaggctttcagttcctcctctctcagacccacgagtccaggtcccagcccctctttactagcccaggaatccaagttcccagccccctcctcccttagatctaagagtccaggcccccagcccctcctccctcagacccaggagtccaggtccgcagcccctcctccctcagacccaggattccaggccccaaacccctactccttcagacccaggagtccaagtccccagtcccctcctcccgcagatccaagagtccaagcccccggaccccctcctccctcagacccaggagtccaggcccccagcccctcctccctcagatccaggagtccaggcccccagtccttccacccgcagacccagaaatccatgaccctagcccctcctccctcagacccaggtgtccaggaccccagccctctcctccctcagacccaggtttccatccaggcccctggcccctcctccctcagacccaggaatccaggcccccagcccttccacccgcagacccagaaatccaagcccccagcccctcctccctaagacccaggagtccaggcccccagccccctctccctcagacccaggtttccatccaggccccggaccctcctccctcagacccaggagtccaggccccagccctctcctccctcagacccaggtttccatccaggccccggaccctcctccctcagacccaggagtccaggccccagccctctcctccctcagacccaggagtccaggcccctggcccctcctccctcagatccaagagtccagacccccaagtttctcttccttcagacccaaaagcccaggccccctgccccctcctccctcagaaccaggagtctgggccctgtacacctttttgaccctggtgtccaggcctccgggacctaagtctctagtcaccaacccctcctgtagcacacatacctctttgtttccccaggatgttctttcgatggtactgcagtggcaactaacaaaggtatctttcctccttccctatcctatttccatcctgaaaataaagaatatatttcaactct

SEQ ID NO: 505407 - DNA, 254 bp, Homo sapiens
gcatcatctcaacctatagggagcgttctgcgcatcatctcagtctatagggagggttcagcgcatcatctcagtctatagggagggttcagcgcatcatctcaacctatagggagggttctgcgcatcatctcagcctatagggagggttcagcgcatcatctcagtctatagggagggttcagcgcatcatctcagcctatagggagggttcagcgcatcatctcagcctatagggagagttcagcgcatca

SEQ ID NO: 505408 - DNA, 1976 bp, Homo sapiens
  misc_feature (394)..(394): n is a, c, g, or t
gttacgtgcttgagaaaaaacaccgaggctcggagacacactggccttgcctgaggcgcgcgggtgagccgcagagctgggattcaagctcggtcttcccaccccagagcccgtcctccctcaaccagggcaggtgctggcttccactctgcgagggctcagcgttgtgggagatgaagcggaccagtagaagcctgctggtggatatgtgctgggcgagacgccacagggtgtcccagggcaaagacttcggtttgggtttcaggatgggcccactaggagccattgtggtggccaggggaaatgagtgtgaacgcaccatcctgcctcctgacagccctgtcccatttctgacccacagagccccaggcagcggtcgcaagaagcccgagangccggcagccatctcctacgaccactcggaagaggggctgatggcgagcatcgagcgggagtactgccgctgaggacagcatgctccacccccgccaggcctcggaggcacctgctggctggggcaccctctgcttgcacagagctctagcaggagctgaaccacctccaaaacgcagtcactcccggatattcaaagctgccctttcaaatccactttcagaccgcgctgacctgggccagccactggcggtcatggttgctggtgggggcgattagctgtgtagacccacaggtgcgtgggcctgggccgccggcgcctcctccccaacgcggggagcctgcccagttcttctggagcctgaaatgcgtgcccctcttggttgcccgctctccacagtggggagggctcacgaggactaggtgacacaagcgagcccctcctggcatccgcgccacaacacttccggaaggttctgctgtggaaggtgcacccgcgctgctccctcagtctcgggcccatctctccagggtggccgggtcagcttagtgcttctcaactttaactccctaatgagcagcctgggggtgctgttgacttgcagggcctgaggttctgtacgtctaaccagctcccagcccaggcccgagctccgaagccccaactgcactttgaggagcgagaaccccagctctgatctgccttgcagtgggaggtagagctcgtcactgcctctctgggcctcagtttccctctctggaaaatcagctctggcagctcttggaggccctccccagctctgacaatctggaactgctgccactgctggtcccctgccccaggcacagcagtgccttccctgcggggagccagcgcccaggtccaaccgggagagggtctgcctgatactggctttccagttctccctctcacaggcagcctggccagtgcctgcggggcttttaaattctcttcctgcctgggtggaaggtgggaaagccacagcagtgaggcaggaagagccttggaatgttcctggttgacagatgggaaaactgacctgcccaggacgccctgggaacagggggcggagctccggctagaggggactcctgtgtgggcgggcaggtctggagcctgggcccaggtgtggcctgctgggggacagctccgggggagagctgtggggagaacagcggtctagggaggcaggaggcaggcggcaggctcctccccagcagcctgcagggcatcaggacagagcgggaacggaggagaccgaagggaacgaagggagatagagggggcaggaagaaaaccagggcgggctacgtgcatgacacccagacaagacctggtaattggcctgacccgcacacacggaagccacccaccgataggacaaaaccagacaaagagctcacgaccgcaggaccagacacagcagagcacaagaagcacaaaggaacaaggcaaccgtgcggcaagcacgaaagccaggcgcagaggcacacgaaaggagatgcctcaacatgagactgctgacagggaaagggcaacactggaacaaggcacgccccag

SEQ ID NO: 505409 - DNA, 196 bp, Homo sapiens
ccggaacattctgtccgggagcataaacccataccaccaagcaaaacactatagcctctaagctattagctaacatgtcaactaggtaatgcatcttcagggaaaccagagtggaaaggacagcaaaacattgatttttttttttttttttttttttttttttttttgggaaaggggccacaagttgtcgcgggcc

SEQ ID NO: 505410 - DNA, 129 bp, Homo sapiens
ttccgcctagatgaaacggtacctgctttagtgagactcaatgcccggcggaggggagacaagtatataggtattagtcggcttgtcgtcaaatcacaaagtcctagcattacgagagactatagaaga

SEQ ID NO: 505411 - DNA, 982 bp, Homo sapiens
agcgggtcatgcccgcggccgcacagtaacgcgcacagttgccgtatccgcaagatctctctggtaccagctcgggtgcagggcctctgcgtggagcccttcctagaccatctgcgggcttctcctctatacatggccgattccgagaaagatcaggggcctgcgagagcctatgccaggtcggtgcgcatggggccggatgcatctgggccgcaggaggtaagtggtcgcgaaggacaggttgcggcagggggaggaatgagctgtgaccagacggcggcgcgtaaggttggacaccgtgaacctagacggcagtgtcatgggctcgaagaaatgggcatcgcagtggacgaccacaccaaggacccacgcgtgccaggaagtaagagcgccgcggaagaagcttctgcattgacacattcgtagctctctagtgcctgaagtacgacccattgtccccttacaattgcgggaggatcgaaaacactatgcgcgggaagttcgcataggagggcacccatgcgagaaaaaaaggccttgtgctaagagaaacggccgaaattggcgggaataataaggaataacggaaaaggcgcaaatagaatgtattgaagtacacggggacatttggttccacggaacctacgtaggggaacgggacaaacaccggtaagttcaaacttgtaacactacgtaagtaaaaggtccctccccttgagcatacggccgcatataggaaagtacaccagaagttaagcgtcgttgccagcaccgcggtgcggaacagcaaagtgtggcacgcggggggggttggcatggacacattgtgggaatcgcatttgggcgaacgcggaggcggaggaaagcggcaagcagaaaggaggaccagcgtacaccggcaacgggagaacggaatacccggtacggagggcaccttggaatcgcgaaatggggcattgggaaacgggagaggtggaaaccc

SEQ ID NO: 505412 - DNA, 430 bp, Homo sapiens
ctacttctcaggatgaaatctgtctgccccgcccctcagtaccatactcacagtccacagctagcatgggcaggagtggggtagggctcttggctccctgtatctcgctccacttgaagagtatgcctgttgccagtctccttcagcacctcctccatcatacgctaaaggcatctcagctccagtgtcagatgccactcctgattatgctgtagtgactgctttgcacaactacttccacacacactacaccaccgagtgcgaaacctcagcgacacgtatcgcaacatctcttaggttccgccttccaccctagtaactaccccattacgctacagttcctcgtcctctgaacaaaaactctcgaacttcttctacctgtgaacacagcctcttctcagtctccagctactacgccctgtgcctggtc

SEQ ID NO: 505413 - DNA, 358 bp, Homo sapiens
caagaggttactgatgatcgaagactagagcaaatgctatctcctctccaacgccttcctgtatggccgatttcttagctccttcctcggatgactcacattcttctgtagtcaccatcgtgccgtttattataagttatagtgtgacatatatctcgttaccaccacacaccagacctgccccaaagcgtaagcatccacattgtcattttcgtgtctttcataccccctaatcagggcttttagcaacgagtaccgtggcgtcaagcaatctatgtgtctaaagaggcaaatgcaaaagcatagtcacagtacaggcgggcaaggcatgcagagcatgggcaacaaatggcgctgg

SEQ ID NO: 505414 - DNA, 312 bp, Homo sapiens
gtctccaggatggcgtgcagcaggatcggccgggtgacgccgtgtttggcctccagcgaggccaagagctggtccatgtagaagatgtcccacggcccctcgaccttggggaccatgatcacgtcgatcttgtcgccggccttctcgacgatggtggcgacctcgtcgagatgccagggcgaattgaggcagttgatccgcgtccaaaagcccacgcccagggccttgaagtcgatctcgcgcgacatggccaccaagcccgccagcgccgcgcccttggcgtcggcggggatggcgtcctccagattggcc

SEQ ID NO: 505415 - DNA, 823 bp, Homo sapiens
  misc_feature (27)..(27): n is a, c, g, or t
  misc_feature (93)..(93): n is a, c, g, or t
  misc_feature (162)..(162): n is a, c, g, or t
  misc_feature (198)..(198): n is a, c, g, or t
  misc_feature (211)..(211): n is a, c, g, or t
  misc_feature (227)..(227): n is a, c, g, or t
  misc_feature (247)..(247): n is a, c, g, or t
  misc_feature (290)..(290): n is a, c, g, or t
  misc_feature (362)..(362): n is a, c, g, or t
  misc_feature (409)..(409): n is a, c, g, or t
  misc_feature (494)..(494): n is a, c, g, or t
  misc_feature (507)..(507): n is a, c, g, or t
  misc_feature (539)..(539): n is a, c, g, or t
  misc_feature (543)..(543): n is a, c, g, or t
  misc_feature (550)..(550): n is a, c, g, or t
  misc_feature (579)..(579): n is a, c, g, or t
  misc_feature (598)..(598): n is a, c, g, or t
  misc_feature (609)..(609): n is a, c, g, or t
  misc_feature (613)..(613): n is a, c, g, or t
  misc_feature (619)..(619): n is a, c, g, or t
  misc_feature (711)..(711): n is a, c, g, or t
  misc_feature (720)..(720): n is a, c, g, or t
  misc_feature (732)..(732): n is a, c, g, or t
  misc_feature (739)..(739): n is a, c, g, or t
  misc_feature (749)..(749): n is a, c, g, or t
  misc_feature (759)..(759): n is a, c, g, or t
  misc_feature (763)..(763): n is a, c, g, or t
  misc_feature (787)..(787): n is a, c, g, or t
ccagccgaacctcgtggggctccaggnccatctcgtcctcgttctcgttctcgcccagctggatctcctcggggttgacctgctgtgccagcnctgccagccccccccgggaggcgtcactcctcacgaacaggatcttgctctgggcgcgcaagggctggncacgctccgcctcagccgccagcggctctgcccgcngttccagcagctntcaagtcgtccatgcnactttgcccaggggccaggncagaaacggtgcccgtggcactgcccgagaccttgagcatctncgaggccatgaagttgacctgcgttttgtacgtggcctgcacgctgcgccggaaacgcagcatttccttganggtgttctcattgccatgccggacctcaaagtccttccacgtttgcnagaacgcgccggtcgtccgggggtaacagaactgggagcagaagctgtagaaggcccgggcgcggtcaatctccccgagcttgcnctccatgtttgcnaaccgcaggcacatcttacgcgcgttctcgtncganagctccncaatggccttctggtagatgccgcgggtnttggttacccatagatctnggccgcccgcntgangtagangttgaacatgttatactgctgggcgggctccacggcccttgtggcacgctcgttcacggccatggcatgccgggccaggccccacttctccnccagctgtncgttcagcaggnacaaggncttggcatantttggggggnagcngttcagagcctgttcaaacaggtnccgtgccccctccagcttgcggcccccatagcgggc

SEQ ID NO: 505416 - DNA, 248 bp, Homo sapiens
ttatcaggataatcagattcacctcaggtttacagtttatagaaacctagagcagtatctcacgttgaggtctgtggaagagacgtccattgcagaaatggctggtagttactctttttttccccccacccccttaatcagacttcaaacgtgcttaacccccttaaacttgttattttttacttgaagtcattttgggacttgtcttaaccagggcaagagacgacgggtgggggacacaaatgttt

SEQ ID NO: 505417 - DNA, 111 bp, Homo sapiens
ggtcgatctaagctccgtatccacaggggagtgaaataataagtgttgtctaggacgtcaagaaatagtaatccttggagtcattgtacacgcctattagaatgtaaaatg

SEQ ID NO: 505418 - DNA, 133 bp, Homo sapiens
tcaggcaatccacccggctcggctcccaaagtgctgggatataggcgtgagcaccatgccccgcctagagtgaatttacactgagagaccgaggcggagagtgagaatatattctcagagggaaagtacctgt

SEQ ID NO: 505419 - DNA, 159 bp, Homo sapiens
cataagtcaggaagtatctgtagcaccaccctgtatatcagaagatgagaaagctcctgaagtttaccatttgttctcattaggtcaccttcctactgcaaatactctagtaaatgaacgtgtgtcacgttcagatatctcatgctctttgactaaaag

SEQ ID NO: 505420 - DNA, 350 bp, Homo sapiens
ttcgaagaacccgtatacataaaatctagacaaaaaaggaaggaatcgaatgtgtggtagggcgatataggggaatacttatggcacggtatgtgcagaagagtatgaacgtccgatagttgcctgataataggtacgcaactggactactaggatgccgacgttagaccgatagtacagtcatgagtctatcgacgtaaaacattggttctgaactcgaagtatgtactcaatagatgcagggagaacaaataaaaaaaaaaatagtgaatataagaaaaaaagataatatggaagagcataagtgaaatattgaagatagaaaaaaaaaatataagagagaggataag

SEQ ID NO: 505421 - DNA, 502 bp, Homo sapiens
agtcggtccctatctgtgttcggggttgtatccgtcttcggggtggtgaggggctaacaaatggaggaagggaaaggggtaacagcgttgcccaaggggagactcagaggctctgacttgctgaagaacctacccagtagtggagatactgaaaaaaattttggggcgggccatttgtctaccatggtagttggttgattgccaggccaggagctgggaagttcccatttcctttgaccaaaacgcagcttagcgcaaggaattcttataacagtacacaggagggagctttgcaatgggcttataaggaaaatattactccttaccttctcagggtgtgcaaaagacacaaaaccattattcgccttagcaaaagggttataacccaacatccttagaaggaattgtcagggctaaaaaccccaaaagattctgaaggttggccttatattaccggattgcttaaaaacccaaaatgcctacgtttcaaccaacaaggatc

SEQ ID NO: 505422 - DNA, 374 bp, Homo sapiens
tcaggtgtacatgcagtcctggacccaatcaggtagctgctgcagtactctgagaagtaggcggatggtataataggcctcacaggcattctcaacccggtgaaaagatagctaaccacttccgttgtgcgtatccctatgaggcgtaattataacaagctcgagtctgcgtacgacaaacagacctaaagtcgttcattggatactcttcaatcaggcaatagccgcgtcgtgtacagccattctcatccaaaccccctgaagcttcaccggcgcagtcattctcataatcgcccacggactcccatgctcattactatggtgcctagcaaactcaaactaccgaaacgcactcaccgggtaccgaggtcgca

SEQ ID NO: 505423 - DNA, 119 bp, Homo sapiens
atgagctggcccttatatccaccatcactgcctccttttccttctccacctgaaacgccatccgcaaggtcagcatctgaaaagctaccggaggaactagggtgatcgtggggttgtaa

SEQ ID NO: 505424 - DNA, 765 bp, Homo sapiens
ccgccttgaggagcgcctgtaactgctattttgaatacctcatgagcatggaccgactacagtgtcgcaccatcactagcccctaggttataaggatgagcatctgcttgcagtccatggttgatgaactgacggtgatgaaatttggcgccaagttcatgataatgctgagccgcctatggccatacacatctgagacgctcatacagccagcaggcagcgcaagccctaccagtgttagagtcacctagagccacccgagagtacatgcacaaactatcacgactgctgagcgccgagtgctcgcgccaacattgatgtcacaacacatatgccagcgccagagatgtccacgacattgacgcattacaggcacatcgcagactgaggattagcatcatccactgtactaatgttagccatctacaccacaggcctattacagatgcttgcaatgtgtctgtgcgacccatgataaacccgcatgctaatactaactacctgactctatactactcacaatcatttgaagagaacgccagttatccagctaaccacgatcactgaactgactgtacagtagtatagctaattccctacaaagagccgtacttatatcactcacaggcacttgactaatcgcactttatatcatggtcgatagcatacttattcgaccttgactatatcacctgtgaggcactcatgcataatgcttgaaggagccatcctggtattgaccacctgtagctccttcccctctcc

SEQ ID NO: 505425 - DNA, 182 bp, Homo sapiens
gattttctgaaggggatgctgcaagccgagaagctgactcctcctcagagaaagcactggccaaccagttcccgggccctgtgccgtgtgccaaccactagccatgagagctgagatgcccggccacacaagacgtgtgcatcttgcagtcactgggcgcggtacaccatgcgatgatgcgt

SEQ ID NO: 505426 - DNA, 371 bp, Homo sapiens
  misc_feature (154)..(154): n is a, c, g, or t
  misc_feature (165)..(165): n is a, c, g, or t
  misc_feature (168)..(168): n is a, c, g, or t
  misc_feature (236)..(236): n is a, c, g, or t
agtcaaacataggtacgaacagtactaaatgtccgatggcaattagtcgcaacaggtggtgaagcagtatttccaattggaagatcattgaagggggctcctgccaccggctaatagcagttcaaactaaatttttggtatcaagtccctgaanggaagtatgangtngggtccctctgaagtttaattctgagttctcattaaaagaaatggcttcatggttttatttcttaatngctatgcttcagaatcaattggtgttttatgccctttcccccagtatggtagagcaagtctggtgttaaaagcccagagtgacagcgtcatgatgtagtagtgtcttactggttttttaataaatcctttggtat

SEQ ID NO: 505427 - DNA, 498 bp, Homo sapiens
atcacattcagcgcgccttcatgattattatcatcggtagcgtaacgggcgatttgtttaatgttttccgcagcattgcccatcgcaaaggaataacgcgccattttcagcatctccgcatcgttaccgtgtcgccaatcgctaccacattttgcggtgacagatcccagcgtttcagtaaccgcgaaataccgtttgctttatgtagaccgggaataatcaggtcgataaagccaaaaccactggtaacgggtttcataatgccatcgagcgctacgtgcagtttgtcgatcactaacgggatttgttcatccggcaggttgagcgaaaacttgaacagtacgtcgtcaatctcctgataatcttttacaggtttcaggcgatggtagtgttttgccatcagtgcgacaaatgcttcgggggcattttcgctgacatatgcactttgcagaccgcaggcgacaaaattgagttgcttatcttttagcaactcgccaa

SEQ ID NO: 505428 - DNA, 1012 bp, Homo sapiens
tcggcacgaggtacacgagtgatacagtcaccactcagtcaggacatgggacttggaactccaggatgggggtgtccatagacagacccagcccagtacgaactgtcacagaatggcctgctgaactgggatgtggaattgtggacgggtggagaggtctgaataaaccgtctgtgtcatggtcccgtctgcctctgtagtggtcaggactcaagtctgtagggcaaaggcccatgggatccctttggttggggacctgatggctgtggtacgtgcttgggtctggagtcagtgtgggggtctaacaagagacagagatttgatgctaacgtcccctcaagagtgagggtcagtcatgaggcttcttcagtcaggcagatgtgggtagctcgtgggccatgcctgtgtcgaggggagcatgcccgaccaagtaaagggctcacatggagtggatgccgcacaaaatgtgccaacgcggagtgggagagtgtcgagcactccgagttgcctcaggcaggctgcatttccttcatgctaccaagtgtgcaatcactgtggctaataatgtgtactgtgctctggctctattctctatataactagtaacgtgtgcctccaggttccttcccaatgtaatcgcggatgataggattgtctgtccttgtcagacgaataccattgccagcatttgtgcttaccaaaatctgtccacgcaatagagacttaaggctcgtggacatcatcttctggcgacccgctggaacattgctggcccgtagcaacattggtgcgtattcggctatgttttgaatgatactgatttacatctctaatatatgtaaccagcaagtgcgattgctgcctaccgggtgtggtccacaccactttagaagaacgaccacagttttcataaaggtggactagtttcatttggacaacgttccaggtcccttcaacattggggcagatatatcttgggtgacacacaggaccacgagtagggcaccaccag

SEQ ID NO: 505429 - DNA, 190 bp, Homo sapiens
tccaagcagacagaggttgagaggccgaagaagatatcccagtaaggctacctttggcagtggttccctccttctttctcttttcttttcttttctttcttggatttgagacgttgtctccttatgttgcccatgctcatcttcaaactcctgggctcatataattcttccaacccaggctcccgagtac

SEQ ID NO: 505430 - DNA, 540 bp, Homo sapiens
tataggcgctagtgtgtgtttgcatgctgcgggctcacctgggcagaaagaggaaccagagctgtccccagcgaacccacccccagcacactcctgtttcccagggattttgcagtacagctgagacatgaaccaaaacttttttttttttttttttggaaatggagtctcgctcggttgcccaggcgggagttgcaagggtgtgatctcggctcgtgtgccacctcggcctcgggggtccaggtgattcaccgtgcctcggcctccgtgagtagtggggataacgggtgcccaccaccatgccgggctagttcgggtatttacagtagagacagagtttggctagtgtgggccagtcgggtctcgaactcttgacctcgggtgatcggcaaactttgacttcccggggtgcgggcataccgggtgtgagccacggcactgggcctaatatatggtataatccttccctcggcttcgggaactccaataatgtcaatgtaacgcagtttggctatggtcccaaatacctaggggcctata

SEQ ID NO: 505431 - DNA, 904 bp, Homo sapiens
  misc_feature (584)..(584): n is a, c, g, or t
  misc_feature (586)..(586): n is a, c, g, or t
  misc_feature (609)..(609): n is a, c, g, or t
  misc_feature (729)..(729): n is a, c, g, or t
  misc_feature (883)..(883): n is a, c, g, or t
agcggagagtactgtatcaggacctcccccgagctctgacccgacctgcctaggcgtgtggcgccgacagagcctccggtcggactgggtcttcacccgctaatattgtgactttctagcaacgcctgattaatctctctgatctgagcccatacatcttgtgattccatctgtcccaggttatctttaataagatgcaagctaccatcacatcgaagtgtcgttgattagccgttttgtaaagatgctggagtcagtatagactagtttatgagatatcgtgcaatgagattggtccaaacaatgctagattattacgtacgtagcgattctacgactaccatagacatcatttactcatcgagtaagacggatatggagcctgtaacaccgtcatcgacaggtacactacagtggtatcgaatacttaggacgaattgcaaattgcataagtatgtgacaacgaggataatatatagagaacagataagtgcgtatagaatctctctggagtagaacggataaggaaggatcctatgtaaggtaaccgtaatatccctaggctgatgtgccttatctaggananctatgatctcactgtctataggnctcaacacgtgacacgactcttgcagagaaataggaggtctcgtgagcatatcctagctggttgtcagataattaccaacgcaatgatatactctgtattatcgctcattagtattaacntcgtgtgagatatccacttcggtgacctcataatggaaggctgactggggacaagttgtctacagcccatgtgagaagaaagagaggttttggttccagagttatcaggggcagaaagccaatctatgtgtgactatgttaggaaccagatgcnctccagaaagatgatattgtg

SEQ ID NO: 505432 - DNA, 1653 bp, Homo sapiens
ctagttctagatcgcgagggctgccattcattccaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaagagagagacagcaagaacataaataatattttgatatgaaagcgagcgaggagggcatcattaataagtactacatgattgatgtagaacgaatacgtcgagcgctaaatatgaatcttgtttataggtgggcatcacatcgtgatgaggtatccatattgactacaaatatagagaagacaaaagactagactaccgtaatatctgtatctgctgtcgcgagacagagccaacaactatgtagtgggagagaccaacaaccatagctctacattagcatggtacatattcagacaaacgactaataagcgcgagcagatcataatacaacaacgaatccataaaacataaatgtaaataacacgaatagactctacaacaaaccacaacacatcacgtagatataatatttatacatcccactgcccctatacattactctaacaaaactcacagcaccaaccaaacgaaaaaataattaatacttatatgttaagaaaacaacacaaatataaatataaacaacaacaagattcacattcagcactacgctacgaatatcaaaaagctaataatcattagataagatgcgaacgcccgtgacgaagagatagtcaatgctacaacgaagaagacagacaaataccgtcacgggcatgagggaaaggctgtgaaggaaagggagaaagaagaggaagcgagaagcaaaaaagaaaggacagagcaacgggaggagaccgaagcgaatgaaacagagcgaccgcagcaagacgagaaggagaacaccataggacaacaatcaatcccgcaaacacacgataaatcacatctaaagaagaatccacaccaatactgctcacacaaaacatacggataactaacaacaaacaactcaccacactcaacctaaacacgtcccatagataacaaacaatctcataccacaatcacgcttgcaccacgcaactattcaacgaactaacgcggaatagcaccaacactaacacacagagggagggatgagcggagacaggagagcgggaggcggggggcgcgagacagaggagggagaagagaggaggcgcgagagcacgaggggggcggaagggacgaaggaggaggggaggagctgtgcgtgggacgggagaatggagaagggcgcagagagaaagagagaaggacagacagataggaggaggaagaccgaaagctggagcgaggagcaaaacgaatgggagagcgacgggaaggaaacgggaagaggaggagcgcggggagaggcagagcgagagaaggagagggacagcgggcgacgagatgcgatgaatagacgagagaggacgagcgtaaggagacagaagggagcagagggaggggacggcaggaggagcgagagaaatgaaagagagagagaagagaagaggaaaggagtagagagggagagaaggaggcaaggacgaagagagagacatacagaccagtcgagcagcggggacgacaggaggcaagaggcagatcggacgcgg

SEQ ID NO: 505433 - DNA, 158 bp, Homo sapiens
aattatcggctatcccatcctgacaccagacaacatgagcaaataagttatgaactacaactgcctaaacatgtatatcaatatacaacgttgtagtgaaaatctagtcccatgggagtttccccctaatgcttccgtctcactactgcaagcaggat

SEQ ID NO: 505434 - DNA, 717 bp, Homo sapiens
aagtgctggtactggtctggagattttcggatcaagaatcggacagaagctgagtgtgaagctggtacacagagtgagaaggagaggcttgacatagagagaaggaagaaatccgggggcacctgtactcagctccgtgaaagagaaacggtgagctaaacggaaaccctactgaaatgcacacgacaaggaagtcctggtcgagcctggtagcagaagctgaaggaaattgacgatggagttgccgggtgcgagtgagtagcaggcgccgtggacctggagctcagcatcatggacggtgaaggacaacctgaagaaggctgaggcagggcctgtgacgttaggcaccagccgtggacaccactcctacctggatgaatgtgagccccgcgtgcctcgaatagctgtcacacctgcctctgacccagactgtaccccagtcaactctggctagactcgagcactcgaagaacaggcctctctcggtctgtggtcacaggcgagaaggtcgactgtactccagcaaagccaaggcaatggtcagaagaaaggagctagttagagaacaagcttcatctagaagactctcatgtcaatgtggaccttggtgacaatcctgctttgttaaagcgaagtactatgcgaaagggtgagtctgtataggacagacaaagcaaaggactagaggtactgtgaactggatgagcttcagcctca

SEQ ID NO: 505435 - DNA, 650 bp, Homo sapiens
gctatcccagccgggttttatgcttcttgttattaaaaaggattggggggtattgtcgtaaccgtggtgagcacggaggtcacgtccgaaggtgtgtgaaaggtgcccgcgtgccagcaccatcctgtgtggacgtggggagcctctcataccaggtattcgtgaaattttgggagccgatgggacaaccttgggtggaaaaaggggtcgtgcgcaccacgagttacattttgtggagagcgtccaggcccccgaattgctcctgggccaggcaccacggattccttatggggcgccaatttgatatggacccactctcttttgggagaaattggggatttgtcaccaatgtgggactcttgttgcgttggccccccgagatatcctcgtctgcctatcagggtacccctctccctgccatatcctggactggccaggctttgaactatgtaatcacgaggatatgtcatcacaccaacccctggtttgggtctgaggtcttgactccacgagagcacttggaaatgaaatggctgtctaagagatctggtccaaggccactggatactagatcttacatctgcagctcttttttttttgatttcccatcttaattctgcctatttaaaaaaatatttttttttatgcta

SEQ ID NO: 505436 - DNA, 311 bp, Homo sapiens
  misc_feature (256)..(256): n is a, c, g, or t
gcggccgcctactactactaaattcgcggccgcgtcgacgttccatgctgattctctgtttagcctggttatgttccatgctgattctctgcttagcctggttctgttccatgctgactgtctgtttagcctggttctgttccatgccgattctctgtttagcctggttctgttccatgctgattctctgtttagcctggttctgttccatgctgattctctctgtttagcctggttctgttccatgctgattctntgtttagccaggttctgttctatgctgactgtctgtttagcctggttctgttgtc

SEQ ID NO: 505437 - DNA, 155 bp, Homo sapiens
tgagcatggcccaggctggggagggctagttggcactggcaaagcccctctgccaggcttctctgctcaactgtaggtgcttccttgggcaatttgatccccatggcaacccacggatgctggatatccataatcttcataattatcctgctgga

SEQ ID NO: 505438 - DNA, 270 bp, Homo sapiens
  misc_feature (79)..(79): n is a, c, g, or t
  misc_feature (125)..(125): n is a, c, g, or t
  misc_feature (131)..(131): n is a, c, g, or t
  misc_feature (146)..(146): n is a, c, g, or t
  misc_feature (151)..(151): n is a, c, g, or t
  misc_feature (162)..(162): n is a, c, g, or t
  misc_feature (203)..(203): n is a, c, g, or t
  misc_feature (235)..(235): n is a, c, g, or t
cagattgcagcggacatcccagcaagtggttgtttcccttgcattggacgaaagcttggctccaaagcatccaggctcnaggaaaaacatggcctgctattgcagaataccagcgtgcattgcangagaangtcgctatggaaccngcatntaccagggaanactctgggcattctgctgctgagcttgcagaacaagaaaantgagctcagaatttgctttgagagctacaggnaagttgctattacgtcacagacacagtgcgagctg

SEQ ID NO: 505439 - DNA, 370 bp, Homo sapiens
tatctcgcgaaggaaagacacaaaaaagcgaaagatacattaagcacgaggcaaggattgtatgtcggtggaaaagtccaacgtatctttgcaactctcagggaaccccattatgcattagagaaaatagagggaagttgggggtctctaaaggggaaggctcccttgggggaggtgtcagggcttccccactagccaggtgacatttgaaactcatcctggcatcagttgtcctccctgaggagtcaggctgaggaccttgggttagggttaaatacccaaacatcagtcctgagtttcctgattcatctggggagtgagtgggtacgggaactggtgccctttcaaatgaagctttcctgccttctag

SEQ ID NO: 505440 - DNA, 714 bp, Homo sapiens
  misc_feature (714)..(714): n is a, c, g, or t
gtgagtgtgaaggcctaggacattattgtacactactgtagactttttgaacactgtacacttaggctacactgaatttattaaaaattttttctttctccaataataaattaaccttagcttactgtaatgtaacttttatgttataaactttttaatttaaaaaagtttttaacttctttgtgataaaacttagcttaaaatacaaacacattgtacaattagctgtacaaaaatattttctttatatccttattctgttagctattttctatttcaaaaaattttaatctttaaaaacgaagacgcaaacacacacattactctaggcctacacagagtcaggaaggtcccggtggaatgtctttagaggcagtaacacatagggaactgtcatctcttatgataacagtgccttctggaatacctcctgaaggacctgcctgaaactgttttacagctaatttttaaatttttaaataagtggatgagtacactctaaagatagtataggatagcaaatacatctggcacatagtttattatcaagtattatgtactgcacataattgtatgtgcttagcttttatactactggcagtgccgaggtctgttacatcagcataccacagacagatgagtaatgcatcattacaacagcttgtacatcactgggctacaggcattttctgctccatatgtgttgtacgggcn

SEQ ID NO: 505441 - DNA, 286 bp, Homo sapiens
  misc_feature (18)..(18): n is a, c, g, or t
tgttttagggaaaacaanctttccttcccccattatcacctcagaggaaagtatactgagaaatttttttgttttgttttgttttttgagacagagtcttgctctcttgtctaggctggagtgcagtggtgtgatcttggctcgctgcaacctctatctcccaggttcaagtgattctcttgcctcagctatttaggatgcttaggcaggaggattgcttgagcccggggatttgaggctgcagtgagccatcattgtgccacaatactccagcctgagttataga

SEQ ID NO: 505442 - DNA, 374 bp, Homo sapiens
cccccccacgagctcggaccgggagtggacgagagaaagaggatatagacacacttctctgtggcgggacatatggtgactgacccactgcacacaaacgggggccttagcgaaactgcagaggactgatccttagaccaatcacatcttcgccaagtctctgtcactgctgcgtgaccctcgcagattcgcacctttcaactcacggggaatagcaggccccactgagctggacactcttctctactgcgcttctccacggctagatgggccgactatgatgcagcacaaagtgtcaacaggcggctcgtgcactgtcataacttgaagctggtaggcactctgctgagaagcaatcccacagcaggggtatc

SEQ ID NO: 505443 - DNA, 384 bp, Homo sapiens
taggcagtggtgtttgactgcggaggataggtcaagaagggggacagctctctctttgtacgaatgagacccccctccagctcaggggcagcgagtttcacagaccgtagatactttcgtcactgtaggacaatgtagagaaagaagtcttcttcatggtgttcctggtacagctgacccattgtgtcactggtgggtggaatgacattgttgacaaagagaaacaaggcatcctcagctcggagagtgaattcggttccggatcaagaagtcgaactgagcaactgtgagatcagaaggcaccaggtatctctttttgtccaggtctcctatccgagctttgggagcctttgctagtatcaccggtagccggtccgggtattt

SEQ ID NO: 505444 - DNA, 786 bp, Homo sapiens
agcggaggactttgggaggccgaggtgggtggatcaactgaggtcgggagtttgagaccaacctgaccaacatatagaagccccatctctactaaaaatacaaaatcagccggatgtggtggctcatgcctgtaatcccagctactcaggaggctgaggcaggagaatcgcttgaactcggaaggcggaggttgcagtcagctgagatcgcgccattgcactctagcctgggcaacaggagcgagactgcgtctaaaaagaaaaacaaaaaatcctaacagacaaccttcataacaacgaagtgcctcttggagtaacattacaatggttactctgagctcttcacatgtaaaatcctagtgagatggacccggattttaatatcacatgttacaaataaggaagactaaaaggtgtaactagccgtgcttacggactacagaacctggggaggtgcgccgggcgcaggggttcacgcctgtaatcccagaaacttggggaggccgaggcgggcagatcacgacggtccaggaagaatcgaagatcatccagggcgtaaccacggggtgaaacccacggtccctacgtacaacattcacacaaaatttagccggggcatggtggaaggggcgccttgtattacccaagatactcagagaggctagaggcaggacgaaagggtgtgaacccaagagcggacatatgagtgagccgaaatggccccattggactccaagctgggtgataaacgaaatcggccacaaaaaaagccagcaaaaaacagga

SEQ ID NO: 505445 - DNA, 969 bp, Homo sapiens
ttctggaaaggtctgaacggagaccataatactaggtagcccccgatgtgggtctcaatgaccctatgaataggcataatttcttgctcaaaacgggtgtagggctcgcttaaaaacttcttagtactcactctcagtggaccaagtaatgatgaagtgtctgtgagtcaaaagattttaaatgtgagtaagggtttacagaacgatcatgtttgatacgaaggagagtagcttgtaatgagactctgaattgtgaatctgtaatagacgcatgtgaagagacgcatcggtggtgtgatctagatacattgacagtagaatatgtcttggaattaggcggtaatggtatgatatgccatgcaaatttcgggtttgatgacgcgcttggaaaaaatctgcttaagcctagcccctgcctaggtaggatcccatatggaggatactattgcataagcaacgcttacgattctgctacgaggaacagactcgtagtattcagctcattgcaataatcttcacatcaagcaacatagcccctcgtaggtaaacaagccgattgctcatccaaaccccactgaaaggttcaaacaggacgcagttaattgcttcactaatccgcccagcggagttacatacttcattacttattctggccttagagaaattcaaagttacgaaacgacatcagagttcggcttactaactccttcaattcaagggcgttcaaacgtcttagtccccacgtaaatacgccttttgggatgacttctagggaaaggctgggtaacatgagattagacccataattacctaatggaaaatccggggggtggaaccaggtttctgtgttattcatttctcctttagatcataatagtcagctatttcttacatttacacaaatgggtcatacccattacataaccttccggaaccgttacattccttccttcacaatatggttgcaaa

SEQ ID NO: 505446 - DNA, 1176 bp, Homo sapiens
  misc_feature (703)..(703): n is a, c, g, or t
  misc_feature (955)..(955): n is a, c, g, or t
agcggaggagggacggatggcggacgacgagaatcgtgccgcccggcctgggaccaatgcgcatgtagcccgcagcctcaggccgtcctgtactacttctaccacatcactagagccgctcagccagatgggagcaggcccacctggcccactacgctaggcacgtggtcggcgcatcatatccggggcatgcgccggagccctgtccacgaggctcccgcatgactctgactaccttgcctgagtgatagtcacaagcctaagatccacggtcggcccatccatccctcggtctggccacggagcattgatcacccggtcctctagggaagcgaaggcccactgcgcatgaactgtcctcaaacgcgcctacgtacaccatgtaaagacttcacctgctcgagaggaagaacgagaaggaaccttgtgaaacgctctcctggacgcatccaccaggatatccaagacgtagctaggcgagctcgtcaagaccgaaagggcccagaggagatgcacctgggagtggcccttgcgatggcatggacggtccatgattggcaggaagacccattggagaaacggagcagcctgcagtaatggccgctcgcggagaccgcgtgggaggactgagacagcgagccacagttgtcacaacagagagaattccggggcgattccacattctagtccccctcccggcacnaccttggagcttgcagaggtttgagagggaagccccccaggggcgcattgggctccttctcgtgaggcctggggccatgtgggtccggcgccacttagtcgctcgcggggccaaggattccgcccaccatggtccctcccgtccccaagggcagaaggttggcgcccgggagacacccccccgggaaatccctcccttgaggcgtatcccagtcgttgatccatgggcctttgatattcccgatgcgcgccnaggcagacctggggctagcggcacccgcggggcccccttatcccaaggaattccggcggcgtggcccctgtggtggttctccccttggttctcccttggtcgccattctcccgggattggggggacttggtgatatgcccgtcctggggatttcttcccccggttaagtggaatattctgaactttcaaggcatgcggggatgggggaagggcatccccgg

SEQ ID NO: 505447 - DNA, 1001 bp, Homo sapiens
  misc_feature (297)..(297): n is a, c, g, or t
gctgtttgaggctctggactgcttcctaccaccaactctttcaactgacaaccccttgagcctgcctctccatgatgtctacaaagattggtggtattggtactgtacctgtcggccgagtgtagactggctgttctcagatccggtcatggtggtcaccttctggctccgagtcaactgcttacaagcggaagctaaaatctgtcgataatgccagccatagaacgcctttgcagttgcaatgcctcttctctggcgcgacacactgctgcgagattcacattgctacatactaantgctgcttctggtcaaggaatgttcgctcgtgcgctgaacggttttgctgcgatgaccagtgcaaatgatgcaacccaaccaaatgtgaaggcagactggtttcacatgcctcaggctgtattatcctgcaacccatccaggtccatgactatagcgtccggctatgcccctgttattgggattcgccaccacgggctcacagtttgcatgcaaggtttgctagagctcgcataggagaaacgattgatccgccgatctggttaaaaagcctggaagatggccctaaattcttgaaatgtctggtgatgcgtgccgaatagttgagtatggttccctggctaaggcccactgttgtgtgtggacgagcttctccagattatccagcttttggggtcgcgtggctgtgcgtgatatgatgacagacagttgcggtggcgtgtcatcatatcagtggaccaagaaaagctgtgtggagctggtgcagtcaccaagtcttggccatgaagctcagaaggctaatgaatattatccttatactggcacccatcttaatcaggcggggagaaccggtctcccaactgtttgttcccattggcctcaagttgcgtaaaaagcgcgaagttacctggtttaaactttaagaaagacatgttttggcacccagagaccatgggggggcaaaaaaaacaaaatttggagaaaa

SEQ ID NO: 505448 - DNA, 181 bp, Homo sapiens
agaggacccgggcgggtgctatgatgctcaccgcctccctgttctgcagctgggaagttcaaattcggatccggcaaatggaaagaagaaaaatgtccatttgacgcctcaggactatatttaggttcctataaatccagggcaacaaaacagtgtattcaagcatcatagcacgctgccc

SEQ ID NO: 505449 - DNA, 264 bp, Homo sapiens
aatcggatacgggaggactctctagagtcaccagcctccatgtaaacgagtctttggaggtcagctactgatgctcacgtgtcgacggaacttgtacagggaggcatgcaccgcagtggtgaatacacgtcgaccaggctccatgtatacaagattgggtcgtcagcacggatctcctatatctcaaggaacttgtctaggaagttatgcaccgccgtggtgaatccacgtcgacgctggaggcatgcatgcatgctcgggtcc

SEQ ID NO: 505450 - DNA, 1567 bp, Homo sapiens
  misc_feature (251)..(251): n is a, c, g, or t
  misc_feature (318)..(318): n is a, c, g, or t
ataagttgggattactcgctctaattgctggcgatgatattggactcctggtgtcttccacgtgggggtaataccctcctcgtctcacacgtatgtgttatggccccacacgtttttagtgatggtgcgcatccctttcgtcgcaagaacgcggtgggttctgatcttaaagagtaggttttcttcatcgactcgtggggcaccaaacacaaaattgattcttcttttgggggggaaagtcaacaccacangccgttggtggagatccttcgtggttgtttcccacccacaaacatcgtgtgatgtaaccacaccggnagggcggtttctttccatccggcaacaaacagtggtttataaatatatggtttggcggaggagatattatcgactccattatatagggggggggtgtcttcataaatatggtgaccgcttctttctttattgaggagaggccctcttgtttgggagaaaaacgtgtccctcctgtctggcgcggtgtatgtgttgggaacaaacacccaccagagaagtatttggtagtatctataaaatacatctcctcgctttttgccaacagggtgtactacccgcccactatgagggttttccacacccacaggcttctgctggtggtctcacaaatggtggggagatgacaccacagggtttttggtggggggcggcggggcgctcgggcgcccacacgcacaacagaggaagagctacacccctgtggcgaaaaaaagaagagcggccgacaccggctactgcgcatcaccaggaggcgtagaagtattggcgaccaccgagggggccaccacaggaggggagttggtgctccccttggtgggggcacacacccacacacagtgcgcggataattatgtgtgttgtcctatatgtcatatcatgtgtgggggttctcaccaacacaacgacaccacgtcgtatcacatctctctggtggcgctcgtgtttgtctctatccgtgtgtgtcttatctgttgtgtttatacaaagagggcgcctctctagggccacatagtctcactctatagagacactgtctctgtgtctctctctcttctctctgtctcacaccggctgtgtcacagcggttctgctctgtgtgtgttctgtggagagagataaaagagaccacacatgtgtgggggtaacacacaccacacacacactttataactttttcacgagataagacacacatgccacatatatatgtgtgtggtggtatatctcacataacccgaatgtcgctttcacagagatggagaccctatccttaacacattgttcacaatgtgtgagagatataagaatataatgagaccacaataacacacacatgcactttataatctgcgtgggcacaatccacgttgagacttttaaaatgtaaagagaatggaaattccacaaacaccttgaaacacacacattcaagctatatattgaccacagagaaagtaaaatttatggatagtggtattttgtgtaaatgattttttaaataaaagagaaacccttacgtaataattta

SEQ ID NO: 505451 - DNA, 304 bp, Homo sapiens
ttatcccctgtcgccaccgaggtcgcacgcgtgagcattctccgccgcctccgcgtgcagacgccgccgcgatgcgctacgtcgcctcctacctgctgggtggccctagggggcaattcctcccccagcgccaaggccatcaagaagatctgggacagcgtgggtctcgaggcggacgaggacgggttcaacagggttatcagtgagctgactggaaaaacactatggaagaggtcatggcccagggtatgggcaagcttgcaagtgtacctgctgggggggctgtagccggtctctgctgccc

SEQ ID NO: 505452 - DNA, 653 bp, Homo sapiens
attttgttttttgttggattgtcttatttgttgctgctcgttcttctatgtgtggttcctctttctttgttcacattctattgtgtgtgccccttgaatctttcgctcgtcggtttttgctcagtcttaatgtaaatggaggtcaggtctatatgatgttgcgtgtttctgtagctattatgtgttgtatcctatgttggatctcttggtatcatcatctagttcgtccctgttgcttattctgttggttcgtatattttccatggggctctccagctcctctttcgtgcccctatcactcactttcctattctttacagccttaatttctatgtggattgtccctatttagtatgcccatcttcacgtggccaaatgtgagtacccgtgcacagcagcgggtgcggcccatacgatcatgagtccacgtggggccacacggctcccacctggtgccaaacaccagcccactgcggccgtcaccccgccagcctacacgtgccagccgccacacggggcagcacgggcctctgcttgccagccaggagtgcggacaccactgttcccagcttcagtgccaaagaggggtcacacgggggagctgtctgcggagcacagcgcctgcccgagagagaccccaccgccaccgtgta

SEQ ID NO: 505453 - DNA, 247 bp, Homo sapiens
ggggggttttccccctttttaaggttttttgaaccccccccttttgggaaaggggggggggggccccttttttcccccctgggccttttgcccccccttttttggggggcccgggggggggtttaattggggcccccttttttggggggtttttttttgggcccttcccgggggcccctttcccccccggggtttttttttttgggttggggttttttgggtttaggggggcctttttttcccttta

SEQ ID NO: 505454 - DNA, 265 bp, Homo sapiens
  misc_feature (5)..(5): n is a, c, g, or t
  misc_feature (15)..(15): n is a, c, g, or t
  misc_feature (18)..(18): n is a, c, g, or t
  misc_feature (21)..(21): n is a, c, g, or t
  misc_feature (33)..(33): n is a, c, g, or t
  misc_feature (35)..(36): n is a, c, g, or t
  misc_feature (47)..(47): n is a, c, g, or t
  misc_feature (87)..(87): n is a, c, g, or t
  misc_feature (89)..(90): n is a, c, g, or t
  misc_feature (104)..(104): n is a, c, g, or t
  misc_feature (108)..(108): n is a, c, g, or t
  misc_feature (110)..(110): n is a, c, g, or t
  misc_feature (118)..(118): n is a, c, g, or t
  misc_feature (123)..(123): n is a, c, g, or t
  misc_feature (132)..(132): n is a, c, g, or t
  misc_feature (148)..(148): n is a, c, g, or t
  misc_feature (172)..(172): n is a, c, g, or t
  misc_feature (195)..(197): n is a, c, g, or t
  misc_feature (203)..(203): n is a, c, g, or t
  misc_feature (208)..(208): n is a, c, g, or t
  misc_feature (255)..(256): n is a, c, g, or t
aacgnatttggctanagnaanaagggtggtggntnntcatggcccanatggcctccaaggagtaagacccctggaccaccagccccngnnagagcacaagaggnagtngngagacccncactnctggggagnccctgccacactcagncccccaccacactgaatctccccncctcacagttgccatgtagaccnnntgaagnggggnggggcctagggagccgcaccttgtcatgtaccatcaataaagtaccnngtgctcaac

SEQ ID NO: 505455 - DNA, 112 bp, Homo sapiens
agtgactcccgaggacacggctgtctattattgtgcaagagactattttgttgatagtggtaggttcaaaatcgactactggggccagggaacccggctcaccgtctcctca

SEQ ID NO: 505456 - DNA, 391 bp, Homo sapiens
  misc_feature (187)..(187): n is a, c, g, or t
ggatgatcgaaggcgttcggtcatcgaggaagtgaagcgcgttagccggtccaggcctgcgtcagttacaagtccgctgaagatctgccgaaagttcgtggcggtctgggcgtgtctatcgtctccaccaacaaaggtgtgatgacggatcgtgctgcgcgcgctgccgggtgtcggcggcgaagtncttttgcactgtgttctagaggggggataacgcatgtctcgcgtcgcttaagaaccccgtttaagctgccagccggttgtcgaagttcaaattcgcaggccaacagccttcggtgaaggggtgccaagggtactccttgaactgaacatttcattcggtccgttgaagatcgtcgaaaaagctggtgagcacgcggggtggggt

SEQ ID NO: 505457 - DNA, 421 bp, Homo sapiens
gcgggtgtcccactccaaagcctaggcttgccacacgcaggagggctggaccctctccatcacctgactcaaaggcccttataggggtcacccaatgaacacggtactggagacccgctgataccccttgaagactaatacacgggttatgattttcttttctttattcagatactgaagtgcctgccagcctccacatttccatctttgctttggccatcagaaagcttggaactaaatttaatctcgcgtcataataatcttaccacctttttgactccctccttctttggcatgagttttcaattttctgttcccattttagcaatcttattgtgcgtgtatcttttattggaagctgcctccaatcctttttagaagctgacagggtataaattgtaaataaaaataaatactgctg

SEQ ID NO: 505458 - DNA, 679 bp, Homo sapiens
  misc_feature (679)..(679): n is a, c, g, or t
aacaaaaaaaaaaaaaaaaaaaaaaaaaaaactctggttcgcgcgcgcgcgccccgcggcccctccggaaaagcttttctagaaaccacatccgcgtggggcgcgcgcgcgcgggcccccagtgtaggtgtaacgtgtggacacacatgtgggcgcatataacgcgtgtgtgtccctaagggagagaacccgggggccaatggacacatagaggcgcgtggggtatttctccacaccaatataaaaaaacacgcgccgcggggggcaacaccggagggcgtgtttcgtggagacacacatctctcacagagagtgtgagaggtctctcgagagagggggtctcactatcctagcgggagagtctctatatctacacacaagaggggaagggtctcacaaaagagagagagcgctctcgagaactatctctcaaaaatttttatacccgccactcccccgcgggcctccgtggtgtggtgggtacaactcaatcatcactcgtcgtggagacagcagaatagagttgttgggtgcgtggtaacacctcttcacaattagttcagagcacgtatatttctggtgggtgcgacgcgactactgctgtcggaggcagcagaccgcacagccacccaaacaacaaccacaggcggggggaaagtagaacgatagaaaaacactn

SEQ ID NO: 505459 - DNA, 1415 bp, Homo sapiens
gctgctctacctctcccgcgcgtcgcgcagatcctccgccggttctctcggtgtctacacggtctggtcttcagctacccgtcttcgtctccgagttctgtgacatcagcggagctcgcgccgtcggcccggcggcgagagatggctggcacattcgggagttacggttgacctggatgccatagtaggacgttgttcaatccgggaatgaagaccttggtgattggtaggtcgactggaacctggtgtaacgatctgcttggctcctagtcttcagcggatggaccatgttcctcgaggatgagtgtatcgtgcccagcaacgtgtctctgacgaatcgtactgatgcgccttgaatactcggaatgcgctgcgattgggaccaatctcgcgtaggaagtggggctctccgatcgtgtgactatcagatcgagagccgcgcgaccgtttgtacatgaaatctgctgcgtttactgggctgctcgtgcactaaccgcggagaaattacccggactttttgaagtatgcatagacatggctagcatctgaactacgccagattacgaaacacgttacccgtagcgagtactggctttctgaggagacataggcgatttggcccagaaaaaaaacggtgggaagcgccccaccgacggatacgggactccgaaaaggccgaatctatcgtagatcggcggcaaaagcgggtagttccgcgaaattccagttccccatgccggtttcgcgcggaaactttacacggcacacaccggaagttcgcttctccagaagaaacatttgcaacttgcaagtgcaatcacacacacagatggggaccggggggagacggctcatccagggccaaaacgcactttgcacaaccagcacaaccgggacagaggccccgccgcttggcaacagcaaccccgtaggaacacgcgaccacgcgctcacgggaacgcaacttacctttggcgccggaaacgatgccacggggtaaattctcggcggcgggcccgtgatatccaacggggagaataaaccctactctttgcgacacggacttgggcttctgtccactcgccggcacaagaaaaggtagccgcccgacacaacatcagaacgttacggggaccgcgtctggtacggaaccggaaacggagatctcatgtatgctgcggcacgtacgtatgggcccctttaagcctgaatcgcgaaccctcactttatgcgcttataccactcaggaacaccgccgctctaataatcgcggattcgtccaggacacaaccgaccaccaacgcagagatcttccctttgggggtggtttcccccgcctatcttaggattctctctcgcgctatggcccaacacgcgcgcctactgagcgccttgcccacatcggccacacacgc

SEQ ID NO: 505460 - DNA, 140 bp, Homo sapiens
ttctgctgggtggcagcagggcgggtgcctttcacttgctttgctctctgcttttacggtttttaccctttcatccaacttttcattccctttgctattcttctgcctcattttccctattctcctttctcacatggcca

SEQ ID NO: 505461 - DNA, 407 bp, Homo sapiens
ggccacgaggctcagctcctcttcaggtctgcagctgtagggccctcgatctagaacatcagctcctccctgagtcttctgctgcacgaccctcaaactagaatatcagctcctcccgggttttcaggtgcacgaacctcaaactagaaccttaggtcctccccgggtcttcagactgcatgacccttgatctagaacattaggtcctctccgggtcttcagctgtgaggaccctcgatctagaacatcaggtcctctccaggtttgcagctggatgacccttaaactgagaatctatcagctcctctccagggctgccagctgcgagaccctcaaactagaacatcagttcctccccgggtcttcagctgcatgaccctcaaactagaacatcagctcctctccag

SEQ ID NO: 505462 - DNA, 1012 bp, Homo sapiens
cgcggtggcttcatccctgtaatcccaacactttgggaggcccaggcaggtggaccccacctgacgctggagtttgagaccaggagaatcacttgaacccgggaggcggaggttgcagtgaaccgagattgcaccattgcactccagcctggcaaaaggagcaaaactcgggtcaattcacattaccttacataacataaattattcctgatctctaaaaaaaaaacaacaccaacaaaaaaaaccacttttgggcgccgcgccctcggcccaagaaaaaaagtttctctagacacccttttggtttgggggggccggggccccatatgatattcaagccttggggcacaccgtgtgtcccaaagaagatcctggggccaggctctggtgggggggtttccccccaataaaaaaaacgcccgggcggagacccagcgcgtgtgtctagaaccaaacccccaaggggggggttccaagccgcgcaaatacggcgacctacaacacacaacggcgggctccaacagcgagcgtcggatattaaaaattagcccgcgcgcggtgggggtgagtaacatcagtcacaactatcgtatcactatataacgatacgcatctcatatgcacctcttatagatcactagacgtactatcagtctatccatgaatgctacagacgaaccgtcccagatgcaatgacactcatctgattcacgtcacaacacatcgactatatcatactacctacaatctcatgtacatacataattatccacacatagagtcattattcttctacactcataacaactcaatacccctctacccaaaacaactcagcttcacccgtgcactatcacacactcagcactcacacatctaatacactccgttccactcaccaacataaatgaacatcaactcattaacatctcacccacacaaaccagaaaaccactcacatgcccacacccgaacacccatacatgatctactggattccaaacctcacact

SEQ ID NO: 505463 - DNA, 103 bp, Homo sapiens
tcctcatcaacctatagtacccctctggtcatgatacaaccagaaggaaagtctgtaaatctcatacaaaggtagaaagtgcacattcaacccacacacgctg

SEQ ID NO: 505464 - DNA, 377 bp, Homo sapiens
  misc_feature (98)..(99): n is a, c, g, or t
  misc_feature (110)..(110): n is a, c, g, or t
tcattttcaacttaattggatgtttcttttgcaaggtcttgtttttttcctagttctcattcaccgttcagttgccttcccccacctgtgagcttttnnagtcaaacttngtttattagcttttttcctgattcttctttcatgtctttctttcctatcccaaagtatgattgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctcagagg

SEQ ID NO: 505465 - DNA, 280 bp, Homo sapiens
cgacggttagagtccatggtggtcgagcaaagatgtggtggcaggaacaggtaagagctcacatcttgatctgcaagtaggaggggggagggggagaggagagaagagaagagaaaggtagaggaggagaggcaggctatgaacaagtaggggggtggaatgcagagagataggggaagggaagcagagaaagagcaagagagcaaggagggggcaagcagccccttttatagtgagtaggacatacctggctgttgccaggtagctgtggggtcgacgc

SEQ ID NO: 505466 - DNA, 102 bp, Homo sapiens
caggcgcttaattggcctagaatgtgttgaatgcgttgaatggccctggtctatgagaactacaacaagttcatctctagccacatgacaccataccggtaa

SEQ ID NO: 505467 - DNA, 984 bp, Homo sapiens
gctggcggccgtggagtttgtgacatacgaaggtgacacccctcgagctcacttcccttcaactccagctggagcgcctgcttggctttgggttcgcttctgcatgccttctgccccgtctcctagcctcatgggccggactcctagacgcatgaagcccagtcgcactaggcgcagaccgtgccagcgagccacccagactcgccacagccgcccagaccccgacactgataaccccggagcgagcagtcttctctaggcgagtcccggagtcctatgaacacctgaaatgtatcatgacctcccgatgggagtgttggcgtgtctcaccagctgcactaatttctccatctccttcttctcttctctgcttggcaggggcatgtggtttccgttaacgctggacaacagtcgcctccggcagccagcgtggtggcctatagactaacaagatctgaacaggccactggactctcggtgaatcaactcatcttgatgtattgctgtgagcagaggagcgtggagatcctgacacgagcatgatccgagtagctgcgtggatcacgtaatctcccagcctagtagcgtgcacgaacacctcatgtttcgaagtactcctgtgtcaagccctcagcagcacgcgtggtagaacgttctcagtccttgtcttggatcgccctgcaaggagtccacgactcccgtaataccgctcactaagtgtgccctgaagcctcctggttgcgtactgcgggtgtaacgtggctctgttcatccacgggttgtgagcattaccgccacttaaaaactttgttgttcatccgtaagttccctttgccatgattagttggcaagggttcgcacgaatggcagtcatccgtctccgaaggcagcaacttttatcaccttatgcacgagtgtaggtggccaagaagagtgttcctaaggaaattggccaacttgggtccactcccaaggacagaaacc

SEQ ID NO: 505468 - DNA, 106 bp, Homo sapiens
atgggatcatcactcggatcacagatggccactgcgcattgccagccttgtgagctccagagatggattcagggagggtttcatttgatgtggctgcgctgctacg

SEQ ID NO: 505469 - DNA, 274 bp, Homo sapiens
tcagtatttgaaattgtggtgaaaagctgcagctgtcatcttcaaatcatctcataacatactttaaaatgttctggtagtagtgtgcattgttcatatgagaatgtcggttgggtgatctctttgctgtattaatgagttctttacatgtggtctcatctgcctgtgtgagttctgtgtcttaatatttactggaatggaaatctatgtattattgtaaattgtatatgctggtaatcaaaaattaatcctttggttaaagggaaaaaaaaaa

SEQ ID NO: 505470 - DNA, 262 bp, Homo sapiens
tccccccccccccttttttttttgggtcccctccctcccccccccctcaaggggggttttgtttggttttttatttgggcccaaaggtttccgggggttgcgaccattggcaggggtgtttttcaacccctggggttccgggcctttttagaacttttccgggttttcccccagttttttttcccccccgggttggggccccgcccccccccccggggcttggggttcccggccctgccccgggttcaaccgggccttttta

SEQ ID NO: 505471 - DNA, 285 bp, Homo sapiens
gcgtgtacgtgattaggtatacaatatagtgtacaggccgtgatttaaaaaccagaaaacagctatgcatgataatactcctagagcgtggttcccctctagacaggacatggaattgtcccgaggttcatttcccccaccattgattcatcttcctccatgtagactgggatgagaagtcaaagtcttcatcaaggtcaaaagccactttttacagaaaaagtgacttactccatagaggttacatgagatgctctggaagcacttaggttaattccttcacag

SEQ ID NO: 505472 - DNA, 908 bp, Homo sapiens
  misc_feature (45)..(45): n is a, c, g, or t
  misc_feature (158)..(159): n is a, c, g, or t
  misc_feature (164)..(165): n is a, c, g, or t
  misc_feature (183)..(184): n is a, c, g, or t
  misc_feature (209)..(209): n is a, c, g, or t
  misc_feature (211)..(211): n is a, c, g, or t
  misc_feature (262)..(262): n is a, c, g, or t
agcggggtacgctggctggatgggcgccggcaggagcgggcaggncgaggcgaaggccggggagggatcgagaacggtgtgggagagctaggctcggggggcgaggccccggcccggcggggcgatggaggcgctgctctccacccccatcaaccccnnacaannttcccctgccaagctgtnngcgcctggtgaacagcccgcgctancngctccatccagctgtggacgtgcctgcgagcgagggtgcttgcttatcgantcagaccgctctctcgagtgcctgacgctgctcagcctcgcccgggcctgggggtgcggtggcgggacctgcgggggccggggccgacgcccgacgctcttcgaaagccaccatgcttcaccatgctttcatcgcgcgcaggtcaagcctctacggccttccgcaagtgtggtgctgcggcgggccgggggagcggcgaaaccggcaaggcagatggtgccgactcacatcacgttcacacaagcccgtcaacttcctgcgcgcgtaccagtgccacaggctgtctcagtgcaccgtcaagtcggcctcatccagctgccagacataggccaagtctggcggaccggcctgtgagcgtgcccgtgcctgcgccgcccaaggcgcttccgagcggctgctcatcacctcggcctccgccgacaccgttgccaactgcagcaccatgcagaccgccgcgcgcccgacggggcccccgtgcccgagccgcacggaccagttggctgtagcgacaatttcacccggtcattccgtcgagatagtgtgtctcctttactcctgtgtatcaactccaatccatgaccacagtacttaccctctgaacggtttagatccggacccagttcctcatacaatatggcgaactcct

SEQ ID NO: 505473 - DNA, 498 bp, Homo sapiens
gaatgtaggctttgaggggtactgtagatgttgcagagagtactatataagggtttgaaatctgtaccaacaggtccttggacagctgcctgagccagtccagcactggggaaaagaggcttagtaactggacactgtgggacaggtacagttgctgttagtagcagatggtctattaagaattacctggctgctgaaacagtctgtgcttgagtcattggaagaattccaagacgtgaaacaggtggagggcatacctggtggcattccaggcatcagaggtgatattcctggtccaaggtggaattattccacccattggcatcataatgttatcaccgcaaaatgactgggtgtattttctctgatgatgcaatccaggtggcatgcctggcataactggtggcattcctggcatcagaggaggaacacctggccttaatggaggtatgcctggaggcattcctggtgctcctggtactggttgcagtcctggct

SEQ ID NO: 505474 - DNA, 89 bp, Homo sapiens
gcggccgcctactactactactgctcgaattcaagcttctaacgatgtacggggacatgtaataaaggtgtttattgttttgttcccac

SEQ ID NO: 505475 - DNA, 253 bp, Homo sapiens
gatccgagcgaggaagggacatgtgctcatgggggaggggaggggcacagaccgccagtccagctctttcttcttggaccccgatcccattaagtgaaactaaagacattgaatttgcctgcacatttcgcaactaaataggctccacgggacaatggcccctggggtgtggtttcatatctgcgtgtagatgctcctgcaggctgagattacgaaaacttggccctccgtttgcagcagggtggaatcggct

SEQ ID NO: 505476 - DNA, 345 bp, Homo sapiens
ggcacagtgtctcacacatacaagatgcctctgtctggtaacaggcacaccagcgtcgctgttcagttacagtctaagtctcgtaacgcggggagcgttcatcacaacgaattttatttacagctttatcatccatatgccactaaaattcacctgttttctttcaacctgcactcattttgattgcctggaactctggatttaattcttcgatcccactttgtatcttgcattcacttcactctctctccagcttttattctttctttctctttccctaggtccaatgcacttgacccaactcacatgcgtggactccgggaaggtactgctccctccctccaa

SEQ ID NO: 505477 - DNA, 960 bp, Homo sapiens
actgtgagcggtgccaagccaaggggttcgtctgtgaactctgcaaagaaggggacgtgctcttcccgttcgacagccacacgtctgtgtgcaatgactgttcggctgtcttccacagggactgttactatgacaactcgaccacgtgccccaagtgtgcccggctcacgtgaggaagcagtcactattccaggaacctggcctagacatggatgcctagaacactggagaacgccaggcaccgtatccacccctccggctggtgcctgctggccttgcccaccagatgtgcattctactctggagacgagccccccccccccgcagagaataaccccaaaaacacctaggaaccaggggccaaaaagaaagggcttaggggccccgggaaacaaacccacgggggggcggaagaatcacagaggggctgaataccacggcatctgtgaatggcgttggcaggaaatcgagggatcaaaaacacgggcgtgggccccaagtagatcggacacccctttaggggacgacagacacctgtgggtgtgggtacataccacccagaaaagggtggggaaactcaggcacactaatggaaaaaaaaccctacaaggggctttaaaacaaccaaggcacttatggcacaatagaaatgaccctggccacaggtaagcaacaaccttaaaaggtggccaaagctgaaaaggcagctccaggaaaccagaagatgcccggaagagaacaaccggagaagcaaataaggacaacgaggaccacaccattagacatgccccggtagaagtcgatactcgaagggggtgacacaggtcccgtgtagccggaccgaatagcactacaaagggtaaacgggtccacacgagtacagcggaagtgggcaacatgaaacggggcagaaacgacgggtacgaagaccccaagaacacagaagcggacagaacaaaa

SEQ ID NO: 505478 - DNA, 395 bp, Homo sapiens
tcattacacctgcaggaaacttggcatataccaccaaatgacaacattaatcatctttgaacatcatgctttattttatagcttgggaaatcacaatgaccattatgtctcaaaccattccctttataactccaatgagaccttattacccaaactttacaaatacaaaagccaaacttcaaagatcacatggctaacatggagcagataaaaatgtaacactgtatcttgataccaaaatcagtaagcaccctcctactacatgacgtagcctcccaattgctattcgaagagggtaactaaacaacttcaggaaagggaaaccgagtgtatagcacagaaaattcaattgtcgaagcactaacacacacttagttctaagttctgctttatta

SEQ ID NO: 505479 - DNA, 740 bp, Homo sapiens
ggagttctgagcagggcgggactcaggtgggcgggatgcgaagagctatggggaaggattcgaattccggtggatttaaatcgcgggaggagaagctaccgcggcctaaagaagacctctgttgaacacagactgcagttccagccaccacagctaatctggatcatgaatgggagccaccgtggtcttggcaagtccgaaaacatagctgagtagctcgtctagaaaagagatttgtgttcagctgagttaaaagaagtatttacctcaaacctctcctcttgcacaaccaacccccgttataaaaggaagtgcaaaatggaataaactgattttaagtgaatacaagctgtctttatatacaaaagtaactcaaggatggtgatgtacccagtcatgctttcaactgatttgggaagcctacaccattcaccttaggttacatatgaggataacttaaaacattaagctatgcataaaaactccaagagaaacaataatttaagagtttctcacacagaagcgaactctgtggatgctgagaaggaaaaaaatgagagtcaaaacaacttttttgaactgctgcctgcagaaatcacttttaaaattttcagtcagctggacattcggagtctgtgcagggcttcattgacatgcaggagctggaatgacacaataagaaacagtgactctttatggaaacctcactgcatgactgtaagagctgttgtaactggggg

SEQ ID NO: 505480 - DNA, 303 bp, Homo sapiens
  misc_feature (21)..(21): n is a, c, g, or t
  misc_feature (299)..(299): n is a, c, g, or t
cccatcctagatgtaccctanagttgtgacagtatttgaaaaggcccaggcatggtggctcatgcctgtaatcccggcactttgggaggccaaggcaggcaaattgcttgagccccaggagttcaagaccagcctgggcaatgtggcaaaaccccatctctacaaaacattcaaaaattagctgggcgtggtggcaaacacctgtggtctcagctacacaggaggctgaggttagaggctgcagtgagccgtgatcataccactgcactctagcctgagtgagagagcgagaccctttntgaa

SEQ ID NO: 505481 - DNA, 274 bp, Homo sapiens
acaagtgagaggatcacatctgatggagagtgggcatttgacaacgatgtaactggtaaccagccttgtgaaatctacaatataagtgtctttttaatgctctgaaagctgctgctggtcattcattaatgtgtcagcacatttaatcaggatgctggaccttcaagatcacactgaaaaatgcaaccaagaacaggcggttcgtgttttcaacatgatctttacttaaataaccctgtgacaggcaatgaacgcatctgcacaatttaagctc

SEQ ID NO: 505482 - DNA, 808 bp, Homo sapiens
aactaaggtcagagctgaactgaaggagatagagacacaaaaaacccttcaaaaaaatcaatgaatccaggagctggttttttgaaaagatcaacaaaattgatagaccgctagcaagactaataaagaagaaaagagagaagaagcaaatagatacaataaaaaaatgataaaggggatatcaccaccaatcccacagaaatacaaactaccatcagagaatactataaacacttctatgcaaataaactagaaaatccagaagaaatgggtacattcctggacacatacaccctcccaagactaaaccaggaagaagctgtatccctgaatagaccaataacaggctctgaaattgaggcaataattaatagcctaccaaccaaaaaaagtccaggaccagatggattcacagctgaattctaccagaggtacaaggaggagctgttaccattccttctgaaactattccaatcaatagaaaaagagggaatcctccctaactcattttatgaggccagcatcatcctgataccaaagcctggcagagacacaacaaaaaaagagaatattagaccaagatcctgatgaacatcgatgcaaaaatcctcaataaatactggcaaccgaaatcagcaacacatcaaaaggttatcaccatgatcaagtggggaaacatctaatcttcttaaatgcagtgtacttacatggcctgcgaatctcttatgtgttcacctcggtggagggcattggaattcctggtcattaatggttggattctggttacttttcccccgcctggaaccct

SEQ ID NO: 505483 - DNA, 497 bp, Homo sapiens
  misc_feature (194)..(194): n is a, c, g, or t
  misc_feature (227)..(227): n is a, c, g, or t
tcaaaaaatgcagccaatatttaagctccccgtgatttcagactacgaatgggtacctgcttcgtctgttctgtgttggttttctaaaaacgcacccatcagatacggagggcctttattgctcagccccacaggtgccgcccaatccggaagaagatgatggaaatcatgtccccagaggtgccgaccaattnctttaaaaaagtggtccattaatttattcccgnccgccttggaaaagacatagaaaaggcttgcccatctatttatcctctccctgatgtttttgttagaaaagtaaaaatgctgaaaaagccccagttttaattgggaaagctcatggagcttcctggtgaaggccgtagttttggaaaaacccctgggggccagaccggtgctaaagtttaaccagcttatggatattaaccccccgtcccaaaatttgtttaaagttccgacttccaatagtggccaataaaaagtgcttttttttatta

SEQ ID NO: 505484 - DNA, 337 bp, Homo sapiens
ccctggtgagtgaggggaggagaggcatggaagaaaaaatattttttcactgcactctgaacaactcccattaccggcccgatgcaggtcatgatgttccaggccctgcaggtgaggggaagcagacagccatgtgccgtcaccatgcagtacatcacctggctgtgcctcaggattcaatctctgctcttctcaatctggtctcccttcccaggagatcctacctatgcacttcctcaccttctaccctcatccacttgccaaaatcttccaaatctgcagattcagcccaggcctgaccatcctgagctccagacctacacatacaactgcctat

SEQ ID NO: 505485 - DNA, 403 bp, Homo sapiens
  misc_feature (88)..(88): n is a, c, g, or t
agatgtactgtgatgtgagtttgaaaaagagtttctgaagtattatatttgggagatatgttactagctgagcttttcaaaagtttantaagagctgaggaattgtatttttatctttagtataaagcaccttaaaaacagtaaaaggagcttttatatttcagataaatatagcactgataaagtgacagctgggctgaatattacagcattacatgggccatgcaatcaataatttaccattagcattagggccatggcaaaagcaaatttagacatttttaaaaggaaacagattttaggatgtacaaataaagtttttacagatatagtcttttaattagtacttttatcttataaactgattatgtatgtctgttttttcaataaacaaacaaatgaa

SEQ ID NO: 505486 - DNA, 207 bp, Homo sapiens
cacgaggcccgggttacttttgtagacttcacagttaaccgtaggagtttagaaagccagtgtctaaatgaagtacatactgcaggaagacctgatgtggacgacaagcgatctgatcttcctaagcttcaaggggaatttcagctccgtcttgcgtcaacttggaaaaatctctaccacaagctcctgaatgaggtgaaagggggc

SEQ ID NO: 505487 - DNA, 805 bp, Homo sapiens
ggcagagggctctcagggtccacgtcaagggtccagcagtcgtcaccattgctccctacgtcacactccggagggtgtctcaatgccgaaagcagcaaggctgaacttccctagacctaagagtgccttggagcgcctgtactcaggggatcaccagcgaggcaagatgatttgcataggagcagctggagcgcatgaagcgataccagaaggccctggtccgagagcgcaagaggacacatggcgtggcaaggtgacgagtgacggtgctcctgtccatcatctcgtgtacctcagccgtgccgctccctgtgagatcttggctcagtatgtaaggaggggccaggcagcgtggcatgggtacagggaatgccgatatgccccatcacaagtccccctataacgaggaagcacagtcatacctcccagtgaggagagctgtccattggacctacatggtttcagagaacgacctcccaaggtggtctgttagtccaccgatcgaggcgtggtaacgaatgccttggtcatgcaggggtgacctgaaccatagctggaggtgaggatcaaacaggcccagcgagcctgaggaaatacccagtcaggacctcccagccgcgatggacgaaggggccctttggcaggccgtttcggacagtctacggctgcaatttcagaggaactgggcaataccaggggttcacagcaggagaggctgaaccatggtgacctgattttgggtagaagccacaagcaaactggatttagctccccagaaacttgcagcgagaatactggggtgagg

SEQ ID NO: 505488 - DNA, 415 bp, Homo sapiens
  misc_feature (411)..(411): n is a, c, g, or t
cttaaagtcataaaagcttaatgaacaaaaggggccagaaccactgttgccactcaaccacccagtatcaaatccacaccctgggagagaccattccccagggaccacttcgggcccacggatcccttttagtccagaagacgtcccaaagcccaaattagatacggcatctaccaagtcggcagaatttgtggctaacttgcgccttcccactgttaaaccacaaaccctacccattttacaaccagctccatctaaggaagattcctccacaccagtcatttacaacccaacagctttccccaacacccacaagttttcagttaagaatccctctgaccaatgcagaggcaggcaggctgcagaagcagggaaggtgggcgaggtcactggggtcccgatctacatgtnatgc

SEQ ID NO: 505489 - DNA, 737 bp, Homo sapiens
ggcagaggggtccatacggcgtcgttctggattcccgtcgtaacttaaagggaaattttcacaaggtccggagccctgagtgtcctgcgaaaatgaaggaggaggatgtccttgaagttcctgtgcagcacggaacccacttcaggtggcaccaagtcttgacttccagatggaacagtacatctataaatagggataaagtgatggcatcatatatcatacaagtctcagagaggaccgtgggagaagcttctgctggcaggctcgtgcaagttgttgccatttgaataagccctgctgagtgtcacgctgttagtactcactcgcaggtaatactgggccagtaggagctgtgtctgaaagtgttgctggctagccagctggagtccatatccatattgtctggacgcagctgttcactgcctgtgcagccttgtcacgtaaaccaagatccacggcagtgctgtccagggaggccacggacttctatgtggtatactgaccgccagggtctgaccgagctagccctcctcacagggagggcagtcttatggttaacactacctaccaattgcgctggtgtaacacatgattctcctctgcgctatgtggacatggtcatcccatgcaagcaatgaagggagctcacgtcagtgcggcttgatggtggtggatgcctggctcgggaaaggttactgcgcaatgcgttggaccgatttacccggtgaactagccca

SEQ ID NO: 505490 - DNA, 116 bp, Homo sapiens
tcacacgtcacacccacagtcacacctcacagtccacacactcacagtcacacctcacagtcacaccgtcacagtcacacctcacagtccacacctcacagtcacacctcacagtc

SEQ ID NO: 505491 - DNA, 518 bp, Homo sapiens
cggttaagttcttgttagagccggagaatgtttcgagagtgaccgcgtagcgcaaacatgttccagggtcctgtgcctgatgatcggtcgccctcatgttggcgctagtggaggcgaatcgcttcggagaaaatgcgctgttggcgcacaagtttgcgcaggcgatgaggacaacagtgtgtacgaggaacaacctggggggcctgtggtacgccatttcatgggataatgagaactaggtgtggctttgctaagacaatgggttcttacagtggctggcccgaagttctgtgaggcacaaagccacatacaccggctactggttggtccaacaagacaaggtctgtccaagacacgtcggtgtgaagaagcgttctatgtgtgtcaattgtcccccgcccagctaaaagttggtgtacctctgggtgccactctctttgcctaatgcacttgttgacgtgattcttctgtgccaccggcacccaaagaaaaagaaaaaatcattaatagaaaaaaga

SEQ ID NO: 505492 - DNA, 170 bp, Homo sapiens
cccaaaagggggggggggggaaacccccctttcccccccttttgggggaaaggggggaccccttttaaaaatttttttttttggggggggtttcccccggggggggggtctaaaaggggcccgggggttcccccctttttttccccccccccaggggggtttttttccca

SEQ ID NO: 505493 - DNA, 255 bp, Homo sapiens
atgttgtgccttctcacgcaggggggagtgggtctcatcttattaccaacagccagagaaaggagttaatattcaggatgcatcattctctaaaaaataagagctgagctctgttgattccaggaaacatggtgcagggatcgatgaagggcctgtgataggagaatctagatccagtgcgcaggggtgcgtctaagcatacagtagagacagtcgcagagctagcaaacggtcaccttttttcggggaggtgca

SEQ ID NO: 505494 - DNA, 200 bp, Homo sapiens
ggagacgggggtctcacccgtgtcaccaggcttgactacaggtagtggctatcacagctcacggcagccttgaactccggggctaaggatcctcctacctgagcctccggagtagctaggactgggtctccatctggtggtccaaggctgggagtgtagtagtgctatcacagctgacggcagcctcaaccttccaggcg

SEQ ID NO: 505495 - DNA, 236 bp, Homo sapiens
cactcctcccactcacaatttacgaccacaggaccctctcaagtagcagggactacaggcgtatgctaccacgcccggctaatttttctattttttagtggagacaggattatgcgatgttgcccaagtggttcttcaagctccgtgggctcaatgtgattcacccagtgaccgtcccaatagtgttgaaggttactacggcgtgagccaccgcgaggggactccgtctagacgtc

SEQ ID NO: 505496 - DNA, 357 bp, Homo sapiens
ggggggtttgtcctgcatgtggcccagacccccctgacccccgggcctgcctgcctggccctgcatgttgcccgccccctgtatttgggcagatcctggccaggacaaagtcggggctcttgttttattttttcttacagagtctccccccctttatagaatgtcaaccaaagagggccccccccccctttcagcctcctttttagctagcccccccctttcatcccaacgcatgtttgtgacctttgggaatcatttacagggccccccggaaccctgttttttgcccccagccaaaccaccaatgtttagctttttttatgggatttgatgcggtaaatggaaataaatattgtt

SEQ ID NO: 505497 - DNA, 406 bp, Homo sapiens
  misc_feature (40)..(41): n is a, c, g, or t
  misc_feature (345)..(345): n is a, c, g, or t
gagagactggtcacagtttatccttcttatccttgtgttnnactcttggccgctagccagcagaggttgtggcttataaggggagaaactatgcattaccaatgttaatgatattatttgcatgaaaagagtgtgataatacaatggctcatttgccccacaaaagtgtagggcaagatgaattgattacttaattgatgggttgcacaattgccgttcgacggaaatgcaatcttaaacgcaacatagtaaccagtgcgactgccataacgaccattgcagccagtggaagctgttgtaactgcaggccaaatgccagcaaggtgccacccaaccaggcacctnatgcattgcctaaattgaacgcgctttggttaaaggttgatgccagattagggagtctcac

SEQ ID NO: 505498 - DNA, 389 bp, Homo sapiens
  misc_feature (74)..(74): n is a, c, g, or t
ttttttttgagatggagtctcactttgtcacacaggctagagtgcagtggcatgatcttggctcactgcaagcnctgcctcccaggttcacgccattctcttgcctcagcctcccaagtagctgggactacaggcgtctgccaccacgcctggctaattttttgtatttttagtagagacggggttttgccgtgttagccaggatggtctcgatctcctgacctcatgatccatctgcctcggcctactaaagtgctgggattacaggtgtgagccaccgcgcccagctcttttaatgtctttaatgtagcttacaagaaaatattaaattaatggtatgtgggctttatgttataattttatttcaacagcactgctctagctttgct

SEQ ID NO: 505499 - DNA, 162 bp, Homo sapiens
agcaggaccctgcacacgccgagccccatacacttcttcaatcccggtggacgaagtgtgcaacaacttcgtccataatgacctgtatgggttttcggcgtgtgcagtaacaacttcgtccactgggacctctcggactcgtctggatgttcggcgtgtgca

SEQ ID NO: 505500 - DNA, 313 bp, Homo sapiens
  misc_feature (1)..(1): n is a, c, g, or t
  misc_feature (46)..(46): n is a, c, g, or t
  misc_feature (146)..(146): n is a, c, g, or t
nttcggcacaggaaataccgccagacctgactgtgcctccaggtanctgacagacttcctgctgtggccagctctggtgctgtgcttcccgtgagacccaggaccccttcctgccatacccaccaaggtcctgcccacaggcaggnctgcctctagcgcccactacctcgagacccctgcccagagggtgggttgcttggtgtttgcgggaacgtgggcattttctgccgggaacggggtttgctgctgggctcgagggccttaagggagcggaacctaggcctgatgggttaccagctcctgccgttaccct

SEQ ID NO: 505501 - DNA, 145 bp, Homo sapiens
gaactagtgcagtggaggtgccccacagggatggtaccctacaagcacctcttggcaattaccatttccttagggggtgtgttattcagaaacccccctaacttcacgggtgaagatttttgagacaatttctgtgcctgtgtgc

SEQ ID NO: 505502 - DNA, 271 bp, Homo sapiens
gtcaacgcaatactcctgctggtcaggctggtcttgaactgccaacctcatgtgatccacccatctcggactcccaaagtgctgggactacaggcgtgagccactgtgcctggcctgagaggacaaatatttttacaaagaaatgatagttctttaatgtatagaatgtgggatgattattaaataattgccctcgtattcagaacatgtattcagtatgatcagtgattcccagatcttggcactacttgacatttagcggccggataaa

SEQ ID NO: 505503 - DNA, 119 bp, Homo sapiens
aaaggagcggggagggtaatgacttgagggcatagcaggaataatcaaggtttttcttgtaagcatgtggagacttaagcatgataatatgtaaaatgcctggcacatacatggtgcaa

SEQ ID NO: 505504 - DNA, 790 bp, Homo sapiens
  misc_feature (328)..(328): n is a, c, g, or t
  misc_feature (418)..(418): n is a, c, g, or t
tcccgtctcaggtccccgctgcaaagggacccgccgccatgtctgcgcatctgcaagggatggtcgggcggaactgccccagttccctgatcaaaagaaataagcaggacctctacagcaccgtgaccccaaataatcgttgaagggcccgcaattccctctctccgcatacaaccggaccgtgattctcacccgaaaaactgtggtgggcgtatgagacccaggcagccgacggacaaagtggtgctcggtgggtggctcattaaagcgagagactccgcgcacagcagagatacgcctgtgcacaccctctccttatgtgtgtgcngagaccccaccacatactcaaacacaaagagaatgtgctctcgcccgccacgtctctcagacaaccatctcaagaccaacatgtgatctnccgcaaagaaaacaagtgttacccgccccagacctgtgccggcatgtggtcagccatctccgacgaggggcccgaggcgcccactccgtggcgccgaggccagaagagcccgtgtgtgaagtggttgaaagaggaaaagcgggacccccggccccccaaccatagaatgcctcctgtagaagcccccgtgtgtcgcccccaagaaggcataataaaaggatcgagccgtgggctttccctcaaaaaaaacaaacaccaaacaaccaacaacaaaacacacttcgtagggggcaaataccataaatgacagggggggggagcagaaaaacaaacggggtaatgtaacaggtgggcatatatgtccacaaatgt

SEQ ID NO: 505505 - DNA, 773 bp, Homo sapiens
ttcctgcccagtcattgttcgacccagcaccccatacgatgcagtatcaaggcacactttctggccacgggacctgtggccttctccgcccagcccctgctcgctgccccgtacccaatattgcccggggacgccgagtggctcaatgaacacggagacatcctctccatgggatgatagacagcggccgcctcatcagctcgacgcggctcccccaaatgaccctgcgcatgccccccgcctggacactgactggcagcagtcgggctacagcctcctactcccagccctcgagatgagcttctaggtccaggtgatgactgcaaagcagtctccaggagcaggccactactgcccagagagcagaggaggaggttagttgcgcagggactgcagatccatgtcagacctggccaccaccttgggcacggccatctctgccctctggaccatgtctttcagtcgggagaaaccagctctagagatggatcaccagttcctctaaaggtctcacagcaaagtgagcacggagctcccaggcacccgtgtaccctgcctggcctgattcagggccattgtggcccccagcttctgtttcaagctcggcagatccccaggatcccttccctccctaaggactcagctgaggggcccctctgcccccattctactctccacctcagcaccctcccccagcttgatgtcttgggtctccccagcacccatcctcctggaccggtgcaaagtacagggatacaccgcaggcccttgca

SEQ ID NO: 505506 - DNA, 222 bp, Homo sapiens
tgaaacaaagctgcccagttatctctaagctcgaatttagactacttgtccataatattcatccctgtagcattgttcgatacatggtccatcatagaatacacactcgcagatatcaacatcggacacaatcattaagcatgatcttgaaatatctactcatcttgctaggtaccatactaatcttagataccgctaacaacctattccaactggtcatcg

SEQ ID NO: 505507 - DNA, 744 bp, Homo sapiens
agcgggggggctgcatggaagccgcgcgcgccgtcgttttggtggtcagggacccagcgaggagcgccgactcgccggccgccgcacaccctctctcggctgcagcctgctgtgcgctgcacggcctggggcccgtggagccccgatccgcgtctgctccatgagggggccccgcgaccagccgctgcttccagcaccggggcggtgcggtgctgaggcggtggcggcggcgctgccccctctgcggtaagcgggcggccccggccgcctccgcgagggcaccatggaggtgaatgcaggaggctgtgatatggctatatcagttcttccagctcagcctcaaggccatgcctcttgtcacagtgagggtcctgagaatagtttccatgtcctcctccgtcttctgttccatcttctccaaagtagctctaatgctgataccaatggtaatcccaagaatggtgatctcgccaagtattgaaggcatcttgacagaatgatcgagtagatgtgctactgacacacaagctaagtcgagtgcaccttgggatgcacaaaaagctcactagtggggtgacagaatttcagggactggctcctactgtgttaaagtactgtgggcgaatgtgcgcgatccaggattccacatatggaagttccatgcttgccaaggctgtgacaggttcctactcggcgcaagctattcagcaaaggatccagtaccagaggtgctgaagaatgaca

SEQ ID NO: 505508 - DNA, 249 bp, Homo sapiens
atagagaacagagtcccccattccccccacccctgctcacacacatacacacacagcataaaggccatgtgacgactgagcaagaaggcagccaactgcacgtcaggaagataggcctcaaaaaagaatttctcttcctcaagagtcaaaaagcacatttgaggttatttcagtttttaaattatttgtttgtttgtttttcatcaccatggtatttcatattatcttatatccaaggtggctgtaaac

SEQ ID NO: 505509 - DNA, 520 bp, Homo sapiens
cgagttggaggttacaccactgttgcccaggctggtcctgaactcctcagctcaaagcaatccacccacctcaagctcccaaagaactgggattacaggcgtgagctacgacacttggcctgaattttattcttttaaataagtatattttctttttgaactttggaagacctctaaaaagggataaaagtcataaacactgcttctgaagtctttttttttttttcccccctaagttcagagccaggccgtggctctgaacttagggcagaaaaaagagaaagatttaaagccgagcaagacaaaaagatagcagattgaccgagcaagaattggacccagaaaaaaaagcagctgcccaagaaagagaagggagagaggcagaaaagagggaaaagatgagggaggaagagaaaggggcagcagaggagaggcagaggataagggaggaagagaaaggggcagcaaaggaaaggcagaggataaaggaggaagagaaacgggccgcagaggacaggca

SEQ ID NO: 505510 - DNA, 347 bp, Homo sapiens
agttactagctcccaaagaaatctaggatacctctagtctggcacagtggctcacgtctgtcatcccagcggtggcagcccggggcgggccggtcacccgaggtctaaacaatattcttcatcttaaacatttaccttaatgtttaaattactgcttaaataaaactgggaacagtccatttgaccctcgaatgtgtactttaaaaagaaacatttacaattacctttaccaacggtagaactgacacaccttgagttactggctgaaacacatactggcataggtacttcaaccagaaacaggcagagcaagtggtccaatcaaaatcataaacaagatggttcaa

SEQ ID NO: 505511 - DNA, 233 bp, Homo sapiens
gcagcaggcaatattcttttcttccatgcctagtcaatctgagtagggtttcctcaatgagaaggggtaaatctgaaaatggctggtggtcggtaggggagctttttcttttctttccctttttttgtgttgggtttgtgtttttgtttttggtaacatgttaggagttaatgttgcaaagagtagtttacatctccactttctgaagacacttgaatttaggaccgatgtat

SEQ ID NO: 505512 - DNA, 509 bp, Homo sapiens
  misc_feature (125)..(125): n is a, c, g, or t
ggggagaaatgtcctaggcctccgccttttttcttttattcacccagagcaaagttgcaggtatgtgagcgcctttcatgattcgtgccctatcccgcggtgccatttttaaggatttatattgnatttttggtgggtatttcaaatacaggtgtctaacagattcagtgcattggccgggtcgacaggtttggtgccctggcccaatcgcgctgtttcaggtccgttatcctgcgtacagggcccttcaattaaaagttgtgtgagggtaaatccctgtcctcaccgataaaagtgtgcttagacgaatatctcatgtcgacgcctgggtgataaacccaatgaccgccttctgaggctccacttttacaaaaggtccctctcccttggaggtgggaagggaaatgttagtttttctttttctagaaaaaaccgggttaaatctttttataacggggttgattttttaacctatgggtcgaagtgggaacacacctttttaatctcta

SEQ ID NO: 505513 - DNA, 617 bp, Homo sapiens
  misc_feature (28)..(29): n is a, c, g, or t
  misc_feature (85)..(85): n is a, c, g, or t
  misc_feature (118)..(118): n is a, c, g, or t
  misc_feature (123)..(123): n is a, c, g, or t
caacggtgcaactttcttcggtcgtccnnaatccgggtcatccgacaccagccgcctccaccatgccgcccaagttcgaccccancgaggtcaaagtcgtgtacctgaggtgcaccgnaggcnaggtcgcgccacatccgccttggccccgaagatcggtcctctgggtctgtctccgaagaaagttggcgatgacattgccaaggctaccggtgactggaagggtctcagaattacagtgaaactgaccatccagaacagacaggcccagatcgaggtggtgccttctgcctcagccctgatcatcaaagccctcaaggagccaccgagagacaggaagaagcagaagaacattaaacacagtgggaacattacttttgatgagattgtcaacattgcccggcagatgagacaccggtctttggctagagaactttctggaactatcaaggagatcctgggtactgcacagtctgtgggctgcaatgtggatggccgccaccctcatgacatcatagatgacatcaacagtggtgcagtggagtgcccagctagttaagaagcaacaagaaaatattccaataaaagactatctgataaccagtgaaaaaaaaaaa

SEQ ID NO: 505514 - DNA, 102 bp, Homo sapiens
ctgccagtgtagagcgcgcgggcacagggtgccgctgaccgaggcgtgcacagactccagaattggaggcatgatgaagactctgctgctgtaatgtggggc

SEQ ID NO: 505515 - DNA, 293 bp, Homo sapiens
atgagtttactagtattttgttaaggatttttgcgtcagtattcatcagggacttatggcttgcagttttcttgtaatatatttgtctggcattggtatcagagtaatgctggcctgataaaatgagtttggaagtactccctccttttcagtttttttggaagattttgaaaaggattgacattaatttctttttaaatgtttggtggaattctgcagtgaagctatctgctcctgggcttttctttgttagaaggtttttgcttactgattcaatctccttgttagttata

SEQ ID NO: 505516 - DNA, 297 bp, Homo sapiens
ttcgacggtgttctgtactcaggagacccatatcacgtgcagagacacacataggctcaaataaagggatggagcaagatctaccaagcaaatgcaaagcaaaaaaaaaaaaaaaaaaaaaaagcagggttggaattcctactctctgataaaacaaattttaacccaacaaagttcaaaagagacaaggccattccatcatgtgggtacggggtatccatttcaaacaagaagagctaattatcctaaattttatatgccccctaatacagacaccccgtgtcaaagggttcacgg

SEQ ID NO: 505517 - DNA, 714 bp, Homo sapiens
tgacaaactgccctacaaagtcgccgaagtcggtctgggtgccttgggtgacgcaaggccctggacattgctgagaacgagatgccgggtcctgatgcgtatgcgggaggcggtactcggctccaagccattgaagggcgcccgtatcgctggatgcctgcgcatgaccgtggagacggccgtcctcattgagaccctcgtcagcctgggtgctgaggtgcagtggtccagctgcaagatcttctccacccaggaccatgcgtgcggctgctcattgccaaggctggccattccgagtgtatgcctggaaaggggcggaaaacggacgagggagtaccctgtggtgcattgagcgatgatccttgtagcgttcaagtgattgtggccccgtcgaaacatgaattctggacggacatggggggcgaaccctcaatccaaaactcatccacatccaaggtaccccgccagtcttcttgccaaggcatcctgaggcatctctgatgagaccactagtggagtccacaacctctacaagatgatggcccatgggatcctcaaggtgcctgccatcaagggtcaactgactccgtctgccaagagcaagtttgagcaacctctatgggctgccgggattccctcatagatggcatcaagcgggccacattcatgtgatgatttggccggcgacaggtaactggtgggtagccaggctat

SEQ ID NO: 505518 - DNA, 174 bp, Homo sapiens
ttgaaaagtgactaaaggaaatagcagtgagggagcagcacaaatgagacaggggacaaggaaaagccaacctaaaggtgcattatcagcagcagctataggcagtggggattcaattctaccttgacttctgagaagtgagaagatccttcttaaaactgtcccctaaaggat

SEQ ID NO: 505519 - DNA, 433 bp, Homo sapiens
gtggactggataaagaaaatgtggtacatataaatcatggagtattaggcagccataaaaagaacaaaatcatgtcctttgcagccagccacatggatgcagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagcaatatgtttctcaata

SEQ ID NO: 505520 - DNA, 149 bp, Homo sapiens
  misc_feature (97)..(97): n is a, c, g, or t
  misc_feature (109)..(109): n is a, c, g, or t
cggcacgagcacagaatgctggagagatgcgtcctggtgaacgtggggcagcccctcccacgacccccaccagactgccttaggttttttagccccnctcctttccttncccctctgcctccacccactctgggtcacataagatagct

SEQ ID NO: 505521 - DNA, 296 bp, Homo sapiens
cgtcgggtgacgatggcgcgcgtcgggactggaccgagtgctcatgggctaccagacctatccgctggccctcagcctcgtcttcgataacgtgcaaggtcatgacctcatgggcaggtgtcccccttgaccactttggggaggtgccaggttgcccggctagagccagctagggccgttcactccagtggcaggtgtttgtccccagtgctgagagcatagagaatctcatctcgctgttggctcgcccttgggaggccctgtgtggccgtgagctgcctgtcgggctcaccggc

SEQ ID NO: 505522 - DNA, 205 bp, Homo sapiens
tttcagctcatttcagttcataaagagaatggtatgtactagacttaatctagcaaactactactagaatagatgcagtgccgctcgcacttatacattatgataagatgcagcttagatatatctttaatgcttgctgagagacgaaaaaatagtttggccaacaaatgttagctctatgatgcccaggctcgtctggaactcc

SEQ ID NO: 505523 - DNA, 159 bp, Homo sapiens
tcccagtaccaaattgcaataaagcatgtgccatatagaatttgtgcatgaaagtgttttagtagcccagatatagattgtacccctggcaaactaagcaagatttctttttcattactcatcttgcaatagggtaccgcagctcgcaattcgtcaatc

SEQ ID NO: 505524 - DNA, 1084 bp, Homo sapiens
gcttcctgccgcccgccgctgccatgctgcccgccgcgctgctccgccgccctgggacttgtgcctgcctctgtcctgccactgccctgtgccttatgcctgaggcctgcctgcctgcccctggctgccgcctctgtgccccaaccatgatgtccttcaccttctgcctctcccactgcaggtgttcttcaacggtgccaactgtcctggcagtgtggactgtgcccactgctgacctggagccttcggcatccttgtgctggcccactgtgcccactgctgcatggtcctgcggcctggggctggtcgtggtgcatgcagaggacgtgcaccacctccaaatactttgtgagcagctggttccatcgcagtgaacgcctgactcttcggtgcagttgttggcctgaagaggccgtgacgctggacatgtaggacctgggtggcagccaaggcaaacttggatgaaggcccaggcggagcttgttggcgtgacagctgaccgaggccactgcgggcagagatccagatccgaatcgaggccaacgaggccctgcgttgaaggccctggagtaggcgagccaagctgcatggttgacctcagcttcgtgcagacacctctggcttgaactagcaccagccaccggacaccagttaaagaacccggaaagcctgaagacaacaaacacaacgggagctggccacgaaacgaagaagacaccgcagagggaacacaacgaacaacgggaaaccacgacatacatgtaccacaggtgggcacacaaaagtggtggtgcgcaaattaatctggattagagtatggtgtcttattattttctacaaggagcctagtgtagatttgtaaaaagattgactgactgtgacgacatatatgtggaagagaacccagaaatttactggtggtgtacacataacttgtgtaccaaactagccgctaaagcagattataaagaagtcaaagtagagataataaaattacaagtagtcaaagttgtagacaaaaagcgaggaatattggtcacgttctgaattatggtaacatatgctacatgagatagcaaataca

SEQ ID NO: 505525 - DNA, 447 bp, Homo sapiens
cgtttttgtcctattgtcgcgacgacagagttggccgagaccgggtccgcagaacgataattctcgaggggcgttccttttgccgctgtgttccttaccgccttctgttcttttctattgcgcgaatcagctcgctgcggtccgctcgcatattcttccccgcgccgctccgccatgcgtcatcattgttcttgtcgcccccgtatacgcgccgcttccctctttttgcgtcctggcttgcccgcagagtcctctctctcccctttgtttgcgacctggtatctggtgggcgacaactcccccttaggatacccgccttgtccaactcatgttggacacaacatcacactccgttgaatactacttcttccacctcccctacttatttctaattaaccaataatttcttcctgattaaaccaaaaatcaatgggcccccaaataaca

SEQ ID NO: 505526 - DNA, 564 bp, Homo sapiens
ggagagtgacgaaaatgatagaatctatgccttgaactttgtacccccagtttaatcatttgttgtttctgtttacatcttatgtactgactatgccttgaaaagtggttgtagttactatttttgattggttaatcatttactcttctacttagggtaggggtagtttacacaccatagttacagtgttataatattctgtgtttttctatgtatttactattaacagtgagttttgtaccttcaggtgattacttattattgattaatatcattttctttctgattgaagtacttcctttagcatttcttgcaggaaaggtctagtgttgatgaaatgcctcagctttggtttgtctgggaatgtctttgtttctccttcatgtttgaaggatattttcactggatatactattttatggtaaaagtttttggccttcagcacttgaaatatgtcatgcccctctctcctggcctgtaagctttccactgaaaagtctgctggcagatatattgcaggtccactgtatgttattcgtctcttttctcttgcttgttccgctg

SEQ ID NO: 505527 - DNA, 304 bp, Homo sapiens
atgagacattatcctacaaaacagagagtccttatgtagaccaatatgctatatgtctgagatctagcacattatagatgttatcttttgaatcagtgggagaaagattgactgtatgccaggcactgttccaagcactgggatctaacagtgaacatatttctacagtcagtatgtatatgtcaattgtctccaccctcagctctccctggaatcacctattccaccaatcttctgattactctctgaagagaataaatccctgatcttctttacagttattttcaggctttcagtattccac

SEQ ID NO: 505528 - DNA, 916 bp, Homo sapiens
cgcggtgactcacacctgtaatcccagcacttgggaggccgaggtgggcggatcgcctgaggtcgggaggtcgagaccagcctggccggcatggggaagccccgtctctactaaaagtacaaagttggctgggcgtggtggctcatgcctgtggtcccagctgcttgggaggctgaggcgggagagtcgcttgagcccaggaggcggaggttgtggtgggcggaggtcgtgccattgcactccagcctgggcaacaagagcaggactctgtctcaaaaaagaaaaaaagatataaatcacaataaataaataggttcaatacagttgtgggccaggctgtgtgtggacactgtgccactatagtgcgcagctactctggaggcagaggcaggaggatcacttgagcccatgaatttgaggcagcagtgagctatgatggtgccactgtactccagtctgggtgacagagtgagaccccatctctaaataaataggtcaacccttaacaatatttcaaattcttacaaaattgaaaagatgattcttctcaaatttagttgagcttctaagagcaagcattgggcttttccactttactaatcatttcagttcgacctcataccgtttacgccactggtgaattttctttcctcagcttaaccgagtttatagactgaccggctggaagtgaaccttgacgagtatcaggtctgtcatttacggtcaggcacgagaccaaggggatgtactgggcccaattgcgtattacagacccgatcggcatttcgcgggagctcccggacttggtaggcagtttgttcccatcccggcccgcccccttcgctactattgccactattcaccctggcgcgacgagcgtaaccaaaactgggctctacacaattacgttatctct

SEQ ID NO: 505529 - DNA, 368 bp, Homo sapiens
tatttgtccacagaggccgggcagcgtgggtcggccctgggggacctggccccttttcggcccccgggtttcagtccctgccctgcaggggatctttttccgggacatcggtacgatggtgggctggactcaggcttccacagggttgatagtggcagcaagaggtggtctggaaatgggtccacaggtgaattttcggggctgtcattccggatctcaggggctggcccgggggccccgggggccccggggacgcaaggggggtggctcagcgggcgggggccctgtgcggattgacttcttcgaccgccttgtccccggggggggtggggggcggggccctgtgggggggcggcggccccctttta

SEQ ID NO: 505530 - DNA, 164 bp, Homo sapiens
gtccgcgcctgttgatctattgcgtcttgcgtctgtgggctgatatgacaagacagtctcagagtttggcttcctggcatttatgactgacgtgacccgtcatcccggcatgtgtctcggacttatgcactgggattttgtctatctttcagtgcatcccttta

SEQ ID NO: 505531 - DNA, 300 bp, Homo sapiens
  misc_feature (13)..(13): n is a, c, g, or t
  misc_feature (186)..(186): n is a, c, g, or t
  misc_feature (236)..(236): n is a, c, g, or t
  misc_feature (241)..(241): n is a, c, g, or t
tgttttcaccggnttttttgactaaaatagctattgcaacagaggctactcttgggttaaggaagaatgtagtttcgttttatgtttaatatcgctcaaagaaaaataaaagcatctccctctaacaccaccagacttttcctctctgtaccttatcatgtaaattttgctatttgattttcaccngggttgtttcctttaatgtgcaaaaatttaaggctatttagctgacaacngcctngggttgtaaaacaggttatcaaggatctgaaagtctaagttagggaaaaaaagtggggg

SEQ ID NO: 505532 - DNA, 210 bp, Homo sapiens
tatggtacaggatctagaatgtgcttcaggtgtgtgctcggagggagtgcggtgggttgggttgcattcttatggtagatttgctaaagaacaggtggtctaaaaaaggcctggatgcttggccagagcgtaggagctctgttgtgtacacaggcgtggctaaggatggtgggtaactaaagacttcgagttctgcattcactcaccagc

SEQ ID NO: 505533 - DNA, 126 bp, Homo sapiens
cacgaggggaaaaactggactgaactatggtttgtactaaaacccaacataatttcttactatgtgagtgaggatctgaacgataaagaaaggacacattctcttggttgacaattgctgtgtcaa

SEQ ID NO: 505534 - DNA, 355 bp, Homo sapiens
atctccgtacccacgatggagatgaaacatgaacaatatagaagcccatatattgcaggattcttatcaagcgggtatacaactaatcgattatggtttaaatgcattgagtgggtgtattcaggtggttgaccggaaccagtacactcaaagtttgactagatattgcaaggattaaaatttcccaatactgacaaggattctagttcatcagatacattctcattgttttcctcaaatagaggtgaatgaagtgaccttttattgacagtgattagcagtaataaggctattgtatgtaactggcatccccaagaattctttcctcactaccattcagtgtcatagggaggat

SEQ ID NO: 505535 - DNA, 310 bp, Homo sapiens
tgaaaaagtattaaaggagactcaaaccacgtgacaagttactgcggcataagtagtagtttttttgtttgtttgttttgagatggagtctcgctctgtcacccaggctggagtgcagtggcgcaatctcggctcacggcaacctccgcctcccgggttcacgccattctcctgcctcagcctcccatgtaactgggacttcaggcgcccaccaccatgcccggcaaatttttggtatttttagtagagatggggtttcaccatgttggccaggctgatctctgactcctgacctcaggtgatcctcccg

SEQ ID NO: 505536 - DNA, 116 bp, Homo sapiens
cccccgggagcggaagcgaagcatgcgtccctgctgagaagatgtactgaacaccgatggcgggctgggtggcctggcaggagggatctcaggcaaatggaagcacgtgaaaaggg

SEQ ID NO: 505537 - DNA, 236 bp, Homo sapiens
gtcggttcctgctattccggcgcctccactccgtcccccgcgggtctgctctgtgtgccgagggacggcagttgtcccagatatgccgttcggtacaatagcggggcactctgacgagcttttctctagcttgtgtcactaacggacctgtctatcatgagctagcattactcggcttctgcacgcaaacggataatgacagcaagaagttcaaaggtgacagccgaacgtgcagc

SEQ ID NO: 505538 - DNA, 860 bp, Homo sapiens
caagatctaaaccgagaatcgaaactaagctggggtcatggagcctgcacccgcccggatctccgaggccccagcatgtgacgccctgttctggccctagttgattgttcgctatgcttcgccaagtagagttgtcccgacgctgcattccttgagtccataagtacgagcagaaatatatacgggcaccaagtaatagttgacatattacaatcagagtctagcgactgctagacacttaccatccaaatcgtcaggacagtacaatggaacacagacgcaatggaccctaatagccatatgccatgcatgaaaactaacaatgcgacaatgtcacctcacgccatcgaacgacacacagaacgagagaaactatatccctgaatccctggccctcgtatatgaaccatttctcaatgggggcttccccggaaaggtactatggtagagcacatacgagtaacgtaaaccaacagcctgtaagcgtaagcgggcaccaatgatatatcacacagcatcaggccagcaacggacgctgatacgcaacatgtgagtagctacacatcgtatcgagcacaagaccagaagcaatacgagagcacgtcacactttacagcgtacatatggaatggaaccgtcccgagtcgaaaagtcgcgaccatatggaataagcgcaatttctccgagatcatatattactgcccgagaatagtacacccacgattcacgattacaaaaatcggggttggagctgtacgcaatcaccagcgataggatacaaaagacgacactacggaacataatattcaccagatgcacaccatatcagagagcgcagacaaacgtataccacgattagc

SEQ ID NO: 505539 - DNA, 256 bp, Homo sapiens
ctaaagcgacgtcgcttcacctagctaggtggacggtggggactcaaggacttggctggcggttttcctatgtcatttctgcttcagctcttggctggcttcacttcttggtaaagttaagtggtaaccggagggtaattagctggcttcattattttggtattacaaccgatatgttcattagaattcttggcatttaaggtggatactgtaagggtgtttcgttccctttaaatgaatcaacgctgccacctag

SEQ ID NO: 505540 - DNA, 302 bp, Homo sapiens
  misc_feature (5)..(5): n is a, c, g, or t
cttantgtatgctgatcatctgccagaggtgcttcaccctgagttttgtcttgtattgtattctgacagtttttctgttttgttggccaggaaaggggagaagggaatcctcctccaggtgattttatgatcagtgttgttgctctaggaagacatttttccgtttgcttttgttccactgtccctgtgaacgtccacctgaaacctacacacctgtcatgcttccactcattctttctcatctcgggcagacggttgacccacgttgtacgggttccagagacctatgtaagcattccgaa

SEQ ID NO: 505541 - DNA, 889 bp, Homo sapiens
cctgccagcatacctgatttattagtttctattagtttttcaaaagtatcagaaataacagattgttgggagaagatacttctgccttttgaaaccaattatttaatatttgcattaaattggttgaatacaatcttaggcatatgccatactagaagaccaagcccataaattcataggaaataatcttccatacaaggaacaccaaggtgatctgcttcgattccatttacaatactggtgatcataatggtgcttttcagttatctattctgtcgtgtgcttacgacattattctatcttcgcaatgcttttttatatctattgttgctagagtttctgtcgctgtctgataccctcgtatggctgcgtacaccctgttcatcggtgactgtctttacttattcgctcttatgcgacattattggcgtttttattttctcattttgtgtttctattttctgctgacgttacggcttagtgtcgtcgtagctacgggcatgatgcaggcttctttttatatggcgtcgggtacagaggatgagaccctgctgagcaatcttctatattcatcgaactgcttttttgatttcgttcgctatctttagttcgttgttgattttgtttcgagctcgcgctgctcttcttctattttgtgtagcccgtttatttgtcggcataagtaatcgtatttcttggtcttgacacgctgttattttccgttacgtttgtttgcttgttcgcgattttccgcctggcggtccccttttttgtttattgtcgttttcctgcgctgtgtttcttttatttattgtactccgcccgtggtttcgttgttttctttttgcgatcttgtctattgccggcgtttctcgcgtgtgctaatttt

SEQ ID NO: 505542 - DNA, 217 bp, Homo sapiens
tgcaggctgattcaggaaagtgatagtctctctaagcctcacattctttactacaacagcaaggcggcctgcccagcagtgttgcttttaacggtcccagagagaaactcctggacaacctactagccagacaactgatagatagaacagacactgcggctacaggccacagtcagcagatcctgacagagagacggtccatatacatcacctatct

SEQ ID NO: 505543 - DNA, 141 bp, Homo sapiens
gtgactgtgtggccacaagtgccgccacgggcccagtgcgtgacacaatcaatggctacacatgcacctgccccaggtctgcagtaggaccatgggtggggggtgtcacagaagggtccactgaagccctgggggcaggtg

SEQ ID NO: 505544 - DNA, 126 bp, Homo sapiens
  misc_feature (16)..(16): n is a, c, g, or t
cacgtatcgggaaaantaaccacgggttggcagttcacccacgctgagcgagacccactgcggggagaatgggtacagtcggcgggaaatcagggcaggcacataggcggtgacaagcccggtatg

SEQ ID NO: 505545 - DNA, 108 bp, Homo sapiens
atagacccatactcacatcaacgatcgccatgtaggaggcagagcggatccctgtgtaaatagacacttagaggagatttggaagctggtgtggagcttaggagtaac

SEQ ID NO: 505546 - DNA, 295 bp, Homo sapiens
ccccctccctgtcccccgcctcctcccttgacgtttgattgctgcctggcgggaccgactggcccggcggggtggccccgccccgccctgcccttccctgggccaatcccccccgactaggggccgactcttttctggactgacttcgagacatttccgatcgggcatttttctggagggggcgaacggcgcccctgccccccctgtttagaccccctgggttagccgggcagccccagcctaggcctttactccccctgcctgcttaggggcaataaaccagaaccaaagtcga

SEQ ID NO: 505547 - DNA, 1047 bp, Homo sapiens
ggtttcaccttatgaagtatagcaggctctgatgctggtgtctggtagaaggaaggttattcacgagttctgttgcttagctcagaaagtggcgcttacaacctctccattagacatgatgacgtagatgcatgttcctgggcaccccatactggtgtgctgcctcacttgggcctggagacagggaatggtggagtgggttatcttagcctcaatgcctttgagacacacagtcagtcgaagacgatgacgcagttcctagagacacggtgagcagtgccaccctctcatatggcagcgaatgatgccctggacgtgcccaggattgcgccatgtgctactcacggatcggaggtaagccttcctgggcgtccagtcacatgactcagataaggtaggtgttgtgtggggcatgaatttcatggtggcacgcacgtgcaaagaaacagaatcgtgcccagtggccaaggagaacctatcagtcgtggcaggcaaagatatcgctgcagctccaatcgtggcgggcctagtgatgacgtggatccgtgccatcagagagccaggaggatagcattcgggcacacgtggacgctagcgaccgtagagtacatcaggaaaaaggaacaaggcacacgcaccatcaaagaatccgacaccacgtctacaggactctggcttgccgacgattgaactggggacaacgtgcatcccagcaccaggcaaacacacaaccagatgggtattcaaagacaaagaaagagacccatgaattacgagcatttggagattcatacccacaggcgaagttgaaccagggggactaggtaccttgcgacacgccaccgctttcaacacgtgaccagcaaaaatggtggagccagtgacgccagaggcccatcacatacgttacaggacatgtgagccacccatcagcactgatcgccgtgagtcctaccccgagaacctatctagcatatgaatcacagggattatggtacccgttaaacaccaaaggagaatgtttatccgtaacatggggaacccccc

SEQ ID NO: 505548 - DNA, 766 bp, Homo sapiens
tcaacccctataaaccctcctcctcacatttatcgaatataaagagttacatgctgccagcgcctttacatgaccttggacagcgcggcggtgggtgaaagaagacagcttctatgccaacgttcaagacggctttaatggagacacgcccctgatctgtgcttgcaggcgagggcatcgcgagaatccgtttccttccttttaagaagaaatgctaatgtcaacctcagaaaccagaaagagagaacctgcttgcattatgctgtgaagaacccatgcaccttcattgatcatctactacttctcctcttattttttgttctgctccttggctattccctcatggcgtcaaataccaatcacaccgaggctattgtaccactcgctcttgacgctggcgcgctagtcgacgccacagaccacctcggctgcacctcatcccctcctacccagccagatgagtaaccacgtctctcaccgcccccgccctgggaaaccctactcccacccatcatattacaattccgcggtcgagaggtacccggcatccgcccggctacgtaatattcgcacacccacccttttcgttggtagcacagcgcccccccgtgccccaccgctaccgcgatcattccacgcacgtgaccgggatgctatcttcccttatacctcctccgcgcggcttagcctttctgtagctcccccgtcccactcgcacactccgctgcaccgcccccagggtgcagagaccctgaccagtcaccct

SEQ ID NO: 505549 - DNA, 380 bp, Homo sapiens
cccttgagtgcatgagaggagatggtctgcagatgggagggtatcttgattctgatttcctttaatgcaaggtgagagtaggttcttaagtggagattctgctgttgctgctgctgtattctgacaggctcgtgtccagcaagagggtagggaagctagaagcacactcctggagagtgacttaccacattttagttttgagcactgagcctatgggacagtgttttgttacactgccgggtttccaatgcagaggcttggtgaggtgtctgtctgcaaactgcatgcactgcgttcacccacgtacagctgggatgagaactgtcagtgtggaagggcctactgttaaagccctgagtgagctaggtaggtgactgttg

SEQ ID NO: 505550 - DNA, 199 bp, Homo sapiens
ccggcctgatgtagacttcgggtagtccgagtacgtgcgaggcatccggataggccgagaaagtgtgtgggaagaaagtagatttacgccgataatatatagtgaaatggattttggcgtagtatggtctagggtgtagctgataataggggaaatcagtgaatgaatgctcctatgatgggcaatactgctcctattg

SEQ ID NO: 505551 - DNA, 254 bp, Homo sapiens
  misc_feature (73)..(73): n is a, c, g, or t
  misc_feature (116)..(116): n is a, c, g, or t
  misc_feature (146)..(146): n is a, c, g, or t
  misc_feature (163)..(163): n is a, c, g, or t
  misc_feature (193)..(193): n is a, c, g, or t
  misc_feature (244)..(244): n is a, c, g, or t
catgacgttacacagccctgctggcttcttagatgagtgcaatcgcgaagagaattctcatcgcgattgcacncatcaaagaagccagcagggctgtgggatacgtcatgtgctcnttgctctacccactggtcaccttcttcttnctgtgcctctgcatcgnctactggggcagcactgctgtgcttcctgnccactttccaacgaagcggtctataagatcttttgatgacagcccctgccnatttaactgc

SEQ ID NO: 505552 - DNA, 733 bp, Homo sapiens
ggtgtacgaggaggccccaacgtctggatcaatgttcatgacatcttctatcccttcccccaatcagagggagaggacgagctcatgctttctccgcgccaatgaatgcaagaccggcttctgccattatgtacaaagtcacctgccgttataaaatcaccagtggctactgatatggagtgagcccttcagcccctggggaagatgaatttaagtgccccattaaaggagagagcattgctcatgacacagctggttgaattgggatgtgttatatggctgaggctccggctccaagatcttgggtcaatgcaggagaccaagctggtgtacttccagggcaccaaggacacgccgcatggaagcacacaactactacgtggtcagctatgaggcggccggctgagatcagtacgcctcaccacgacccggcttctcccatagctgctccatgagccagaacttcgacatgtacagacagccacatacagcagcgtgagcaacgccaggcctgcgtgcacagtctacaagctgagcggcccgaagacagacaccactgcacaagcagcccgcttcttgggactagacatgatggaggcagcagatggcccccggataatgttcctccagagatcttccattaccaaagcgctcggatgtgcggtctacgggatgatctaaagcccaagcttgaaacaaggagagaaccacgactcttgaatggggcccatgg

SEQ ID NO: 505553 - DNA, 792 bp, Homo sapiens
gggtgtcggtgggtggcttgtgcctattgtcccagactatttgggaggctgatactgtagaattgcttaagcctagaatagtggaggctgcggccggagtgcgatgtggctcacaccttgtaactcccaacactttgatgaggctgaatgtcggtgggatcacctgaggtcaggagttcgtagaccacgccttgccaaatcgtggtgagatacccccaatctcttacgtaagaaatataaacaagattaccttgagtgtcagtgggtgcgccacctgtaatcccacgtgtacttgtggaacgctgaggctaacgatgaatcacttgcatacgccagtgcaggaggagacgcgttcgcacgtgagcctacggtatcgctagcactgcactccagcctgggcaacagagcaaggagtccgtactctacaaaagaaatcacaaatacacaagaaaaagaaatccagggtctgcatttcccgggtccggcgcccagatgaccgtgcttggaagaggggcttccgcgggcgaagggtccgttgccgccgcgtactccagtcttctgtgcttccaagatgggtgccgcgaatcgaacggggggggacctcccacctaaatcaggggaggcccggcgagtacacattggggccacatgagccacgggctggtagccttcgtcctcaaagagggggcaggaacgaacacgcacgcgggacactaaagagcaacacacccctgggaagcagccgggtgggaaagggcggggagtcccttccagacggacgaaagcttcctg

SEQ ID NO: 505554 - DNA, 339 bp, Homo sapiens
ccggggcattaagagctggggccaggcagttgaagtcacagagtttcagagaatgtttgaaggcccagtcttctctcccagccttagttagatgccaaagctttgtcctttatccagcctcatagtatagctatggatcttaagagcaccagatccagagggggttgggtttgctgaccttcatcatgcattcattcatacagcaaatatttactgagtgctttcatttgccagggactgcgttaggccctggggaaacatcagtgaataaaacacggtccctgcccacagtgcttagggcctactgagggaaagaagtaaccaggctcgagtagctct

SEQ ID NO: 505555 - DNA, 206 bp, Homo sapiens
ggcagactccatccagagaccatcagccagatgtcagaagctacaccatcacaggtttacaaccaggcactgactacaggatctacctccacatgtcttggggaccggaaaagggaggaattcaaggtgtaaccctcatgaaggcaccggtgttatgatgatgggaagaccatcccacggtgggagcccaggtgcaagagggaatt

SEQ ID NO: 505556 - DNA, 1043 bp, Homo sapiens
  misc_feature (202)..(202): n is a, c, g, or t
  misc_feature (233)..(233): n is a, c, g, or t
  misc_feature (255)..(255): n is a, c, g, or t
  misc_feature (257)..(257): n is a, c, g, or t
  misc_feature (260)..(260): n is a, c, g, or t
  misc_feature (303)..(303): n is a, c, g, or t
  misc_feature (339)..(339): n is a, c, g, or t
  misc_feature (460)..(460): n is a, c, g, or t
  misc_feature (521)..(521): n is a, c, g, or t
  misc_feature (544)..(544): n is a, c, g, or t
  misc_feature (636)..(636): n is a, c, g, or t
  misc_feature (661)..(661): n is a, c, g, or t
  misc_feature (705)..(705): n is a, c, g, or t
  misc_feature (832)..(832): n is a, c, g, or t
  misc_feature (883)..(883): n is a, c, g, or t
  misc_feature (896)..(896): n is a, c, g, or t
  misc_feature (957)..(957): n is a, c, g, or t
  misc_feature (984)..(984): n is a, c, g, or t
gcccagcggcgccgccctctgttcggcgcaggccacactcgcagtgtacattacgcgcaatcattctatctggctcgcgtcagttcctcgcacctcacaagacctcctaccaagtggatggagagaggagaagcaacgaacaaggtccttataaatgatagtaaaacattaaaaggtatcgtagagtgcgctatcgagcaanatagaagtagatgctcgagagaacatatcgngccttgtgagtaattccttgangngtntagatttctttgaccatagggtcgactgagtgacatagtacanggcagaatgcaggacgaagaatatggaacggctacncacgtccttctctctcctcttttacatacatcgggcgcaccccctcctcaatctaacacgcacacacacacgaaaggtaacaactgatacaagctgacaacgagtgcgttcagattggtangttgagaaccctcctcctccaatcctagcaccagagacgaccccgacacaaccgcaccccntccactcccgtcgccgtgacccnacggtctgttctcttttcgctgtcgagttgtgatctgttgatgttctccttgttcctcatccctgtcagcccttcacgccccatgctccgcncctctgtcatacactcctactcatntcctctcctaacctccgtccttctaacgccatgcttatcatccnacgcgcaggtctaacgatacgatcgatcaagtattcgatgctaccaccacaccgtcacacgacctaatcctcgccacacacatcatttaatcatagacagtacaccactacgtctttacttcaactncaaggctgagacgcgtagatccagacgctagcgtctgtatgttaatcattntacctatactgcnacatactaatacaaacaccctagtgtcgatgaatgacatgacatgatataacgcatgcaancactaccacatactgagaccatcgccnacgtctcgtccatatctaccacgcgactagaatcaacgccagtccgctatatagcgagt

SEQ ID NO: 505557 - DNA, 208 bp, Homo sapiens
atccagcagcccctggtagacctttgggtcctccacaatcctgctgagtctcagcttcggctcactgagcaaatctgagatgaggtcatttcggtctctcaggactttcagcctcgcctgattcctcatgggggacatcaggatttttcttctgctgccctttgtcatgctggctctctagctggtgccctttttcctgtctacttcc

SEQ ID NO: 505558 - DNA, 152 bp, Homo sapiens
cctggccgcttatcagtggttgtgtcgttgtgtgcgtgcgttgtgagttgtgtgtgagatgtgtgttgtgtgcatgagttgtgtgcatgcgctgtatgtgagttgtgtgcattgcacgtgtgagttgcgttgtgtgcatggagtgttatgtg

SEQ ID NO: 505559 - DNA, 1151 bp, Homo sapiens
gcacgtccagcaaggctgtcctcatctggcctgggcgcaactcggggagccggaactgcgggacagccgggatgaacttgctgtgccagtcatgatggcaggtgcgtgaacgtgccgtctgtgactagttagcctgccccccgtgcagacggcctggagcagtagatcagtaggcgagcaggtcagtgtagtgcccggatcgcacccctgaggggcctccccgtggaaattccagtacgaaggaggatgaactgagcctctgagctgcatggccgttggtcgtccaccccgagcctgcgggtgacggtgcctcggaggcgggcacgtccctcgtaccagccacggcagagcccgctgcaagagaccccgcgcgagagatcgtggatggcgggcgtcccgccaagcgacagctggcgggctctgactcggacctggacagcgatgatgagtttgtcccctacgaacatgtcgggggacagagagctgaagagcagcaaggctcctgcctacgtccgggactgcgtggaagccctgaccacgtctgaggacatagagcggctgggaggcagccctgcgggcccttgagggcctggtctacaggagccccacagtcactcgggaggtgagcagtggagctggccaaggtgcttctgcatctggagggagaagactgtgtggcagggaatatcaggcagggcatgcgacaccgagaggccactgcgtaggccgacaacgggcacagaacccgggcaccggtgggcgactaacgtggacccacaagagcaaccccacagagaacagctcggccacccatggacacccctggatggcagaccacgagatgccccaggaacaagtaaggcaaggagtggaacaagaaggaaacccaaacacgggaccacaagtccaaacagccggtgcctgcaggagaacgcgataacacaagaacgaccaggaaaagaagagaagaggaaaagaaagaaaacagacgacgcacaacgccgcccacacagacagagaaccaccacaaacagcggagaaaacacagacacaaacgacaagaagcaaaaaaaaacgacggcacaacaggacagagaaacaaagaacaacagcaagaagagacacgacacgggggctcacggcaaacaccg

SEQ ID NO: 505560 - DNA, 149 bp, Homo sapiens
gaccggacgagggcaagatcccttctagtggaggctaaaaactttgggagtcatctttgataggtgtatatctcacattgagctccatcaacaaattttggcacgcacttaccttcaaaatgtatccaccatctgatcgtctgtaaacc

SEQ ID NO: 505561 - DNA, 414 bp, Homo sapiens
tctgagcccgcccttttacctccaccatccaaagtcgcaatccaggcactcttctgagaaggagccagctccagcacgctggagctgagcccacccccacggacagtgaccctgcttacagttccaaggtgacttggatggggtcagtgccaactttagcccatggctggaggctgagaaggctgtcgagtgtctccttcacgctgccctgccctgcacaggtcctgctgctctcttccccggggctggaggaactgtatcgttgctgcatgctcttcgtggatgacatggccgagccgagggagacgccagaacatcctctgacgcacattaaggtcagagctggcgtccaggaggcaagatgcagtcactaacggtgttcagccctgtcaggaccacttataacaccaggag

SEQ ID NO: 505562 - DNA, 124 bp, Homo sapiens
ggaccttacgcgctcagctcactatatttttactttattaactatattctgtatcagccatctgaattgacccacacagttcccgctcatcctctggcatccttatgcgcgtaagggccagcag

SEQ ID NO: 505563 - DNA, 376 bp, Homo sapiens
ctcatacaatcatagatgggatccctaatatgataccacaggcagctaggatgacacgtgaaagtgagaagcacgaggaagtggagcagagctatggtataatttaaaaaaattaaaaaaacgcaacaggcaacttttcttaataccatataccttttcacagtggcaggtaataagtggaagagaagaatgtgttctgtgtcttcctacgttgactgtgcttaatccactgggttctttagcaggactgtgctacttaacctctgtggaaggtcttggctattaccataccagtgtatggattctttcacctttggacttggatgggtattctcttcaggcataattgatgcaactagagtctatgctgtatatt

SEQ ID NO: 505564 - DNA, 305 bp, Homo sapiens
caggagtacgacgagggcggcccttcgtcgtccaccggcaagtgcttctagacacactccacctctagcacgagtacttctcaggtacgatgcattcttctcaatgggggggcggttgagctccagccaccccgcagtcactggctgtgtaacaacttcctttgctgccatcgtaaactgacacagtttttataacgggtgcatgcattaacttatggcctcatggggttatttttcgatttattgccctgtttaagaaaatggtaaacttgaagaagcatgaaagtcattctgttaaaatgcga

SEQ ID NO: 505565 - DNA, 312 bp, Homo sapiens
agcacaacctagggtcagtctgcaggttaaagccatttaccaagatagttgtaggtaaagaagggcagatttattagagaaatgtgaaaatatgttgcagtgggcagctcagactagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 505566 - DNA, 197 bp, Homo sapiens
tcaggatagcggagcatcagataagacggaaatcagataacgcggacgcggtcacgcctgctgcgagggtatgttgttgtttgcgaacgaacgaggaggcgagtgaggtggtgctcccttactgatgctccgattagctgaccgctcctacgtatgcttccgacttaactggggtaccgacgctcgaaacttcgtaa

SEQ ID NO: 505567 - DNA, 439 bp, Homo sapiens
ggcacgaggaaagacagcattccagcctttccaggcaatactcgtgtgtgtgtgtgtgtgtgtgtgtgagagagagagagacacacaccaccaccccacccacaccccctccccccccccacccccccccccacccacaccccacaccccccccaccccacccacccccccccccccccccccccccccaccccccccccccccccccacccccccaccccaccccccccacccaccccccccccaccccccaccccccctccccccccccccccccccccccccccccccacccccccccccccacccccccccccccccccccccccccccccccccccccccccccccccaccacccccccccccccacccccccccccccccccccccccccccccccccccccccccccccccccccacccccccccacccccc

SEQ ID NO: 505568 - DNA, 340 bp, Homo sapiens
gatccggagtactacctagctaccttagcctacctacctaactaccgaggtacctacctaattacggtagtacatacttcccaattacactaattacctacctaacgtgatgaccctaccttacctaagctacctcacctacctaagctcacggggaagtaacctaacctaacctaacctaagctaacctaaccggtagtaacctatcctaagccacctgaggtgtatactacttggggatccgtgcacgttaacgattactaggactatgcagaaaccagagagtttaagaaacccgcattgttcttcaagttattcatagcaaatacatttcgctcca

SEQ ID NO: 505569 - DNA, 156 bp, Homo sapiens
tgactctagagtgatccccctcacatgaccctgagaccttgtcagaaacaaaaacaaacaaaaaaaaatggaataaagaaagaaaaaggagagagggagggaaggagggagatgagggaaggaaggaaggaaggaagcaagggcagaagcatgaag

SEQ ID NO: 505570 - DNA, 825 bp, Homo sapiens
gggcagcgccggcagccaagagatggtgtttcactatgtagcccaggctgcacatccttcagatcccaggttagactcccttcttccaggatacgtaccccagctcctctctgcccctgtcagacggcagtctcgcctctgtcgacccaggctggagcgcagttgacgccatctcgcgctcactgcaacctcttccgtcccaggttcaagccagttctccaacctcagcctccccagtagctgggcattaccaggattttcagacacttcctgacatgtcattacttctaggacgcaacctatctgacactatccgcaccctggtcctgggactctagctcgatgacccttcggacacatgatcccacccaccactactctatcttatagcacgaaggccctgcactattagctcccaatttggacgctgaacacagccccggactggcgtacccggacaatctccccacacgcacttgcacccgggccttcccacaactggcatgtgtgcacttttttatggacgtgaacttggggccacaataccttttatcatgggggtggaagtacccccttgatacgcaacgggccttcgggccccagccactgccctggcccacatctgcttacccaaaccccatgtggaagctcccggctgcaaccacctaaacttctcgtacttgcaccctttggcacaccttctccggcagcatgccctccaaccactttgtacacccccgtacggaacactcaaatattccatcgtggaaaccaccctggaccaccacgtgtatacttccacaatccccctctccgaccgcaatg

SEQ ID NO: 505571 - DNA, 1190 bp, Homo sapiens
gcggctgttttcctgcgcaggatccgacaggggcgtaccgcagccatggcgcccatccggtagatgtgcatggtcttgaagccccacttccacaaggactggctatgcggcgcgtggcctactgtggttcaaccagccggcccgtaagatccgctagacgtaagtgcccggcatagccaacggcagcgccagccatcgccccgcgccccgcagtcggagtccgcagtccggcgccaatcgtgcgcgtgccccatcgtgttcgggtactcacatcgtaagcgtgcgctgcacggccgtcgtgattctagccctgtcaggatgtctcacgggttggcacggcatttcactaagcaaggtggccctgcgacctatcgcgtcatttcctgtgtgatccgaggcaggcggtcacaaggtccacggcagatccctgcagtgccaactgtgcatgctggctgaacggagtacctgctcctgaactcatctctcttctcccagtgaagccctcgtgccccctaagcaagggagaccagttctgactgaagaacgtgataactgtgccactcgcaggctgacctggaccgggtcatgcccgtccgcgaacgtctatacagaaggagacaagcctcgagtcactcactgcaggcaagcagcacacgaactctcacacgccttcgctagctctccgtatggcacgtgccaacgcccggctcttcggcattacgggcaagagagccaaggatcgccgcatgaacacgctcttgccctgcctcccgtacatggcctccttggcgacttggatccggacgcctccgcccccgccgcccgggcccctttcccgtcgggccacacgcgctctctcccgcccttgcctcctcgcctcgccctctcctgtacaccgtgtaaaattccagtcccccaaaacacgtaaataatttatacccgtaccgtctatatcatccataaatcacacttcataaccccacacaatccacgcacaaaccacgcccacacccgacaacaccaccaccagccccccacccccacgatgaccacataaacactcacaacgcatacacagcacaaccacaacataaccccccactcaccacatccacaacaccacctacctcaccctttacactctcctccttcagtccctcacaccaccaccacacacaccacccacccgc

SEQ ID NO: 505572 - DNA, 137 bp, Homo sapiens
ggcagggctctcaagcaaataactctacacacacatacacacacacacacacaaacggcgctttttagtttataaaatattttagtggaaatgtctgattcaaatggtctaaatcatgttcctgaactaatattcca

SEQ ID NO: 505573 - DNA, 456 bp, Homo sapiens
  misc_feature (349)..(349): n is a, c, g, or t
  misc_feature (423)..(423): n is a, c, g, or t
attccattgcattccattcgattgccatcgagttgattccattccattccattccataccattccattccattccattctttccattccattacggatgactccattccattgcattccattccattccattcccctgtactcgggttgattatattccattccattccactccattcggttccgttgcattccattctattgcattccattctattcgggttaattccatgccgttctattccattccattccattccattccattgcaatggagttgattccattccgttccattccattccggattattccattccattgcattccattccattccattcccctgnactcgtgttgattccattccgttccattccattccattccattccattacaatcgagttgattccattccattnctttccattccattccattgccttgattccact

SEQ ID NO: 505574 - DNA, 247 bp, Homo sapiens
  misc_feature (142)..(142): n is a, c, g, or t
  misc_feature (171)..(171): n is a, c, g, or t
  misc_feature (174)..(174): n is a, c, g, or t
  misc_feature (186)..(186): n is a, c, g, or t
  misc_feature (212)..(212): n is a, c, g, or t
  misc_feature (223)..(224): n is a, c, g, or t
  misc_feature (227)..(227): n is a, c, g, or t
  misc_feature (231)..(231): n is a, c, g, or t
cgggggttttccctttttttccccccccgggggcattggagggggaacagcctttccgtgggggttttccaacccaacccttgttttcggggggggggtttggggggttgctttaaagttttttaaaatggaaaaggtgggncttggttttttatgttaacttagaaaaanggnctttttggggcnggggcccaaaattaaggttggtacgnccctgggtttnnatnaacntggccctggtttttga

SEQ ID NO: 505575 - DNA, 238 bp, Homo sapiens
  misc_feature (1)..(1): n is a, c, g, or t
nccgactctagagtatcctcgcgccaactgtgaaaatgaaaaaatagtagatgggaagaaatgaaggagggttggtagacttcttggatttttcaggatgggaccgtagagcaattcagctgcaaatgtgtgctcttatttaagacaaggaaggaccctaaaagcaattcagagatcatccgggatgcttccttggttcaacaaaagaagggaccactgccttgctttcaatttggcg

SEQ ID NO: 505576 - DNA, 539 bp, Homo sapiens
gtatactgttaccagttagctagtgttccaggagagtcctggactgttttgttacggtgaagaagagttggtggggggcgcggtggatggtcccggtttcgggaaggatggaatgcgacaaggtggtggtgttacgagcctgtgtgggtttccgagtgtagcgagcgggctgttgctccgggtcctgtgctgacctttgagaagtgtttgtcgtggggtatatgacggttggaggaggtggagtgtagggggttgccgctgttgcagtggcgtgatattctgacggagggctgtgagcgagttttgacggagtgtctgttccttgccatagagtgtataaagggtgtggggaaacacagtgcgtagggcgggggatcgtgtgtctgctttttgttgctgaaactttgatctagtcttgtgaaggtcggtggggcgatgaggtttctcccgggcctgggtctagctctgtgccccccgtttgccagcgctgggaccctcgcccttctccttcctatactgctataaatggagaatgaata

SEQ ID NO: 505577 - DNA, 1071 bp, Homo sapiens
  misc_feature (149)..(149): n is a, c, g, or t
gactcgcatcggcatgcccgtgtgtgatgatcctccgtaccagtagacttcgaaggctagagatgtgcagatatcccaaggacaagactcaccgaaaatacgtactcctattgatggacgcgcctacgctcatatgtgctcgttcgctncccgcatgctcgctatctcttacgaagtatcacaatgctccactgtgactattgtgtgctaattgcagaggtctccgactcgagaaagactggcgattcaggctaggaccgggtccccgttcactgtgcgcacgtgcatgcgagagtgggacgtaacctcattcaatccagagtcgtcctggaaacagcctctgagtagcacaagcgcgaaggtgaacatgggctagaggacgcgatgcgcgaggatttctcactccacatgcttctctgcacgtgtctcccacgagtgtaccttaccgcctgtatactacgaaattgctagttcatcttgaggttaccgcacaatggccgttgtccttgcatagaagtcgaatggcatctagacgaagactcatgtccccatgtccccatcatatatatatgggaataggcgtcgaagtagttgttgccacagtcgcgtaccctggcagttctggaagaggcatattacgtagtgcatcacacgtacacgtccttgcacataggagtgcactcattgcctgccggatttggtcccttgtgtcgcatccttgccctgggaatgtttagcggaggaagtccttgcccccgatgccaggaggtctgtgggacgcgatggcgctgaagggcacgccttctcgttgactgcgctcgcactgtaggatagagtgggttcgcaggggcttgttgctcccgaatctgagtttggaggactgccgctctcagtgggctccggcatcatggtattcctgagacctggggctacaccgtcttgttccctttgttttggggaagaagtgcttgctggggagtctgggagggagcccgggcggtttttgaacgggggttcccggccgtagttccgggatggggtcggcccctcttttttggtcgtctccccttg

SEQ ID NO: 505578 - DNA, 914 bp, Homo sapiens
atgcggccctcgccatactctcttcgtgcatctttcggcggctccacgctcttttcggcgtccgcctatggctgccgccgccgtccccgagatcgcttccctcgtgccgcctgccgtagattcaccgttgatgcctcgcatctgcaacgcgcggccgccgtactacccttttcgctactatgctataccatgtattatgcgcatgggttttactccgtgtccagcgctgtgttcccgcgatctatattttcccccggtgtatttccggcgcactgtgccggtctccccgggttgcgtctttgtcgttatcgtgctacattgtcctcctctaattttcacgctttcgcatccctcccgcgttcttcacccgtgtttgtccccgctagtcgtgtcttacttcgctcctcgggcgaacctgattttcctttgcccacgggtgatttcgcctcacgtttttcggtttcctcgcctgaatttccccaacacgtttctatataacagttgcacaacactcctgcgaagcgaaagcgaaaagattagcgtaaggtgcggggaattttacggtccacaaacgaaacgggagcgccaaaatacaaaaaagaatttccccccccccccccagtttacgcaatcctccagttacttctttaggctttactgaatggaagcttgactgaaattaggaattagtgtaacattcctgcataaatgcattgtatactctgtaaaacctgctgtgaaaaaaaaagttgattaagaatgcaggaatctggttaatttgccctcacagcaggcagtgtaggtaaaacttttccttgctgggtgaccacaacttgtttagaagaggttacttaggtatttttttcagaaagtaagagctcttgaacaatgtggaaaatactaactaggtagtt

SEQ ID NO: 505579 - DNA, 448 bp, Homo sapiens
ctcactgcaacctccgcctcctgggtccaagcaattctcctgcctcagtctcccgggtagctgggattacaggcacccaccaccatgcccagctaatttttgtatttttagtagaagcagggtttcaccatgttggccagactggtctcgaactcctgaccttgtgatccacccacctcagcctcctaaagtgctgggattacaggcatgagccaccacccccagccaaaatttactctttatctaattattttttgctatatttcttagatatattggattctcttttatatgttctctttattctacattcatcattcttgtacttatacatacattaaagcctatattgtatgctcttatatttctggaacactgagttcttcaccctttatacctcccctgacacggcatggtcaccttcatgaggattatgtcactcggtccc

SEQ ID NO: 505580 - DNA, 206 bp, Homo sapiens
agcaaagagatggataacaccataaatataggtggggagacaattaacatccactaatgtttctctacataaactatactattaatgtcatttttttaagaacagttgcaaatagactcacatacatatacgtgggcaaaaaggcaattaagtgaatctcttgaaacactaaatgtataataaacagcatattatcaacatttcac

SEQ ID NO: 505581 - DNA, 210 bp, Homo sapiens
aacccagcttttggggttttggggccccctccgccccccttggggtggccccccctcctccatgggcagtgtgggccccgggccgggcatcctgctcagtgtgggggcagggttgggggtgagcccccttagctgcttcagtgaatgttcaggggccgggccgaggtgaacctcttgtgttcccctccccattaaaggttggccggggga

SEQ ID NO: 505582 - DNA, 101 bp, Homo sapiens
tcgatagggcaagatacggagccagacatacatacagcaatgggaaatgttcaggcagcatctaggaggagagagtaaatgttttggctatgagcacattt

SEQ ID NO: 505583 - DNA, 632 bp, Homo sapiens
gtattatcctttaagatcatttaattttagttgagtgcagagggctattataacaaacgtgcagaaatttgggagggctgtgatttttccagtatataaacatgcatgcattaatcttgcagtttattttctacattgtgtaatgtaatataatacgctattactctgcagcacgatttctcttatgtgataaatgcccttaagggccaccaactaggttactaacagtacactgaatgtgtatctaactcatatatggcatgcttactgtttatttccattaaacaagaggtttattcatattgttagcaataattagtatatcttgtggcacccaattaatttatatgttcgtggacattacaattttggttacaacaaagaacgaagtgttgtttgttagccttggaattgaacggaaatattggtataaaggatatatggggagaggatggttataaaaaacatatatatatatatggaaggacgaggggaaagaaaaaaaggctggtattgcatttacataggctgtacaacaggatatatcaatacagaattattgtacatggggtatggtgttgtatacaaaaattgaggacatgatactgaaggttaattggttgcggatatga

SEQ ID NO: 505584 - DNA, 150 bp, Homo sapiens
tgtgtcccaccctttttcccacacactgtccccactccccatgccccattcctttccagagaatcactggtttagaatagagacctacaaacttgggcccttaggctggccctccacctgtttctgtcaataaagttttattggaacaca

SEQ ID NO: 505585 - DNA, 175 bp, Homo sapiens
gctggtgtcgccatgggccgccgccccccgcccgttgttacccgtatttgtaagaacaagccgtaacccaaagtctcggtttctgccggaggtgttccctgatggccaaggattcgcattttggacttcgggccgaaaaaggcaaaagttggataggtttccgtttgttggccaa

SEQ ID NO: 505586 - DNA, 122 bp, Homo sapiens
  misc_feature (59)..(59): n is a, c, g, or t
ggctagggttgtcggtgtgggaagggcttgcggatgcggatcacgtcaagcccgactgntcggccagcttctgcaccagccgtccgagatctcctcgagcagacttgcaagtgagatgctct

SEQ ID NO: 505587 - DNA, 218 bp, Homo sapiens
ccgactaggggtgaggctgtgatcgattaacagaaaaatgggggtgagaagtgaaggtcaagctctgtgcacgccagattcacccctatgttctgccagtaacttttctttctagttctcgtgattttgtttattgacacatgggtcttgctgatccgtcccgctctcggtcctccctaaagtgcttgggattacacggcatgtagccacttgcgccc

SEQ ID NO: 505588 - DNA, 571 bp, Homo sapiens
  misc_feature (87)..(87): n is a, c, g, or t
cgggcctcaaggtgctctgtggaccacagcggggcccggggccctcgcgagggagggaagagttcgctccaggtccccgcgattccnccggaaagtgaaactgcagaggtgttgcgtggacacccgcggtcagacacgaccccaggccgcgcgggccccagaggaagcgagcgcgagtccgcggtggtggctgagcgctcagtgaggacgccattccgccacgaaaacgcccgcgacgccgctggcccctgcgcggtggggcgaggtaggctggccggacctgcgaagcccgacgagcccggcgccggctggctgcagcttgctctgcctccctggcctggccccgaggctcccgcgagccgggatccgcgaacaccggggccgaaccgactctctcgggcctcagacggcgtggaccctggaaggccccagttcggccgcttccccggaagtcccccagtgggctccggccgctctggcccgcgcgcgtccggctcgctggtgccctgggcggcgcccggccgctggcgcttctcgggcgctagggggggcccgccccaaacttttcctt

SEQ ID NO: 505589 - DNA, 424 bp, Homo sapiens
ctgacttacttattcattaaattttgaaggttttccacttgaagtaaattaggaaaggtaaagaagataacagaccaagtaaacacttaagaaaagtcaagctgaggccgggcagggtggctcacacctgtaatcctaacaaacactttgggaggccgagggaggcagctggattgcctgaactcaggagttcaagactagcctggccaacatggcgaaatcctgtttctgccaaaaaaaaaaaaaaaaaaccaaaaaaaaaacaactagctaggcatggtggcgtgcacctgtaatcctagctacttgggaagctgaggcaggagaattgcttgaacccaggaggcagaggttgcagtgagctgagatcgcaccagtgcactcctgcctgggcgacagagcaagactccatcttaaaaaaaaa

SEQ ID NO: 505590 - DNA, 344 bp, Homo sapiens
tgctgtccagagttccccatcagccctaaattgactatagcttcaaaaactaggacgatatggaatgacacaagaaaacataacatgggatcttccacaaaatgaaacattttggtgcagcaaaggacgttattaagaaagtaggcccagcgcagtggctcatgcctgtaatccgcagctactcaggaggttgagtcaggaggagtcacttgatcccggaggcagaggttgcatgctgattgtgccacttgcatgtccgtgctctgggaaacgtcagacactgctctgtttccaacaaggaactggaagacgaaaaaacagggaaaaaaaaattttaacatttg

SEQ ID NO: 505591 - DNA, 142 bp, Homo sapiens
aatgtacaaaagaaagttgtatgggagttgagctggaaggtaggattataagagcagcactgaccaataaaacttcctacaatgaaacatgttctataatgtatgttgcccagatacagtacgccactaagccaccatgtga

SEQ ID NO: 505592 - DNA, 285 bp, Homo sapiens
aaggatcacactgcgataagcacgtgatgtatgattatgcattgattttaccgagatggcactggtgtcgttggagtttgtacggaatataagatattacctatgcatttcgaatacaactggataacactaagtttagatctcatgagggagaaattgcctacatccgggttaaacgttgatgggcccagtaactctcaacgttatggaatatctctatctcgaagccgtagtcttagcataatgcctgctatcagaagcaagcagcaggagtcgcagttagtc

SEQ ID NO: 505593 - DNA, 171 bp, Homo sapiens
  misc_feature (8)..(8): n is a, c, g, or t
taccccgnggttatgtttacgttgcaggttcgatccctggcttgcccagtgggttaagggttcggcgtttgccgtgagctgtggtgtaggttgcagacgtggctgggatcctgcgttgctatggttgtggtgtaggccggtggctatagccgtaagacataaccgcgggac

SEQ ID NO: 505594 - DNA, 192 bp, Homo sapiens
gagaaaagcttctgcagcgaaggctgtgtgctgctgtacaaacaggacttcactaagaagctgtgcttgtgctgtatcaacttgacttacttgtcccagaacttccagcgcgggagtacctagcaacttgttggcagcacctgggtcttcttctgtgaggacttgtagtacaagaaccccctcgggtactcg

SEQ ID NO: 505595 - DNA, 878 bp, Homo sapiens
ggcgtcttgttcttgcgtggtgtcggtggttagtttctagcgagttgtgtagggactgctgataggaagatgtcttcaggaagtgctaaacattgggcaccctgcccccaatcttcaaagccacagctgttatgcccagatggtcagtttaacagatatcagcctgtctgaactacaaaggacaactatgtggtgtcttcttttaccctcttgattcacctttgtgtgccccacggagatcattgctttcaagtgactacgggcagaagaattaagaaatcaatgccaagtgattgggctcctgtggatctcacttctgtcatctagcgatggtcaataacctaggaacccaggaggactgggcacccatgaacattcctttgtatcagacccgaagcgcacattgtcaggataatggggtctaaaaaggctggatgaaggcatctcgtcaaggggccttttatcattgatgattaggggtatctacgggagatcactgtaatgacctccctgttggccgccatgtggattgagacgtgttgagactaggtcagggcgttccaagtttcacttgagagaacatggggaggtgtgccaaggtgtgttggaaacctgggagtgataccataaagctgttgtcaaagagcaagatatttctccaagagaagtgccggtggtgtataagtgcaggtgggggggaaccatgaaaaaagagtttgtgattgtttaccatagattaacaagagattacgttcaccgaatgggtgtaaaggggcctctagagggtgagaaggtttcatggagatggcagtggtgggagaatgtttttttaagacatcttgtggttttacaaaaaacaaatgggggagagaaaagag

SEQ ID NO: 505596 - DNA, 431 bp, Homo sapiens
tatatgatcctgcgctgccttgctagggaacagttcacttttcagttgctctttttttcttttttgtgacagagcaggacttcgtctctcaaaaaaaaaattttttttttaagtggggttgtggcccggtacggtggctcacgcctgtaatcccagtactttgggagaccgaggcaggcggatcacttgaggtgaggagttgaagaccagcctggccaacatggtgaaaccacgtctctgctaaaaataacaaaaattagccggacatggtgcctgtaattccagctacttgggaggctgaggcacgggaatcacttgaacccaggaggcggaggttgcaatgagccgagatcgcgccactgcactccatcctgagcaacagaacaagactgtctaaaaaaaaatgaaaggctagagaaataaaaccttgt

SEQ ID NO: 505597 - DNA, 227 bp, Homo sapiens
  misc_feature (39)..(39): n is a, c, g, or t
  misc_feature (47)..(47): n is a, c, g, or t
  misc_feature (166)..(166): n is a, c, g, or t
  misc_feature (219)..(219): n is a, c, g, or t
tcccacaggcacaagggaaagaagaggaacccagaaaangagaaatncctgcaaaagctgtttatgattttaaggctcagacatctaaggagttgtcatttaagaaggagatactgtctacatctcaggaaaattgatcaaaatttggtatttgagggagaacacncacgggagagtgggcatcttcccgatctcatacgtagagaaactcacacctcnctgagaaa

SEQ ID NO: 505598 - DNA, 204 bp, Homo sapiens
agtaaggttttgcatcctttgatcagcaggtaactgacgaattcttgagtcgaagattataccttgatgagctttgatgagctcttgcaaacgaatgagaccagtgctgtcatcatacacaaccatgacgttttccacttgaaaaactgcaccaggtctaaaatgcacgctgagtgaagagaagtctgggcagagactgacata

SEQ ID NO: 505599 - DNA, 210 bp, Homo sapiens
aactccttggaatgcagaaatcaccgtcttctgcgtcgcttacgctgggagctatagaccggagctgttcctattcggccatcttggctcctccctctagtattctggatttttaacagcaaatcagcaacaagcatcctcgggcacacacattttcactcttggacaaccatctccctcaggtagattcacaaagggggattaccgggc

SEQ ID NO: 505600 - DNA, 898 bp, Homo sapiens
  misc_feature (48)..(48): n is a, c, g, or t
  misc_feature (94)..(94): n is a, c, g, or t
  misc_feature (101)..(101): n is a, c, g, or t
  misc_feature (109)..(109): n is a, c, g, or t
  misc_feature (112)..(115): n is a, c, g, or t
  misc_feature (117)..(117): n is a, c, g, or t
  misc_feature (121)..(121): n is a, c, g, or t
  misc_feature (123)..(123): n is a, c, g, or t
  misc_feature (148)..(148): n is a, c, g, or t
  misc_feature (153)..(153): n is a, c, g, or t
  misc_feature (173)..(173): n is a, c, g, or t
  misc_feature (184)..(184): n is a, c, g, or t
  misc_feature (186)..(186): n is a, c, g, or t
  misc_feature (220)..(220): n is a, c, g, or t
  misc_feature (231)..(231): n is a, c, g, or t
  misc_feature (255)..(255): n is a, c, g, or t
  misc_feature (258)..(258): n is a, c, g, or t
  misc_feature (270)..(270): n is a, c, g, or t
  misc_feature (286)..(286): n is a, c, g, or t
  misc_feature (300)..(300): n is a, c, g, or t
  misc_feature (323)..(323): n is a, c, g, or t
  misc_feature (355)..(355): n is a, c, g, or t
  misc_feature (360)..(360): n is a, c, g, or t
  misc_feature (384)..(384): n is a, c, g, or t
  misc_feature (402)..(402): n is a, c, g, or t
  misc_feature (408)..(408): n is a, c, g, or t
  misc_feature (415)..(415): n is a, c, g, or t
  misc_feature (417)..(418): n is a, c, g, or t
  misc_feature (423)..(423): n is a, c, g, or t
  misc_feature (425)..(425): n is a, c, g, or t
  misc_feature (431)..(431): n is a, c, g, or t
  misc_feature (453)..(453): n is a, c, g, or t
  misc_feature (477)..(477): n is a, c, g, or t
  misc_feature (493)..(493): n is a, c, g, or t
  misc_feature (519)..(519): n is a, c, g, or t
  misc_feature (533)..(533): n is a, c, g, or t
  misc_feature (549)..(549): n is a, c, g, or t
  misc_feature (566)..(566): n is a, c, g, or t
  misc_feature (597)..(597): n is a, c, g, or t
  misc_feature (602)..(603): n is a, c, g, or t
  misc_feature (634)..(634): n is a, c, g, or t
  misc_feature (642)..(642): n is a, c, g, or t
  misc_feature (691)..(691): n is a, c, g, or t
  misc_feature (763)..(763): n is a, c, g, or t
  misc_feature (800)..(800): n is a, c, g, or t
  misc_feature (833)..(833): n is a, c, g, or t
aaaatttttgtataattaattagtaataatcatcaataaattaaaatnaaaaaaaaaaaaataaaattaaaatattaattaaaattatgtttgnagacttnatataatnaannnnantttntnctcccctcttctagtttcacttccnaaggntgtgagttctaagccctccntatgtggaganangttatcctccccttgttccatgttaagttcaggnatttgggtggngttgagttggtacttaaatatgcngcnaagtggctcacnaggggaaatgggttgngtatggggggaggngggtcaggtccttgtcccaatanggggctaggtttggaatctccagggtgcagcntggantcctaagggcagattagggctgangactggatgatgctcgtngtgggnttggacntnnacagntncctggnattcagaggtacccatcctaanttcctgggcaaaaaacaaaaatcntggaaaaaaaacaaanaccgtccgaacctccggagtttattnatttccagcggtantgggctggaccgagcnttggtggcatccgattnaactccagaagcatcccaggtcttatccagnatggnnggagaacgctgtaaaaaatctggacttaagnaatattanaaatcgtccctttcctcgaagtcgggctcgggctctgggtccggttctngctccagtaccggctctggttctgcttcagcctcgggttccagctctggctctggctccggctccggttcancctctttagacgcctcagcttccagctctggctctgnctcctccggggtcccggattgccccgcctcggngccctcagggcccccggcctcgtcagggtctgaagctctgggcaacccggggcatgtggtcccga

SEQ ID NO: 505601 - DNA, 234 bp, Homo sapiens
acaggagtcgcagccagaacagagatgacaacaagcccaggctcaggattatggcgtccacacattcagccgacgcagggctccttcaagggactctcctctctgtctgtacagaatgtggaggccctcctggaggcggaagtcacttggccagttacctccatagccgcctgagacccccagccagagccggcactgctcactggggctcctcggggggttttcagatgacgc

SEQ ID NO: 505602 - DNA, 113 bp, Homo sapiens
cacagaaacccaccatcacaaaaaaaaaaatttggcagcgaagagaactgaagaaaaactgacgaaaaagaacaaaccgggcaaaaaggacccatacaaatttttccccccac

SEQ ID NO: 505603 - DNA, 155 bp, Homo sapiens
aaacaaacaaacgaaaagaaagcccacaaaagtttgattcaggggtaggcatagtggtgcacacctgtagtcccagctacttgagaggctgaggcagaaggatttcttgagcccaggagcctcaaggctgcagtgagctatgattttgccactgc

SEQ ID NO: 505604 - DNA, 209 bp, Homo sapiens
tgctgggattactggcgtgagccactttacctgatgccctgcttgctatgtaaacaagctgtgaaataatgtgtcttaatttataaaacatatacagagagtatccatttactcttcaccctggcttgccccgaatgatacatatcttcatatgaccacagttacatttcaaaaccaggtaactgacattggtacgtactatgagtaac

SEQ ID NO: 505605 - DNA, 1348 bp, Homo sapiens
gcctcggtgccgtagccttccccgtgagcggagcgcgtggagcgcctctgatctcggcttgtttcttagtttgttccgcccgcatttcctgcgtttacttttcattatgtcaatgcatttgattattatcgaccttcttcatactattgacatgcagttgctgcggagagagaatgtcaccagaggaaaagtggacggggaggaggcgcaacttggaccacggatgagccggtgcagattactggcgatccaccattctccaagatctggcagcctatcttatgctttaaccgatgacagtaagccgtctgattacttttaccgtacacaaccactggccatgtctcgatgtcgtcaggacccgttggcaaggcaggttgtacacgcccatgactcttcactcgccctctgtgaggatcaacggtacttggtgcgccgaccacagtcctggacgacgtctacatcctttttccgtgttgcctagtactgccaccactggcctgctgtgcctgctcttacgcagctgtgcggcaaccatgcatctagtgcctgtcagactgctggcctgatgcagcttccctgtatgcacccgcttccattcactcatatgcccagaaccgggggaacacaacacagactcccagcgaacaacccaggggccacgccgggcagccacccactacgcacatcgaacttcccacatggcctcaggcgagcgacaccacaaggacgctacacgcggaagcccagtaattctacccgactgcgatgcccacaagctcacagcccgagagcacaagacataactaggaccctacccaaccatgcacagcaaacaggcaaccccaaagaccgagacccatggatcagtataccaacaagaagcagtagcacgccacacactgcacaatgagttagtcacacccggcgccaaagccctgacacagcacacgactgatcgcaaccacccaagacaccaccacacaaaaccatgcgcggctccccctaaggaaatggaattaccattgcttgcctctggacacacttgctgattgcgctccttgcttgacacggccaatccagtggtcctactacactttcacaaagtgacccccccctcatcatcaccttgcttatcgatcatacaacttacgttcctgatccatctcttcacccttttacttcacactaccccactctatttctactctcttgatctctcttcccccccactttttaatgaacaacattcaatcccccacattctcgatccacacaaaaaaaacttctctctactaactaactaatcaccaacccactacacatctatcaaccattcccctaccac

SEQ ID NO: 505606 - DNA, 283 bp, Homo sapiens
ttggggctttgcggtgacttacgcctgtaatccccgcactttgggaggccgaggcgggcggatcacctgaggtcaggagttcaagaccagcctggccaacatggcgaaacctcgtctctactaaaattacgaggcaggaaaatcgcttgaatccagggggtgcaggttgtagtgagccgagatcgcgccattgcactccagtctgggcgacagaataagactccgtctgaagaaaaataaaaaacaaaacaccgaacaaaacatccatcacgcacatcatggt

SEQ ID NO: 505607 - DNA, 443 bp, Homo sapiens
  misc_feature (379)..(379): n is a, c, g, or t
  misc_feature (433)..(433): n is a, c, g, or t
tgtgtgcctgtcaatcagagccaggtgtggtggtgtatgcctgtcaatcagagccaggtgtggtggtgtatgcctgtcaatcagagccaggtgtggtggtgtatgcctgtcaatcagagccaggcgtggtggtgtgcgcctgtcaatcagagccaggtgtggtggtgtatgcctgtcaatcagagccaggtgtggtggtgtgtgcctgtcaatcagagccaggtgtggtggtgtgcatctgtcaatcagagccaggcgtggtggtgtgcgcctggattcctggctactagggaggctaaggtgggcaatcacttgagcccgggagtttgaggctgcagtgagctatgattatgccactgtgctccagcctgggcaatanaatgaaaaataaatttaaaactgtctctgaaaaataaattaaaaagtgagtcanttagcccagc

SEQ ID NO: 505608 - DNA, 900 bp, Homo sapiens
attgccttgagacgcgtcatctccttttcctatgggttggtttcgtttggtaaatccattcagcccattatagacacataactgttaagttcgtagtctttgtttggttttattgaggtagggtctcttccctgatcctcgtcctgcttccacttcgccattgctgggataacagacgttatcacacttggctcattttaaatgcccttcagttatattccggacatctgagaagttatcttaaacattaaccagtttccatcattgaatttgatgtggtttttctcaacagcaaattattctaggttattctaggttaaaaaaaaaaaaaacaaaaaaacaaaaccaaaaaaaaaaaattggtaattctctggcctgttccctgagtactaagtgtacagactttcagttaccatcccccctcccccgcggggaacatcccagcagacacaattttattctttatagaaacaaagtcattccctagacacccttccctggtcttggtccctagcaaaaataaatagctgtccctttagaagtggtgacagaagtcctggggggtccagcagagatgaagaacttgcgggaaggccttagtcctggctctcagagtcaggtgtcatcctcctcctacagactctccctagaaaactcgctagaatcttccttaaaatttccctcagatagggcgcgactctggggaaggtcattggtccatcttgctcgcaatttccggaggggcatcccctggttttgtggagggcacttgagattggagattctaataccaaagagggaggaacgggacggctcgggaaatgcacccccttggagattataggcgaggaggggaccacctttgaggacgagaacccaagcctgggcacttagtcgact

SEQ ID NO: 505609 - DNA, 1237 bp, Homo sapiens
cacctttcaaaaagcaaccccatgtatgcctatatgtgtattgtatactttttttacataattggagtcatactgtcaaaccagttttcatcacagtcagcatctttttccattgccaacacatagcccaccattcctacttatgggccattcaacaaattttcaccacacacaaccatcacattttcaagtggctcatcattgatcattcccatttcaatggcatgccaactccagtactcatttaaccgattcccatgttgttaactatctaaggttgtttctaatatttcattaattataacagttgcagcaaatttggtgtaccataaacctgtctccatataattgattattaggatatcattcccatgcaaggcattcttttattcacaacaaatgtgcaaatgtccatcttgtacttacaccatttccatgaaacagggcatttcctgctttggtactgcatgggtggcagctgtgcaggcaaacagccagtcgcaatgcaccttacacacaacaagcaacatgcagggtccccttccagtcgagcagtgcactttcccaataccaacaagcatccactagcaagcaattcaactgtctccaaggaatccaaggtaacccgcaagtactactctcgcaccatacccacaactcagtctcgcggaggaactcggttattccacgctcctcggaacgcccacaccctggcaaaggtccacagggcacgcaaaaatggcccagcacaccaacaggtgccgcagtgcactaaacggcatgaccatcatcaaagcacacaaggagcgagatccacacagacacaaacatgcggctcgcaggctagcccacacacggaggcaggccaactgagaacaccgcacacgaaaacacccgcacaggcctgccaccaaacaaggtaaacacaagaccaacctatcgccacgaccaaaacagtcaccaaaagcgacgcacacaaaacccacgaagaaccaagaatcaccgccgaaaaggagaacaagaagaaccagacacacaaaaaccgaacagtcaggacaccacacccgccgcaacaggaagaacgacgcaaacagacacaagaacgagaaggacacaggggaacacgccacaacaagcaccaaacaaacccagacgaccacacccacacaccaaagacccgatagcaaaccaaccgcaaacgaaaacagagaaacaacgagcaaacagccgaagaaca

SEQ ID NO: 505610 - DNA, 424 bp, Homo sapiens
agacgctatgaccgatggataccagtacgagtaggcggcacgagactaccgaccgtgacgatgtggccggtcacaagctgaccttcctgcgcctgatgtcctccgaggcctcccagaacatcaactaacagtagcaagaacagcgtgccctacgtggaccagcagactggcaacctcaagtaaggccctgctcctccagaggctccaacgagatcgagatccgcgccgagggcaacagccgcttcagctacagagtacactgtcgatggctgcacgagtcacaccggagcctggggcaagacagtgattgaatacaaaaacaccaagacctcccgactgcccatcatcgatgtggcccccttggacgttggtgccccagaccaggaattcggcttcgacgttggccctgtctgcttcctgtaaa

SEQ ID NO: 505611 - DNA, 193 bp, Homo sapiens
tacaactagttattgatgccaaacgtctgatatggacgcagatatgatgatgctgttgtacagtctgatatgaaacatatggccttaataggtggtgaatgatagtaggaaggaccaaggtccaagtcgaatacaagggagagaacaaaagcttctatccagaggaggttgtcttctatggttctgacaaaga

SEQ ID NO: 505612 - DNA, 106 bp, Homo sapiens
tatacgattgagctctgtaccccgaacagcaccagttggcgctgattcacgcgacggtcaccgcgataaagctgatggcggtggccggtatcggctccagaatcat

SEQ ID NO: 505613 - DNA, 829 bp, Homo sapiens
gccgccttttttttcttttgtgaaaggggacgacatttattccttttccaaatgttacagtaaaaccaggtggaagagaagggttttagcagttagaaaaaaacaaaagtgtacaaattctgggggtatgggccattaacaacgtttatttaccaaccagtggggaaaaaaaacagacacaaaatgttggtgttcacttttttcagacctaccccccaccccaaagctctaataacttgggctttaaccacaagttccaacacaaagacagaacaccaaggtggaattcacgagggctgtgggaggttttggaaactgtgaagttcaaacactatttttcaaacacccttaacagcggggaccagggtgtccctccccaaacccgagggtgcccacttaaggccacaagccaccaagaaaacttaaaaaacaaacgaggggaagaggctggcacaacatcaaaggttggggaagtatataagccccccaaattccgtggcctcaagggaaattagggggcagtataggggttaacacaaaacacctatacatggggcacaaaaacacatgggggcaaaacaaacaccaacaaatgtggcctataatgcacggggaggttgggcgcacaggggaaaagcgaaggatcaggggccccagggacacaggaaagcatatttcaccatttacttaaaccttaccctggggaaaaaacatgtttaaggggaccaatttttccaactgtgggccttaacaggggaacaccccacaattggactgatagggggagaaaatccaaagagacggagcaactggcgccaaaggggaacct

SEQ ID NO: 505614 - DNA, 267 bp, Homo sapiens
  misc_feature (1)..(1): n is a, c, g, or t
  misc_feature (92)..(92): n is a, c, g, or t
  misc_feature (99)..(99): n is a, c, g, or t
ntgacatctgcttcagagtggctgcctccagcttcctccgccacaaggcctctcttctgcggccgcacgtgactactcgcgacccctgctgnatgtctnttttttagagagcgaggagccagcgacctcagggggccccccagccgtcaccctgcatggcatctcacccgacgtcttcactcacgtgctatactacatgtacagcgaccacactgagctgtcccccgaggcagcctatgatgtgctgagcgtcgccgacatgtaaat

SEQ ID NO: 505615 - DNA, 105 bp, Homo sapiens
tactaaaaacacaaaaaattagccgggacattggtggcagggcattctgtaaccccaggtactcggggaagggcttgagggcttggggtgaaaggccccaagggg

SEQ ID NO: 505616 - DNA, 918 bp, Homo sapiens
aagcgacagcctcatgctctccccgtcagagggcttctttgtcctctgaaggctatggcccaaggaagtgatgccccagcgagggactttgacggagaggactctgatctccgaggtatccacagcttccaacagttccaactaagcagcctccccaaatgcacagtttcaccccagaataagactaatgaggcctctccctggagagcactgacccgcgggacttggggacccggtgagtttggtttcagtactggagaccttatcgggtctcccgttcccttggacattttggctcttctcattttatctattccctcagacttcgtatgctctggtatgaatgcccactagggtgcttgacaaggcaatttccaggacagggatccaggagttcatgatgacaagattctcagatcgagtgcccctcagtactaatagctataaaaaagaggacacgactttccgtagccaagttaagataaaggtgagattccatttccatgcacttagagtggtttgcagtaagcatttttaccccctaactcccaagagtgtagcttaaatacgcacagattcacaattgtacgtgataaggaatacgattagacaggctttggcttgcacagtcgagttcattatagtcctaaaatagctcagggggctcccgcatcgacaggagagtgcccggagggtaactagctctaacagaagcaggggtttaccgatgtgcggaaccgtgattaaccaggtttctacggcgcgtaatgaacatcagggacccgcggttttaaggccggtcaaagggctccagaggtttcccaaacaaaaaaaggcggcgccaataaaagcggggagaaaattatcgcttcaacgcccactatctacgccctacttcccccaaaagcaaagggggaa

SEQ ID NO: 505617 - DNA, 287 bp, Homo sapiens
cgagctatataccagtagatgtatgtacggctaggggtgatggtaagcaacatctggtaatacgatagtgtcatagcggttgcttgctgtgaaaagatccaagcatagtaaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaagg

SEQ ID NO: 505618 - DNA, 378 bp, Homo sapiens
tcataggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggacc

SEQ ID NO: 505619 - DNA, 99 bp, Homo sapiens
gcggccgcctactactactactactgctcgaattcaagcttctaagatgtacggggacatgccccaggagaagctggcctcctcccccaaggacaaaaa

SEQ ID NO: 505620 - DNA, 1174 bp, Homo sapiens
  misc_feature (609)..(609): n is a, c, g, or t
ttaaaaaaaaaaaaaaaagaggcaaccaaccccaacaaactaaaaaagaatggttttgggtattgggaagaagggatgggtcgagttaagcctggtctggtcagcacgacgggcaatgggatactggggcccgggtggaccacgtttcagtactcacggtcctctatccgtgggataccccaggggaagggcggaaccggttgttcggctcggtggtggtctggtcaccgcaagcatggttgggcgatcggggagttctcgggcacacaagactaatccgctatcaagccggttgggctcctttcaagctaacttacggttaccaacgtgttccttataaacgcgcaaggcgtcttccgggacctatgacgggaccacaaggggaggaagcgctaagtttgcgtttcagtggtggattgagaaaatggagtggactcttacgtcctgtaaaagagggcaagaaacacaaattatcccgtgggtgtgcaccgagaaagagagaaaacaaacacaaagcccccaacttcaagacttcgagctccacgaggggagtgagagaaccacggagaaaaggagtcttagagggaaatccagtgggaacctttctgngacaacaaaagagcgagaaaaagccttatattctgtgggccttggagggggtatccccttttaacaacaaatctacaagaacaacaactgtgtggtcccagaaagatatgcccggggggcaactccttggggaaagcacaggggatctcaaagggggcaaggtgtgtgcacacgcaagaggggaaacgtttaggaagtctgggggatttgaagcatgtgtgacaggtaataaattacatattgagggggaatttacaacggttatgaattggtaaaaggacatgttgacacacccaccaggggggccaagtaatttgagacgaggaaaccgacgaatgggcccggtacaatgggctgggtacgcggtaccactttacggttatttggcctgttaagaaggccacattttttgcgtcatggttggggtggtaaaaaagcaaaaaagggcgattgggattgaaaaaagggcaatagggtggcacggatgtgttattgacgaaacattcaatggtggcgagaaaatacatatccagggagaggtaggggggcggaacattttaagtct

SEQ ID NO: 505621 - DNA, 579 bp, Homo sapiens
gtgcacttaatgggatccccgccatgggtaatttcttactgtctgtgccccatcagcagtgaaccttggtctcacggagctctaggccgtatccaggccgttgctatccgttgcccagccccgggatgtataaccccctccctcttcacgtcccccgagtaatagtttcttgattctcgcacaaaacagaatgtcgtcgcgatcgtgtcacggattagaagatcaatggagtggggggatcttgcccgctttatttggccccgccgctatcggtactcgattcatgcccactaactttacgtaatcgcctgatcctcggccggcttgatttttcttgccccccttagcgccgatctccctttttttggtgctctggctcgggcgagtacgtcctcgctgtgtgaatcccggagtcgtcgagggcacggcccctaaggagtcccccgttatccaatcctctggccgacagatggtctgcgcctggtgtttaggggatgcctccgacgacgtgatgtgcttaaaacacaattattttcgcgcggcattatacccaaaactcccatgggcccaaacataaca

SEQ ID NO: 505622 - DNA, 110 bp, Homo sapiens
ggagaaaccgacccagaaggcagaggaacaccgcagcgccagcccaaggacatcgaaaaccagagcctgagcaacgagccggccttcaccgcccgcaagacgagggcgga

SEQ ID NO: 505623 - DNA, 91 bp, Homo sapiens
  misc_feature (5)..(5): n is a, c, g, or t
  misc_feature (55)..(55): n is a, c, g, or t
  misc_feature (62)..(62): n is a, c, g, or t
  misc_feature (80)..(80): n is a, c, g, or t
aagcncagggagagtgcgtgggctgagcatctgcaggccgaaggagccgtggccnttggaangggccacaagttccaccncactattcgag

SEQ ID NO: 505624 - DNA, 361 bp, Homo sapiens
  misc_feature (21)..(21): n is a, c, g, or t
  misc_feature (97)..(97): n is a, c, g, or t
  misc_feature (112)..(112): n is a, c, g, or t
  misc_feature (116)..(116): n is a, c, g, or t
  misc_feature (132)..(132): n is a, c, g, or t
  misc_feature (148)..(148): n is a, c, g, or t
  misc_feature (150)..(150): n is a, c, g, or t
  misc_feature (224)..(224): n is a, c, g, or t
  misc_feature (256)..(256): n is a, c, g, or t
  misc_feature (358)..(358): n is a, c, g, or t
  misc_feature (360)..(360): n is a, c, g, or t
tttttatttactgtatatttncctaactttttttttctctttttaacatatacattttatacttcaacatttcaaccccatataaggcaaggaagtncagccaggggaattnggangcagggaagaggcatnaggtgtgccgggagancnattatctgcatctcttcccaactctgagtccagtgcattcaataattctggcagcattacatagtacacttctnggagaatttacaccacataagctgcccaaatncaataaatcagggcttttttcccctcccagaaaactggtttactataaacgtgtgaaacaccgtcccgatctatttctgaacccacccaagcctggctactntna

SEQ ID NO: 505625 - DNA, 192 bp, Homo sapiens
tggaacgagatggggcgtatggaatgttgaaggctgctccgttgatgtcggtcggagcttccagtactaggcgagggcaggagtgaggcctcgggcacacagccggcgccctagtcacccggcccagtatggagggcggcacgggccctcgcacacggcactatgccaagagtggctctacactctacgcta

SEQ ID NO: 505626 - DNA, 203 bp, Homo sapiens
cttcccctttttttctggtaaaacctatgggaacccccaaattagcctccctcccctttaatgatttcccttgaatatataccgaaattgttatttgctttttttttaaaaaggggggttaagtaacccttttcttcttttgttaattataggtccttaatttccgccccccgtggggggtccattaaaatttttttgattta

SEQ ID NO: 505627 - DNA, 286 bp, Homo sapiens
  misc_feature (280)..(280): n is a, c, g, or t
ccctggatcgttgaatgtttggattgcatcgccacagctatcaatattctcgaatgtagcgattgcacaagatttatctcatgctttaaatgaacaaaagcaactgcaatatggccagtctattttgactttagatggttatcatgtcgggcaagattgggtaattgctcttatgtatgatgacgaaagtcaaagtgcgcaaggtatgctcagtcatcgtattcgtctagacgaaattgaacaagttcttcaaaagcagcaaccagaattacaaacattncagcca

SEQ ID NO: 505628 - DNA, 405 bp, Homo sapiens
tacatgatagaccgagctatacccattcgcgaatcacccacatagtaacatgggtgactgccggtgtctacagcactatgccatagcatggaaggcattagaacagagccagttgaaaggcagccacctgatccccatgcaactcttaaccttggaacaaaaatccttccttagtctcaagttcatccatcctaaaaggaaaaaggaggatccaatgagcactcggtttccttcggttgctatttttccagattcttgttagaccacagggtatcccgaaggagttttccatggcatgtcagcaaaatccaaataccactcttcagaaggtaatatacttaaaacagaaataaaacagtaaaattgcaccccatatattcacaaaatttacactggaaattatgt

SEQ ID NO: 505629 - DNA, 831 bp, Homo sapiens
gggaggcgctttaggctggccggcggcgctgtaaggtggagtcgtatgctgctgctgttgtgagcctgtggcgcggcttctgtgggccggaaccttaaagataggcgcaatggctgaacactggtgataatgaacagatggctgccctggaggccaaaatctgtcatcacattgcgtatactctcggcgacttcacattctgccacgggacaagtttctaaaggaacagataaaactggatgaaggctgggtacctttggcagatactgatacacattcaaacccggttgacaccgtctaacaatcagactttaatgtaattgtggaagcacttgagcaaatccaaggcagaactcactggaaatcagtgaacgataacaactaaaatcagaaggtctccaagacaaaccctacctgaagtgactgactgagtatacaaatgatgtcacacacacagatctgttctcatcttaccaggcttcccaaatgatgcaactcttgatgacctaaaaagaatggttagcacgatacaggtccccgtactaaatatcagatgagcaagaacatgcataaagcgatttaagggatcactcacgtcgtgttggataggcttgaatctgcctagaaattcggtgagacccctggggcagaagtacacagaaaagaactgctatcgttgcacgggagaatacttcggcaagcacctggaacgacacaactaaaggggcagcaaataaactaatcggacagagggacaatagcgagctggacgccctcgcaccagatggctgcgatccgggctgccccgaggaggaatcacccacggcaacg

SEQ ID NO: 505630 - DNA, 534 bp, Homo sapiens
  misc_feature (59)..(59): n is a, c, g, or t
ccctaaaggcactacattgaaaagtctgaaagagcacaaatcagataatctaaagtcancaccctcgaaggcaactacgagaaacaagaacaaaccaaacccaaattcagtcagacagcagaggacaactaaccaacgatcagacgccacgacacctaaacctgaaacctgacaacaaacaaaattacaaaagactaccagtcgacaacaaacatacgccctgatctcctcttgaaaccacaccgactaaaaccaagtttaagcaccctcgcggcgccaaaaaaccttctcggcccactttcaagggaacaacccccgaatatttgaaggcgccgaaacggaccttgcagaacgcgccctgagaaaggggcaaatttcacggcggccaactagcggacaagggcaaggggcaacaacaacgaagatttcccccaagagatagaaccgtcttttaaccccgaactgtgggaccccccgtttttcgccccactcgatacaacacaccgcaggcgttttgtcctccacaacgaaaag

SEQ ID NO: 505631 - DNA, 1207 bp, Homo sapiens
  misc_feature (66)..(66): n is a, c, g, or t
  misc_feature (91)..(91): n is a, c, g, or t
  misc_feature (110)..(110): n is a, c, g, or t
  misc_feature (167)..(167): n is a, c, g, or t
  misc_feature (220)..(221): n is a, c, g, or t
  misc_feature (226)..(226): n is a, c, g, or t
  misc_feature (258)..(258): n is a, c, g, or t
  misc_feature (275)..(275): n is a, c, g, or t
tagggctatcgtcgaccaggccgtcagcgcacgcgtgcggagccaccgtcaggagcaggtagctgntgggctccgtgggacactttgcgtncgggctgggagcgtgcttnccacgacggtgacacgcttccctggattggcagccagactgccttccgggtcactgncatggaggagccgcagtcagatcctagcgtcgagccccctctgagtcaggaannatttncagacctatggaaactacttcctgaaaacaangttctgtcccccttgcngtcccaagcaatggatgatttgatgctgtccccggacgatattgaacaatggttcactgaagacccaggtccagatgaagctcccagaatgccagaggctgctccccagcggtggaccctgaaccagcaagctcctacaccggcggaccactgcaagcagacaccctcctgggcccatgtaatcgttctgtcccttcaccagaaaacctaccatgggcagcatacgggataccagtctgggcattcttgcacttctgggacagacaaagtcatgtgacttggcacgtacctccccctgccctcaacaagatgtaattgccaactgtgcaatgacctgccctgttgcagctagtgggtttgattccaaaaaccaccggcacgtgaccccgagtacgccgccattgggccatctacaatgcagttcacaggaacatgacggaggataggtgaggcgcttgacccccagccatgcagcgctggctcagaattaccgatggctctgggccccttacttcaggcattctatatcacgaagtggcacggacaatcttgcaggtgatgcacgaatatgggactgaacagaacaacacatactacgaacatactgctggagaggtgccccacatgaagacccagccagaagatagaggaaccgagacggggccacccagtacagccacacagcttaccatagcgtgtaccacagacacacagtactgtcgccgcactgacaccggagggccactctctagcagaacaaactacaacggagacacccctgggaaacgcaactgagaacgacaaccgctctagcaggaagcagatcgacgcagaggcggccaacccgggaccaaaagccagaataccggaaacagggagacacagcagcagccaccgagaaacaaagacatccgcaacacgactgcccacaa

SEQ ID NO: 505632 - DNA, 597 bp, Homo sapiens
  misc_feature (54)..(54): n is a, c, g, or t
tttggggctccattcatgggtaaggagatgggaacggttcatggatggcgcccnaacccgaagctcgggtacacctagtttggcctttcaggagggagtcctgtatgatagggaaccggggagactgggggaggggtgaaaagatgctgaggccagctcggaacttctggatggtaccacttgccttgaaccaagggtgcctcttctcctgcggggtctacaagaaagtcatggctcagatgttcccaggggggggatgtaaacatacccaggatcttttgcaagtgaagacccagtgccaatgtccttccttatgggagggcgggaacaccgtcaagggatggttcgggtccatcgtaggtacggggagagagaaagtcgcaggctcaaatagattaggttcggtccggaggaccttccaggcgtgtagagatttcctcatcgaggaagctgatgtggagggggaggtcaaggtccaggtcatcgatagttccatattctcggatggatacagagttcgcacggtagatctccttcagggattcaaggtctgcatcaagcggtgggtgtcgagacaggtcagttgcacagctccct

SEQ ID NO: 505633 - DNA, 282 bp, Homo sapiens
  misc_feature (59)..(59): n is a, c, g, or t
  misc_feature (101)..(101): n is a, c, g, or t
  misc_feature (270)..(270): n is a, c, g, or t
catagagaggcaaaaaccccagaataatcaataatacaatactgaaggaggaaaacagnagccagaggcctgccgctgtctgactttgagacttactctgnagctacaggaatcaagacagtgtggtattgtgaaagaatacacaagtggatgaatagaacagaatagagcccccagaaacagacatatagagagacattttttacaaaggtgcaatgataatatgatacagcaaagatagtcttttcaacaaatggtgctgggacaacntgaatatccaca

SEQ ID NO: 505634 - DNA, 942 bp, Homo sapiens
taggcaacatacgtttttattactcaaggacaaccgggacgtcaccaatgcccagtttcacgggggcatgtagtgtgactcagggctgaacacaaaatcacgtggtgaagccgtgtgctacagcccgtgggctactttgggacacgcaagaggacactcggttacttgaaaccgtgactgtgcttctgaagacatgtgatacatgtcttttcccgtgaaaatgtttccccttccctgtctggccatgctcccaatctttttctggccttaccaggggcttctcactggtctggggtaaactaaggtctaggggcctaagtctagaccttgggtaagtgggccccttctgccacaatcagtgcctagggcctagaggtctgagcttgtgggcctccgaaagctctggaccttggctcggagctacgtctggtgaggcgcccagggatggcctggtcttgcaggccaccactatataggccagtctcgcaaggtcccccagtaaaagcctgaagcacactggcccgaggtttggaggctgggtagctgctcgaacattacgggaggatctcgaaaatcctcgactactgtgctaaggaactgaaccagtgacacttacaggccataacttcagctattcccagggttcacctatttgcgaaacaggggtcctggcatcttgtacaccccaaggttgggagtgcaggtccataacaatccatgcactccatgggagccctcgaacctcaccaagctataaaatgatccctcgcataactatagaacttcccccaagcaagctgggagaccacaaggggcgtgcgactaacaacgccaggccataacaagtttatagaaaacattttgtgggaaaaaaccgcggtcctaactcaatgttggcccgggagggtctagaccatatggggctccagggaaccctcctgg

SEQ ID NO: 505635 - DNA, 148 bp, Homo sapiens
atacctcacaaacagccctggaaaacctgttcacagtacttcagtgcatggtttaacttctgaaaagctcgtgagcccaggtctctccttctgaagtcaggaacatctggatggcaatggcttggccttttacattattatccctcaa

SEQ ID NO: 505636 - DNA, 702 bp, Homo sapiens
gccggagacaaaccggacccggcaaccagccatgaacagtagaggtcaatatccaagacagccaacctatcctgtgcggcctcctgggaatccagttgataccctcatgacctgtgtcatcttcctcacggctccatccctataccgagtgcatcctagctgcctactcagtagctctatcgtccgagctttgtgcacccgaggggctgccacgagtccccgaccatgtcaggcgcattgcctggagcctctctgtatcttcccatggccagctctgtggctgttgggcctgtaggttccacgaatccccatggcttattatccagtcggtcccatctatccacctggtctccacagtgctggtggaaggagggtatgatgcgaggtgccacgatttgtgagctggtggctactgctgggaacctggcctcctcctgctcctggatgccttccggtctgctgctcagtttgccgccctgcaggtggttctgcgtcctcgttactcagtggacggggaacgttcttcattggagtgggacagatgggggctaccaccatcctggttgagggaaccaaggccatctttgtgccggcgaaagacgatcacataccttcagcacttctcacaatgtacactgctttagtcatattcacctgaagttgcagtttagacacatgtgttgcggtgtcttgctggtgtcc

SEQ ID NO: 505637 - DNA, 106 bp, Homo sapiens
agatagcatagagtcagtgggactcatgtctgatcaggagtaaaaagagttgtttaaagaagctccattatccgagattttttctcgatcctggaacaatgtgtcc

SEQ ID NO: 505638 - DNA, 1305 bp, Homo sapiens
ttcggtctgctggtacgtgtctgcatggttcatggtttgtggttacacatcttctagcttactgggttctgggacttttggggactggaccgctttgtgatggggaggcctcctttctgatggtgactttgctctcttctaggatgggggtggatcgtcgcttgttggggcgccatagaccacttggggtgtttggagccgcctctcgggtgtccacggcctctccctatgttctccccctcctggatccgtgggtgtctacctggcgcgccgtttgtctgtcgccttagatgtgttcggttgttgtctaatttgtgagcccccctgtgggggggccgtgttttaataattggatggggatgttctcttctctcctgcgccatcaatctggcctccgtgtcccgttctcctcgcggtgtgttgtctctcccgcctgtttctcctggttttggggtatgggagggtcccccttttatgtcgcctatttttgttacgtcgccacattctctcccgtttccttccccctgggggggttgggctttcacggggatcacctgtccctttgatcgggggtattttgttgagagtgttttccgcgcgggttttatttttccggagctccgtagatgggggtccccgtttgtgcccttgtgcccgtgctctttatgatgggtgatatctttttggggtgcactcaccgtgtggtgtgaaatgtccctcgttcacactgttgggacacactgtgggtcctcacgtccccgcctccagtggcttctccccctctcccacagtgcgccacccactgggggtgggggcccccggtgttgatgtctttttgtgggcgtacaccaccctcggggcatcgtgggcccctcctggcaccgcactcttgtccacgcttctccctcggtaccaccggcttgagtgtttttcaccgccaccccccagcgagatgtgctcacattgcttacccgaggctgtcgtcccttccgacgatcccccgcggtttgtggcccctgggaggccccaaggatctcgcggcgacctgtggtatcccgcgaagtacgagttccctttgtgccccgcgaggaacccgcccgctgagtctcttattgaaccccccgctggccaccccctccccgcgtgtcctccaccccccatgccccaccccacgagtcggctcacgaacaaatggggataccccgggccacatttgttatatgtcctccttatctggggtttatttattaagtgtcaccaggtttttttataattaaacctaggtgatttcccccttaacaaaca

SEQ ID NO: 505639 - DNA, 113 bp, Homo sapiens
ttgttaactgattgtttggttggtcgttcggttcggtaaaccggtttagctccctaaaaggcggaattccgttttcaccgattcggggataccgcggaataaactttttaccg

SEQ ID NO: 505640 - DNA, 618 bp, Homo sapiens
  misc_feature (142)..(142): n is a, c, g, or t
  misc_feature (145)..(145): n is a, c, g, or t
  misc_feature (197)..(197): n is a, c, g, or t
  misc_feature (211)..(211): n is a, c, g, or t
  misc_feature (216)..(216): n is a, c, g, or t
  misc_feature (220)..(220): n is a, c, g, or t
  misc_feature (225)..(225): n is a, c, g, or t
  misc_feature (227)..(227): n is a, c, g, or t
  misc_feature (251)..(251): n is a, c, g, or t
  misc_feature (273)..(273): n is a, c, g, or t
  misc_feature (553)..(553): n is a, c, g, or t
  misc_feature (558)..(558): n is a, c, g, or t
ggcgaggagactcgtggtctggttctgggacttccctaacagcatggcccctaaacgccagtctccactcccgcctcaaaagaagaaaccaagaccacctcctgctctgggaccggagaagacatcggcctctgcaggcttncgnaagaagggaggaaaagaacagcaagaagcgattgaacacattgatgaagtanacaatgtgatatanacgantttntgtgnanaacccatgtggggagattttgaangtggcacagaatttttccaaantccgccaaccattttttcagaagaggtcagatttgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatcctactttgaaaataaagttctctccaagaatttcatctgaatgagagtggtgatccatcttcgaagtcaccgnaatcnatggaatctggaaggatttgacgaacgttcgagtcaacgcgaataagccgcagaagaggc

SEQ ID NO: 505641 - DNA, 1595 bp, Homo sapiens
  misc_feature (1210)..(1210): n is a, c, g, or t
aacaaaccctgaagagtatacaacatagaaaccatggcaaatgcaatcgactactttgctacgaagaaagattcctttcctgcatctttcatagtttctcgttaaatattttggtcacatcgcttcttttctcaacaactagttcttacgcgaacagactctgatgccaagtgtcttctgtatctgggaggtattggacgcggaaacaaacattgcatggatggctggaacactgtactgaggaatgactcagacaaggcttccagatgtctaaacagattctttaaactactgaaactgttacctaggttaacaaacctgattgaaggtatttcgctgtttgtcccagttcagcgaatttctaggtaaagtattggtctatatgtgcgggctttctccagaacgcacattctcatcagttgtgaccagaaaaacaaccatgttctcatcgggtagccttcttaactcttttagtgcacacacaaaacacattaatctaggcctttctcaaacttccttattttcaggcccaattccccctctcacaaaaagctccttggaaatacagcacaagcggagtactatacgggggggtacgcacaccggggttgaaaaatcactccttagacccctacttatatgacagttcaaaatcggctaggcacagaaacgttcagaatcggaaagcgacacacacaaattataaataggcccactgtgtaatctttcaccgctcaaacacattcaacaagcatctctcccaaccaaaaacatcacctctagtgctctggtctaagacaccacaagggttcgccacggctcacggatcgcaccatagagtagtccctcgtttcaactaaactggaggactggcgacaccaacccacatgtgagaataacagcagcaacactatatggcgacactagtacgggtgtacaccacaagatctaacaccacatagaccccagcgtgcaacgagacgagaccgcctccccacaccaatcatcacaacgcaccactaacatcaccttggaccgaatacatatcggacaacacaacaacaacaacaaaccaaaaaccacaacataacaacgcaaacagcaactacaaccaaacagaagacagcaacaaacaaccagaaacaaccacgcaaaacaaacgaggatggggggaggcgtcagaacacgaagatcatagtcacgaaggagngaggcgagccaatatacactgtccacaagaccagtctacattagtgacacagagcggagcgccatataaagaagaagagtcacattatcataagagtcggatgaacggagcgagattaataaacaagtagtcggaggcaagcaccaccccaaagctgccttcaagtagagagaacacacacattcgaggagactaaactaagcaaagccaacacagacagtaaacggaagtcaagagattaatatagtgattattgttcgaacgctcccgctagcacagtcagaaagtcatagtaaaacatcaggagagatcatcatagcaaactatgagtaagcatgagataaacaacgaccatatcgcggagaacccagagcccgtacgcggc

SEQ ID NO: 505642 - DNA, 301 bp, Homo sapiens
tagtgcatagatttcactattccactggactatcgcaacaaaataagcaagactatcttcggtgaatcagccacacgtgacgaatcaagtacattctgtgggatcataccccaacatgcagtgccatctatcccagaaatacagcagcataggcaaaatagtcagcaatcacccaccctcagggccacacatgacactatgagaagaatggcactctgagtaataaatgtgactgaaatacaaataaaatgtgtggttttccagactcacaaagtcttggccgccacaactgtgcacaaac

SEQ ID NO: 505643 - DNA, 185 bp, Homo sapiens
gtcactaagcagaagacattctgttgataaccaggttgtcctgacgaggctggacagaagctgagcgaacaggcggcaaggtaggacggagatagaatgtgagaggccccagatactgtcgagcacacacagaacaccttgagaaataactctcgattcaatgctcctacacatgaagccgctga

SEQ ID NO: 505644 - DNA, 127 bp, Homo sapiens
ggtggatctagaggatcccacatggaatggctatttaagttatattgaagttagtttggctgcattttgcctgggttttaagtatttgagggattatgttcacaaaatattaaacagggtcaacaga

SEQ ID NO: 505645 - DNA, 137 bp, Homo sapiens
ttaagtccgtaccaacacgcagggcacacatgtgcagcacacgcacatacacacacacacacacacatatatacatatatatatgtttcatgttggtcattctatagacaaatccagatgctagacatacctaagcc

SEQ ID NO: 505646 - DNA, 120 bp, Homo sapiens
cctgcatcctgaacgtgattcctgcttctgctttcttccttccttccttccttttatccttcctatctttttttcttactctattttctttctttcttttttcttactattcttatcttt

SEQ ID NO: 505647 - DNA, 106 bp, Homo sapiens
ccccatcaatcgctggagccatctgcctccttagggactggcattatttcttcatccttattggcagagtaatggtgacagcggcacagaccctttgccaaatgtg

SEQ ID NO: 505648 - DNA, 137 bp, Homo sapiens
ccttgatgtcctgctataacctgctatctacacaagcagccagagtgattctgtaaaaaagtaagtcagcgcccagatggtagtttctaatgctattctccaatcaaaggaaccagggctccttagacgaaatggca

SEQ ID NO: 505649 - DNA, 153 bp, Homo sapiens
gtccatagagtgtgctacataaatgctgatcagacaaaggtgaatgaatgaatgatacaatctggctgtagttgatggaaacagctcgggggtgccacacactggactcccactgcgtgactcttcagatcgtgtgacaggagtctccgtctc

SEQ ID NO: 505650 - DNA, 992 bp, Homo sapiens
  misc_feature (897)..(897): n is a, c, g, or t
gagcgggaaatggagtggtggtgtgtgtctaacctaatggtctgcaacctggcctacagcgggaagctggaagagttgaacggagagtattctggccgataaatccctggctactagaactagaccagtgacagcagaactgcattgcactggagcatgctcagctggatcttatcagaaattgtagaatatctgtagcaactatggagtgccagtgaactgataacagacgatgcaggttggtctcctacttcatattgcggctactgctggccgggcatgagattgtacaagcccttctgggaacaaggtgctcaagtgactgctgtcaatcacaatggctgtacatcccgttacattatgcagcttcgagtaaacaggcatgagatcgctgtcatgttactggacatgcggggctaatccagatgctaaggaccactaatgaggcatacagcactgcacccaggcagcaggcaagggtaactttgaagaatgcattgcaatatccttctgtactacaaagcattccaccaaagatagcaaaggacagtgaggggtagacaacatcctactacactaagcacctggtgactgagtgaagagagtggcaagaaggcacaaaccggcatgggtggtaccccagaggggcagccacaggaagacacacaatacgacgaacataaacggacccgaggagagcaaggaaccgtcgttgaacaaagagttgagacgcaaacggggtgggcaccggggaggttagaaaagtaacagacccacaggaagcaaaatggcgcaggacaaggggataaaacaagacaagcagaagaaggaatagaactagccaaagacaacggccaagagcgatggacgagatgaacagggaaagccaacaagagnggtacaccaacaccagaggccaacaggagagtagcggagcgcaaaagaacaacaacacaaagacaagatgacagagagagagacaccgcacagcc

SEQ ID NO: 505651 - DNA, 119 bp, Homo sapiens
  misc_feature (110)..(111): n is a, c, g, or t
cggccgtaatctattctttgcaaataacaaaaaggacaaaaactacaattacagtaaaacataaagtagttctcaagtggaaaagttatcattcccacagtccttgagtnngttccttc

SEQ ID NO: 505652 - DNA, 681 bp, Homo sapiens
ccggctttacgtagcacctcggtgtactgcagcaccctccgcttcctactcctaggcgatgagagccagtggctagaagttcaccatgtctattctcaagatccatgccagggagatctttgactctcgctggggaatcccactgcttgaggtttgatctctctcacctcaaaaggtctcattacagagcattgctgtgcccagtttggttgctatcaacttggtatctatgagtgccctataatgctccgggacaatgataagactctgctatatgtgtggaacggtgtgtctcaaacgtgctgttggacgcacatcaataaacactattgctgccttgcccatggattaggcaacagaaacttgaacgtcaacatgaacaatgacgacagatttgcacaaacttgattgatctgaagatgtgatggacacatgacaaatacaatctagaggttatggattgctgaactgccatatctgaggtggttgtccacattgctcgtcttgcaacttgctcgtatgccatgttgacgaatggagggtccacccatgatacacgtccacactctgcatgaacttgagcatggacacctcttgaagtcaattcctgccaatatcccgggagttacaaatgtaaatcaaatgtgcggttctctttggttgaaaaaacgatggccatgg

SEQ ID NO: 505653 - DNA, 132 bp, Homo sapiens
ctagaggatcccgcttcggcgctaacctcagttcgcgtttactccctttattctctccacccagaaaggtgacaaatccaagccctggatgtgaggggagaatatgagcgaaggaaatggttaggcccgaag

SEQ ID NO: 505654 - DNA, 100 bp, Homo sapiens
cacgggcttatgatgtatcgcccaacacccgatcgagtatttggacatcaccctactgaaaacttgcgattcttcttagttttctgcatacttttcatca

SEQ ID NO: 505655 - DNA, 192 bp, Homo sapiens
ggggaccgtatgtaggagtttaagattagtccgccgataatctgtgtactcgtacgttcagtaccattggtggccaattgcatttgatggtaaagggagggatcgttgagcctcgctctgttatgtatcaggatgcgcttaggattgggacgcggcgattcaggactaggcatgatggacgggcaggtatac

SEQ ID NO: 505656 - DNA, 271 bp, Homo sapiens
tatgttacccagactgatcttgaactcctgggctccagtaatccacccaccttggctcccaaagtgctgggataacagacataaaccactgggctctgccagtttcaaaagtatctacaatgacagtgtatacgttaatacacagtatgtaaagtaagtttataactagagacaaggtctcactgtattgctcaggctagtactatgacctcctgagcttaagtgatcctaccaccttgggctcccaaaatgctggacttacaggcatgag

SEQ ID NO: 505657 - DNA, 749 bp, Homo sapiens
agcggggagctgactctctcccggtcggcgggcggttaggggaaagtacctggggtgaaacggtagaggaggtcaaggggaccctgggggatgcccctaggggctaccagggttcgaactgcacagtgacatggtcaggtcgcgggtatagccaagtcttctaggctgcatgactgggtcgggtggcctaggactgctactgctggcattagccagtgagacgatcctgtggctcgtttgcgcatgggacctctggacggccctcgtacgatacgtcgacaagctggacaaggtgcatggacgaactctgtgtaagaatgcaccagttgtggaagcagattgaggactccggtcatgattaactggagtttcaatggatcgacgggctggcgacaggagagaccccgcgacggcttgcacaggcagcagacagcggactggtcgagacacgggcaacccaagagtgccaggaccatcataaagagaagcgtgacaagagggcgattgagaaccagttgtggggcagccatggagcaacctggatgcccctccgtgtgagctggtcaaccccggagaaacagttcatgagtggactacatcctgagtgtgatgaacgtggctgacgtttgacttccctcccgaattctatgagcatgccaagggtctgtgggaggatgaaggagtgcgtgcctgctacgaacgctccaacgagtaccagttgattgactgtgcccagtattactggacac

SEQ ID NO: 505658 - DNA, 170 bp, Homo sapiens
  misc_feature (37)..(37): n is a, c, g, or t
tctagaggatcgccgggagcttaccttggagatctgnacttcgtggactgtggacttctccataaccctcccatgttctgaatgaactcctcggcttcctggaatcagctcctctctggaaagttctactccgttctcaggagccactggaagacctgacttttctgcag

SEQ ID NO: 505659 - DNA, 244 bp, Homo sapiens
aaaaaaaggccggggtgggcccaaaatcctctgtctatattttatttaaggaacaaggtttggctccttttatatggggaaccctggaacagtgagtcatattttaatatatttttaaatgtttggcatgtaaatgtaaactcagcctccaaatatttcagtgaatttgccctgttttatcatagttactgggtaaactcctttgaaatgtttccaaaattaactattaaaccaaaatttttta

SEQ ID NO: 505660 - DNA, 157 bp, Homo sapiens
gaggagggagtgggggatcaggttggagggcgcgagtcaccattgaggctgaggaacgattctctctcgtggggtcaagactagcccaggaaacagggcagtcgccagcgtgactggaaaaggagacctggggcagctgggacggcagtgttctcca

SEQ ID NO: 505661 - DNA, 302 bp, Homo sapiens
attaagaaaaaagagagtccactgaatgcatcatgtgtattaatgcaattaacatttcaaaaccacattaaaagggaggatatctaataagataactatttaatcaacccctctgaaacaatattattctgcagataaaaatacatttcttgtatatacatgtagagttctacatgaaagaaaagattcatcttcatatataaaaaggatgacccttgataaatacatcttatattgccaaactgatgtgattaccactgtttgaactataaacagaaggattaaacgattaagttattgga

SEQ ID NO: 505662 - DNA, 90 bp, Homo sapiens
tcctagggaggtattactcgtaatgtcacagtgggtgttcaccctgtgatgtcattcttatttgaccttggcgccttttttaaaccaccc

SEQ ID NO: 505663 - DNA, 561 bp, Homo sapiens
gtgccagcttactcttcactccaggtcggatgccacgtgctacaggacatgggagctgctgcttgtgggaatctggtgcctgttccactagagacaaggggtagagtttctcatttggatgaaaaccccttcaactggtggtgtacaactgaagctactatatctttttttgaaaatggcaaaaaaaaaaaaaaaaatttctggaggaccacagaaactcaagtgtgtgttcctcctctttggggccccctttaaagtagtggggatatttgggccctggagataccaccagtttacccattcctttaccagggaattgttgccatcaattcccagttgaaaattaattagaaaagactgaatttttatagtgctccacttaggcttacattgtgagttagactctaaaatttctgccttgctaaagtttctaacactgcctctcagattccagtttgggacattgcacaattaagaccttttaaacgctttggcttgctaactcggaagacacattagtctgcagcaagactttcctatttttgaagaactgcgagaaat

SEQ ID NO: 505664 - DNA, 117 bp, Homo sapiens
atcatagaacatttacagagagaaaccagaaatggcgtgagaagaaagaaacagacactgtggtagaaggaaaaaggaggctagcactgtgagtgactttaattccctaatctccag

SEQ ID NO: 505665 - DNA, 572 bp, Homo sapiens
  misc_feature (163)..(163): n is a, c, g, or t
gtgttatccaagtccgcactgcccttccccaaggcaagcaaaaccttattgtgtttgggagtccaaagaaggagaaattcccctggctcggtggtatggaacgccaccggatggacattccccaaagtggaccgcggttttgttgggcactggggaaccgttntgtcccaatggtctgtggggtggaaccccaagcaccccaataccctcagggtggctggtaaaaagaccgtgttacccttccaccctgttttgcaaaggcccatccagtgtgcaaaagccgaggccggggaaggagtggggcccacccccatcacctggaattgcggatggtccaaagcaaaagggacatcgaggacccaaagattgtcgtccaggccccggttctgtgagggcccccccgctttgcccgtaacacacagggcggttggtgtctccgtggtttgtccctgtgaaaacatgtaacgtctgccttagagccatgcccgaaacttgatatttttttctttcatgaggggccggcatctgctggttttcattgtgaaacgggccagtcgtgctttgtgaaaaat

SEQ ID NO: 505666 - DNA, 150 bp, Homo sapiens
caatctcgagcatctcaaaatccatcctgcagtgacccctgcatggagacagagccctccttcgtagactggagacctctgcaatgcctcgcgaagacgtgatagaggcccaggctgtgaccaatctcatggggccattcaacgcctccg

SEQ ID NO: 505667 - DNA, 738 bp, Homo sapiens
  misc_feature (33)..(33): n is a, c, g, or t
  misc_feature (321)..(321): n is a, c, g, or t
  misc_feature (479)..(479): n is a, c, g, or t
tgaggaagtggctgctgctccggcgcggagccnagagccggttcggcgcgtcgactgcccagagtccgcggccggggcgcgggaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgatgctcaaggagcacaacgggcaggtgacaggcatcgactgggcccccgagagtaaccgtattgtgacctgcggcacagaccgnaacgcctacgtgtggacgctgaagggccgcacatggaagcccacgctggtcatcctgcggatcaaccggggctgcccgctgcgtgcgcttgggcccccaacgagaacaagtttgctagtgggcagcgggctctcgtggtgatctccatctgttatatncgagcaggagaatgactggtgggttttgcaagcacattcaagaagcccatcctgctccaccgtcctcagcctggacttggcaccccaacaatgtgctagctggctgccggctcctgtgacttcaaggtgtcggatcttttcagcctacatcaaggaggtggaggaacggccgggaccaacccgtggggtccaagatgccttggggactgatgtccgaatcagaagtagttgctgtggtacatggcgctgtctcaacaag

SEQ ID NO: 505668 - DNA, 1429 bp, Homo sapiens
  misc_feature (33)..(33): n is a, c, g, or t
  misc_feature (418)..(418): n is a, c, g, or t
tgaggaagtggctgctgctccggcgcggagccnagagccggttcggcgcgtcgactgcccagagtccgcggccggggcgcgggaggctggagtgtggtgacataccttgactcactgcagcatctgcctcccgggttccagtgattctcctgcctcagcctctcaggtagctgggattacaggagccaagccgccatggcctaccacagcttcctggtggagcccatcagctgccacgcctggaacaaggaccgcacccagattgccatctgccccaacaaccatgaggtgcatatctatgaaaagagcggtgccaaatggaccaaggtgcacgatgctcaaggagcacaacgggcaggtgacaggcatcgactgggcccccgagagtaaccgtattgtgacctgcggcacagaccgnaacgcctacgtgtggacgctgaagggccgcacatggaagcccacgctggtcatcctgcggatcaaccggggctgcccgctgcgtgcgcttgggcccccaacgagaacaagtttgcaatagaacgagcatcacacttaaaagctaccttactagaataatctataaaaaaaaacaaaataatattagcacatactagtagaacccttgcactacctccttctgaagcagactaacaccccagggataaacaatcaattcgatctcaatatctaaaactatctggagacggatactatataacatcctaacatacaaaagaggttggaggaaacggggccggcacccaccccgtgggagctaccaagatgccctttatggggaactggatagtaacgaataccagcagtagctagcggctaagggtacatagacgtactaaatttctacatccagcgaggagagccgcgtaggcctgggtaagccacgacagcaccgtctagcctagggctggatagccgacaagaagataggccgtacgcgactactaggcctactagaaacactaaccacttgctaggcgctgacctatcatacacagacaacagcctggtggcagcgggccacgactgctaacccggtgctagttcacctatggacgccgccgcggggatagctagagcttcggcgggcggtggacgtacctaagcagagctacgcagcgtggctagacggccgcgagcgcctccagaacctggacaagaaggcgagctccgagggtggcacggctggggcgcgggcctaaatcgctgccaagaaagcgtcagccaaacatcgggtcacggggggaagccatggcccagttgcaccctggctggaggggtgagacaggggtggaaacggggggcctgagacccaaaaaccgggggaatggcccccaacgggaggggaggaagggccacaaggccagagggccacccaggcgcccacagaggagggccaaaataattaaac

SEQ ID NO: 505669 - DNA, 820 bp, Homo sapiens
gcttccatccgttcgcgcagaccctgccggatccgctgccggtatggatgatcgagaggatctggtgtaccaggcgaagttggccgagcgaggctgggcgagtacgacgcacaggtggtggcagtcaattgcaacgacatagtagcagggatggatgtggagctgacagttgacagaatagaaacctcctatctgtagcatataagaatgtgattggagctagaagagcctccgtggagaataatcagcagcattgaagcagaaagaagaaaacaagggaggagaagacaagctataaatgattcgggaatatcggcaaagtggttgagacgtgagctaaagttacctctgttgtgacattctggatgtactgacaaatcaccgtcattccagcgagctaacactggcgagtccaaggttttctattataccacactgaaaggggactaccacaggtatctggcagaatttgccacaggaaacgacaggaaggaggctgcggagaacagcctagtgggttataaagctgctagtgatattgcaattgacagaacttccaccaagggcaatccatatttggcttaggtctatgcttctcaattgtttccgtatttctaacctacgaaaattctttatttccccctgaaccgtgcctgcagggttgggcaaaaagcagatttgtggatgaatgccattgcaggaaactgggatacggctgggttgagagaaaagggttaaggacttctacacttaattaatggaggaggttaccgtggataaatctgaacactatgggattagaaacatgtaggggtgaacg

SEQ ID NO: 505670 - DNA, 748 bp, Homo sapiens
  misc_feature (9)..(9): n is a, c, g, or t
  misc_feature (16)..(16): n is a, c, g, or t
  misc_feature (79)..(79): n is a, c, g, or t
  misc_feature (112)..(114): n is a, c, g, or t
  misc_feature (116)..(116): n is a, c, g, or t
  misc_feature (118)..(118): n is a, c, g, or t
  misc_feature (140)..(140): n is a, c, g, or t
  misc_feature (175)..(175): n is a, c, g, or t
  misc_feature (184)..(184): n is a, c, g, or t
  misc_feature (186)..(186): n is a, c, g, or t
  misc_feature (356)..(356): n is a, c, g, or t
  misc_feature (473)..(473): n is a, c, g, or t
  misc_feature (739)..(739): n is a, c, g, or t
  misc_feature (743)..(743): n is a, c, g, or t
ttttttttngttacgntattaagtagatgctcttgcacagaagatcagcatgatatctataagtacatagatgcagacnatccacctatagctagcttcttcttctccactnnncnanttcacacacttgaatgactgcnttcatgctaagcactgcggatccacagagagaganagtgtgtcnanttagctcacgtgtcatcactcttgttgaaaatttaagaagaaaggcttcagcggtagtacacatttttacatgtcctcatagcctttcctactttactcagggtcaaatctgtagagtccagacggcattgatggagcatcctggagtttatagaaggttgtctgtctgnagctgggaaaagtccacagactaggaaaaggatatatattattataaggaattggcttccatgattctaaaggctgagaagtctcaaggtctgtggtcagcaagctggagacccacncaggagagccaacggtgcagttccagtctgagtctgaaggcctttgaaacacgtagtgatctttcagtagatttcatttttccaatgttgcttcatttcaaagcacaccaactgctctggcttggctttgctgaaccatttaacacccacttgcatctcagaaagtttcagggaaagctccactttggtttcagtcatcatctttggaagaaaaggaagttggatttttccattaacacctcacctcgtgccgaattcctgcagcncggnggatc

SEQ ID NO: 505671 - DNA, 192 bp, Homo sapiens
tggatcaagcgtatgatattctgggttgaaaactcttggctttcttttctgtggagacagagtttgctcttgtggcccaggctggagtgcaatggcatgatcttggatacctgcaacccccgcctcccaggtccaaatgattgtcttgcctcagcctcctgagagtagctgagattacaggcacccccacca

SEQ ID NO: 505672 - DNA, 205 bp, Homo sapiens
agcctggtggtatgggtggcatatgcaggggtgtgtatgtaggtgtatgcaatgtaggtgtgtatgtgtcaggtgtcagttgtgtgtcaggtgtatgcagtgtgtaggtgtggtgtgtgtaagggtgtgtgtaggtgtatgcagtatcaggtgtggtagtgtagtaggtagtgggtagtagcatgtagtgtgtaggtgtagtgta

SEQ ID NO: 505673 - DNA, 460 bp, Homo sapiens
tcctcacttccatgtcacaaccctagcagcggtgcagcatgctgtctccaacccttatcccaggtttaagggtggtttatggccatacgtggaggttttttgttgttgtttttgagactgagtttcactcttgttgcccaggctggagtgcaatggcaccatctcggctcactgcaacctccacctcctggttcaagcgattctcaggcctcagcttcccaagtagttgggattacaggcgcctgccaacacaactggctcatattgtatttttagtagagatggggtatctccatgtaggtcaggctggtctcaaaatcccgaactcaagtgatatgaccgacttggcctcccaaagtgctgggattacaggcgtgagacaacgaaaccagaagagataaataatgaaaaattaaataatattctagtatgaagtgaggaggatactgaacaggatgtg

SEQ ID NO: 505674 - DNA, 231 bp, Homo sapiens
  misc_feature (201)..(201): n is a, c, g, or t
gaatatgctgtccccaagcagggctagaccgtcatctcagaaaacttagcagagtgggagcaaaccgcaccgccccagcaggaacatgcccatggagaggccttccctgagcacgagcaggggcctcctaaggcagtaggaaacgtgagggaagctgctgtagacgaggaggcctctgcctctggtgcccgttggggtcangggagaaaggtacagggtatgacgcgctgg

SEQ ID NO: 505675 - DNA, 694 bp, Homo sapiens
  misc_feature (9)..(9): n is a, c, g, or t
  misc_feature (16)..(16): n is a, c, g, or t
  misc_feature (79)..(79): n is a, c, g, or t
  misc_feature (112)..(114): n is a, c, g, or t
  misc_feature (116)..(116): n is a, c, g, or t
  misc_feature (118)..(118): n is a, c, g, or t
  misc_feature (140)..(140): n is a, c, g, or t
  misc_feature (175)..(175): n is a, c, g, or t
  misc_feature (184)..(184): n is a, c, g, or t
  misc_feature (186)..(186): n is a, c, g, or t
  misc_feature (356)..(356): n is a, c, g, or t
  misc_feature (473)..(473): n is a, c, g, or t
  misc_feature (685)..(685): n is a, c, g, or t
  misc_feature (689)..(689): n is a, c, g, or t
ttttttttngttacgntattaagtagatgctcttgcacagaagatcagcatgatatctataagtacatagatgcagacnatccacctatagctagcttcttcttctccactnnncnanttcacacacttgaatgactgcnttcatgctaagcactgcggatccacagagagaganagtgtgtcnanttagctcacgtgtcatcactcttgttgaaaatttaagaagaaaggcttcagcggtagtacacatttttacatgtcctcatagcctttcctactttactcagggtcaaatctgtagagtccagacggcattgatggagcatcctggagtttatagaaggttgtctgtctgnagctgggaaaagtccacagactaggaaaaggatatatattattataaggaattggcttccatgattctaaaggctgagaagtctcaaggtctgtggtcagcaagctggagacccacncaggagagccaacggtgcagttccagtccaatgttgcttcatttcaaagcacaccaactgctctggcttggctttgctgaaccatttaacacccacttgcatctcagaaagtttcagggaaagctccactttggtttcagtcatcatctttggaagaaaaggaagttggatttttccattaacacctcacctcgtgccgaattcctgcagcncggnggatc

SEQ ID NO: 505676 - DNA, 402 bp, Homo sapiens
ggaccccccgcgacagagttgtgctcatcaagtgagacttttcttccgtgttgttttggctgtgttctgcaagttaaatgtgtaaaagcacttcttttttccccttttttttttccccctggggaaaatctaaagtcttcaagaatccttgaggaattcaagttctgtcttataaatagaactaaccttgtttcataaattagcatctgaaattaaattaggcatccaataaatatttgctgaatgaagtagactttaaaatctaaatatgttaaatagggtttcctgtttaagactattttctattataaaattaatacctgcaaattttaaaggttttagtgtctttaaaaaatatttcttacaatcaaatacagtgttcttcaccaggggagttctgaa

SEQ ID NO: 505677 - DNA, 370 bp, Homo sapiens
cgatgacttcctcgtcatggctcgcgctcagggggatgacaccagtgccgctgcgcgctcaacttatggacggccacgaggcgcgcactgacaaacgaggctggtacctcaacgccaagcattccctcgccatcggagaaaacggggagtactaccacctcgtcgtccccggtggtttcgctgcgcgactgcgtggggtcaagcttcacccttccctgcccccgatgcatattggcagaggcggtcgcgacggtgagactggagaacttaaagagttcctgacgtggctgattgactctcgttaggcttcgacggcggccggggtgtgacgctgaccacctagtcgacggcgtctcttggacctccagta

SEQ ID NO: 505678 - DNA, 223 bp, Homo sapiens
acagcagttaatacagactcagcagatgcttagaatttgctgcatgggttaattgagaatagaaatttgccccgtgggatagtgcacacacctcagtgctagcctcacgaaagtggaatacgccttcgaaaagaatttgtccttgaagcttgtatctgatatcagcagtggattgtagaacttgtagctagattgagaccttgtataggaagttaacttgtgc

SEQ ID NO: 505679 - DNA, 102 bp, Homo sapiens
actctgctgcggattgaccgaaaccgttggacgccgcagtggtggtcaccgaccacagcacggtacctggtggtgccgaagcgtgtttccttgtccttacca

SEQ ID NO: 505680 - DNA, 230 bp, Homo sapiens
ttgtttaggaaatgtctagacagcgcagttggattcccagccaaagctccataccaaagaatggctggggggggacaattggaaattcaccacatggcccgtgtccccctagtactggtcaagaactgaaaagaaatggagcatacagattgcacccaaggctgctgaggctgccagagctaccaccagtcttggactacctttagacagttcacatgaatgagaatggc

SEQ ID NO: 505681 - DNA, 546 bp, Homo sapiens
cattgctggcattagagtctgcggagggctcgggggatgccaccttggaagtaagccacgatagctccatagtctttgaacaattatagtgtcactgctgtggccaatccattgagacttcagtggatgaagctgcatatgagtttcgataacatccgcgagggttgagttaccagtgaggccagaataccagcaaatatcccacagctgaaatttgtaataggaataagggttgcatccacctggtcatgaggcactatatttttggtctggttgtaaaacatcaggtagattcctgagaagggcgcatctcgaaggagagttgctgtcaggccactgaagaggccccggtgcccctcactgtgatagatgctcctcagggcagcgtagatactctcatagccatatttcccactctcatagcgcgtcttgattacagtgataggtgacatacagacccctgcaacagagcgagagcccacccccagcatgactgactccagggcggttgggggatggcctcgcaagaaatactgcttcaaagag

SEQ ID NO: 505682 - DNA, 322 bp, Homo sapiens
taaattcgcggccgcgtcgacggtcaccagtaccattacctcttctagaataagcaattaccatgttttttttaaaatccattttaccgccacgtgaggtgactcatgcctataatcctggcactttgggaggccaaggcaggtggattgcctgaggtcaggaattcgagaccggcctggccaaaatggtgaaaccctgactctcctaaaaatacaaaaattagctgggagtggtggcacgcacctgtaatcccagctactcgggaggctgagccaggagaatcactttaacctgggaggcggaggttgcagtgagccaaga

SEQ ID NO: 505683 - DNA, 265 bp, Homo sapiens
tgggtttaaagggggggccctttttttttttgccaggggccctttttcccaaaattgttgggttgggccggtttgccccctttttttaacccaaggggggtatttttttggggtatttttggaaaaaaattggctggtttttccttcctggggcctttttcaggggtttcttgggaaggggcccttttttttttttgccggaaaggttggtgttttttttggtaaaatgtttttggtttccattaaatggttacttgcccgggga

SEQ ID NO: 505684 - DNA, 740 bp, Homo sapiens
  misc_feature (703)..(703): n is a, c, g, or t
tcaaaactccctttacctcacctcaaatgacttttgaggagggctagagtctcctggtctggcactggcacctggtcaggaactcggagcccatctctggggtcactaacaggctgactggaaggaggcagctcaggcctcactgtcacacactgatctggaggtctctctggttacaaaatggcctcagtcttcttcagcagaatgattactgactctgaaaacatcctagctcatcacaatatctgtctgggccaggtgtactgcttacaacagaatctacaaggacaacaactcaccgtgtttttcaattcagatttttaagttatgaattcaaatctactaaataaatatcagaaacaaacaaaaacagataaagctatagctcactgcattttagaacctgagtgatgtcatggttctctagagctttcattccacaggagagttcttgtctctagggcctcgcacactatgcacaggtgaagggacgaagtgtagccccacagggtagaattcatgatcagaggacagggaaatactgctttattcatttttctattattgtagaagtttttatcctctctaaaaaaatacttattggttatacacagaagttagtcaacttttacaccaattacacattttccagaaaaattcataaaatatcaaacatacaaaagttggttaaaaaatggcctcncaggccatgatgactaaagaaatcataccaaagtttc

SEQ ID NO: 505685 - DNA, 210 bp, Homo sapiens
tctggctaggcacaactggtgattggggctaagtcgtaacaaggtagccgtaccggaaggtgcgtgcaactgtcatataagcgaacgtcatatagcgctccgcagtgccgtgggcctgaccctggcggtgccgatcctgatggcctcactgaaccatccaatcggtagtagcgacgggcggtgtgtacaaagggcagagaattaatcaat

SEQ ID NO: 505686 - DNA, 431 bp, Homo sapiens
tcaaaactccctttacctcacctcaaatgacttttgaggagggctagagtctcctggtctggcactggcacctggtcaggaactcggagcccatctctggggtcactaacaggctgactggaaggaggcagctcaggcctcactgtcacacactgatctggaggtctctctggtagtgccattattttggtgattgatatttgaactcctttgctcttgtttcaatttggtaaatctacaagggaactctctccctctggtttacttagtttacctcctccttaccataggaaatcgtgttgtaggcataatttccacatgtgtaaactgacatgctctgaggacaaaagaatgatgacagttaacattttccgagcatttttaaaattgtcagactgtatttcattgaactctcatgataaaactgatag

SEQ ID NO: 505687 - DNA, 503 bp, Homo sapiens
tgtgcgacacacagtacgtataactaacagtctagtgaggtcgtgaaatgcatgaaatgtgagtatctttcccccaccctatagattaaaagtgctaccccttaacttgtattttacttgaagcattggatggtcttacaggaagagagagggtgggagaaaatgttttttctaagatttccacagatgctatagtactattgacaaactgggttagagaaggagtgtaccgctgtgctgttggcacgaacaccttcagggactggagctgcttttatccttggaggagtattcccagttgaagctgaaagtacagcacagtccagctttgggtcatattcagtcatctcaggagaacttcagagagctttagtaggcaaatgttgaggtaagtttccaataatgggactcttaaaggtttattaagggggggccaatattgcaattagttgcagggcctcttaccgttgggttgggggggggttaggaattttagttatatc

SEQ ID NO: 505688 - DNA, 293 bp, Homo sapiens
ggggatttgggcccctttttgggggccccccccgggtttggggggggcttttttttgccccccccggggttcctttttgccccccctgtttgccaagggggggcccccgggggggggggcctttaaacccccggcctgggggccctgggaaattggattccccccccccttttaagcccccggggtttttttttttccctttttgccccccccccccccccctctttttttttttttttttggaggggggttttggggcccccaaaaatttttttcccccttttggggggcca

SEQ ID NO: 505689 - DNA, 297 bp, Homo sapiens
gaataataggtagacttaccatctagatctcttccacttgattattcattcatctgtactatagaggatgattgactttatctctaatactaaaaactgtttcagtcgcattaactatgatgagcttattataattttaagtttacatcttttaaatggataataggaaactaaactgtatagtgtttagatatttaggtcacgttcagacactaagaatccagctgagaatagattttatacttaaaaatatctgtaaagtatgctagtccgcctttaatagcacctcagtagtta

SEQ ID NO: 505690 - DNA, 1550 bp, Homo sapiens
cggccggtcgttggcggctccggtcttcgtgcttgtgtgcgtcgtcgcgtgcggctgctggttgtgcccccatcgctgtgctgcttgtcgtgcgtcgtttctcgtgtgtgtgtgtgctcctcctcttcgtgtctctgcgttgctgctcgatctgcctgtgcttacttgctttcgctgtccggttttctcgtctcgtgtcacgacgtccccgctgttcctgtgtgtcgggctgttgcgctgctccacttttgcttggctccccagtctttccgtccgtggtccgctgctcctgtctccggtacttgccccgtgtttttgtggcgctggctcttgccgttcctggtgtcgtctctgcctggcgcctggccgtcctcgtcgttcgtttggtgtttctgacgttcttccgggttgcggtggtgcttctcggtcccgggggccttctcttgctttgcttcgagcgcttgtctgtgtgcttatttcggtgcctactgtggccggtgcctctcgtggttctctgctcatcgccgttctggtgtcctggtcgttcgtcctttgctctctttgtgttgcccccgccttttagtttcctgctgttgtggcctcgttctgttcgttcttctatgtccttgtgtcccgtattgttttggcctccttgcactcttgtgctctattgtgtgtcgtcccatctctttgtcggatcgtcggttgcaccctcgtatggttccagtctcctcttgtccctatgtgtgccctttgtactcgtttgggtctactcgatcgcactcggcccctcatgctattttgactgttctccgaactgcctcgatttctattccaggggatcctgtctagtgccccgctcgttttgggtcgtgatctgtcgccggtcactcttagggggagttcctgttgtcccagcggtgttccactgtgtgtgctctgccacgcctgctccttgcttccgttgcttgtagtccatgtcatcatcatggatcgtccccgtgatgcaagcgccctctccttcttaggccgatgctggacaaactcgcaatactctcgcgggccgccccacgtctacggtactctcaatgtcgatcgcgctttctgggcttgccgtggtgtctgctccaaccggtctactggtgccctaccctcggggaggtaccgctcggggtggttctgcattgcagcttgcaagttccctgacagggcattaggcacggacgtcttaccttgctggctcctgccacatcgatgcccccgggaggaaagttctccggatcgtgacccctcagccatttggcactgcgtcatcaccgaccagctctgggactgcattccctgcaggaacctcccggcggtcaggcagggcggccccctgctctcacacatctgctgcatcttgggtctcagggacccagatcagatggacttacaaggagctgggcactgacctgcctcaacagggtccaattgcctcctcgcctccagaacttggagaaagggaagtggcacctgaggcctccagataagcttccgtgattctcgtt

SEQ ID NO: 505691 - DNA, 176 bp, Homo sapiens
tcaagctgaagtttatttaaaatgtaaaagaaatgttcccccaaaatgctggtgatagcaaaaggataccataggcccttcctagttacagtacagatcggggacactgggtacgccatggatgaggaagcgcctgcttgaagcgtctgacagatagactcgagagatagtctagg

SEQ ID NO: 505692 - DNA, 342 bp, Homo sapiens
agttctctcacctcagactctcaagtagctgtgattacagacgtgtgccaccatacctgtgtaatttttgcatttttagtggagagggagtttcaccatgttggccacgttggtcttgaacttctgacctcaggtgatccttctggcttgggcttccaaagtgctgggattacaggcatgagccaccgtgcttagccgcttctttatgaattttacacttggcaaatgtgtaatgaccgaagccatagtctggtcctaatacatgtccgcattgactgttgtgtcattagctgtctggttacattagcttcctggcttcttgtttagaccactgcttccctt

SEQ ID NO: 505693 - DNA, 1092 bp, Homo sapiens
  misc_feature (871)..(871): n is a, c, g, or t
tagggggtggaaaaaacccgggcgttgagccgtcccaaacagggggggtgagcaacccgcaacggttgttgttggaaagagcaggccctgggaaagaaggggccggtactctgaccggctggtggacccgcacctcgtgtctggacgaagaagaggggcgccgccaaaaccccaccgtggaggaagtcccataggcctctcccgcccgggggatgaaacaaagccccgccaaggacattcatgtcccccgcggggaagcgtttttgtgcccgagtaaccaccccccgaatctggtcgcccctggttcaaaaaacgatggtctatgtgcaacaaaaaaaacgcgccagtcgaagttgctccccagcaagcagatggtttttgctgagggcaaaccccccgcccccggagcaaggtgccctgctcccaaaagaagctgtgcttgctcgaagataccacgcagtggcgtgtcggaacccacagctcgggcgcgggggaagaataacaaacgacctccttcttgttaaaaggatctgccgcttcgccccccctctctcgttagacgacagtagaagtaagtgcgcgcccgccggcaaaagacgagcctcgctttaacagaacattttctgctggctactaaaaaagaaaggtggtgctatgacaaagctgtttcatcactcccccatacggggggcagacacttgcatcaggcaaaacaggccttcccgcctgcgtgctcccccaaggaggcgtgttagagcaccgagccgttctagcgccaacaaatttgtagccccgacccacgttggcgcgtcttcaccaccgcaacgcgggtttcgctggactttacatcacccagtggattggttccccngagagagacaggagtagacagacacacagaacggggtagccaccaacacgtcgtacagaaaaaaatagagagaaacaagcgtttcgcaacagagtgttctatggataattacagactcattttggtccgaccaggtggagtggtcggatattttccaacatagttatcatttttttctagggcggcccaaaaaaaaccctttttaaacccaaaccataaca

SEQ ID NO: 505694 - DNA, 223 bp, Homo sapiens
  misc_feature (19)..(19): n is a, c, g, or t
  misc_feature (33)..(33): n is a, c, g, or t
  misc_feature (164)..(164): n is a, c, g, or t
ccgagacgggctgatcatnaggtcaggagattnaaatcaagaccatcctggcggctgggcgtggtggctcacgcctggaatcccagcactttgggaggtcgaggtgggtggatcacgaggttgggagatcaagaccatcctggctggcacggtgaaaccctgtntctactaaaagtacagaaggttagctgggcgtggtggcgggcgcctgtagtcccagcta

SEQ ID NO: 505695 - DNA, 97 bp, Homo sapiens
tgaacccgggtcccccgatggggttttcccccggcccgggggaaaattttgggaaaattccggccccccctttttggaaaaacttcccggggggccc

SEQ ID NO: 505696 - DNA, 499 bp, Homo sapiens
agtgagtcatgagtatcccctccttctggactacgcgatccctgcagctattagaatgcattgtgaaacgaggggagtatattaaaagtcgtgactgcgcgaaagactcgtgactagtgattgttgaaggaaaaaatccagctgagtgataaaggctgagtgttgaggaaatttctgcagttttaagcagccgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgtggccagaagga

SEQ ID NO: 505697 - DNA, 398 bp, Homo sapiens
  misc_feature (54)..(54): n is a, c, g, or t
aattttataaactaagatgctactgggaagaaaaaagctaaatctgaaatacanaaacaacatatttacactggtgatatggtttagatctggtatgccaaagctgaatctcatgtcatattgtaatctccaatgttggagatggggcctaggaggaggtgattggattggatcatgggggcggatttcctcctttggtgctattctggtgatggagttctcactaaatcttgttgtttaaaagtgtgtggtacctcccttccccagcttcctcctgttccagccaggtaagacatgtctgcttcccctttgccttctgccatgattgtaagtttcctgaggcctccccagccatgcttcctgtacagcctgcagaaccatgagccaattaaacctct

SEQ ID NO: 505698 - DNA, 1405 bp, Homo sapiens
gagctggagtgtgctccccgccccctgccgctgcgcctcgcctcccggctcacctccccaccccatctgccctgctgcggctctcctgcgtagacattctcagccgctactagttgagacgatgggactcgctcggctcgtcacgtgtaatcgctgagtagaggtacaccgggctgtccgtgcggaccgttattgaacaaatgccgcatgcatggtataaagggcactgagtggtaacaggcctcggaacgtaaaggcaacttaaccattcacacggagcggctctcctaactattgctatgcgattcctttgtcgcggcttgcaattcgccttctctctgtctcgtagaggcgtgaggtctcgatccgcatttgcgctcattccattgtgtgccttgttgcagcatgtgggtgtgcttgcctaagttgatcgccctccgtgacggactcgctgcgcagattctcgtgcgcctgtgtgaccactgtcttccttcaacttgggagacatagcgttccccttcgtgtggctctttgtaccactttccacttcgaatagcacgtttcggtcgcctttgcgttgcaaaaccttacgcgatattagcagactgtccttaaccagaaagtactctcccccccattcgtgtggacccccccattctcccctattgtaaccacctgatctggccccacatgttgtgcgagtgcgccttggatagcgaaggtgtcgaggtgagcctgcttggtgacatatcatagcctatgcggccccgctttttaagacctactggcccaccctccgcaaatgtgtgccctttcgttctttaagagcgcgcctgccgtgcctactggagtctcaaggcccccgcttcttttcgcgtgtgcccctctgctatcgtgcgcgcactcagcatgtgtcttcgccggcttgtgcttgcgtacccgggccgtgaatggcccgcccctggacttggcgtggcgcgttgtgaactttataggggcacgcccattctgtgccgtgggccggcggtagtcctggaaccgccgtgcaacgtggccttcgtttcgtttcaggctcgggtggtgcactgccttttgttcggactcgcccttaatacgtcctcctgtgccgtcccgtcctaacccatcccccccctttcttagccgttcgcttgtgccgcctcccgtggcgatggcgcacgcgtcttgccgccccgtgtaacggcgccatttttgtgcgaagggatccagggtgtcccccatatgtccgggcacgtgctcgcgagtcggcttgcaccacctcccgcgaaggtcggcggcccttttgtgcagcatcgcccgcttgtaagtgctcccgtgttgtggcgacctggccgctcccccttccttccagtgtctcgacggtacc

SEQ ID NO: 505699 - DNA, 264 bp, Homo sapiens
cgcttcatgccttcctgctttctgcttcctggcttctgactttcctgtttactgcggcttcctgtttctgtctacctgctactagactgcttcctgtttctgcccgtcaccctcatcctaccacttctcctccttcttccttgcatccctgcttctgcccttcctgttctgctgcttcctgcttctgcctttgcagactcactctgcatctgactatacttccaggcgggtgctttttctgtctgccagatgaacattccaggg

SEQ ID NO: 505700 - DNA, 272 bp, Homo sapiens
  misc_feature (13)..(13): n is a, c, g, or t
  misc_feature (62)..(62): n is a, c, g, or t
  misc_feature (69)..(69): n is a, c, g, or t
  misc_feature (124)..(124): n is a, c, g, or t
  misc_feature (132)..(132): n is a, c, g, or t
  misc_feature (238)..(238): n is a, c, g, or t
tcggattaagaantttgccgtatgaaagactacattcagtgtgggcaggtcaacagtgttancagaacncagttgttaagcgcacccagcactgggaggaaatgtggcttgagaggagcggctnccgaggcncccttcactggtctccaagtcgaaagccctggcccagttgtgtctccctcctcctccattctgatcagcagctctcctcatgctagcagggggcacaccaaatccntgatactcctcctctcctactgggcaagcagcgg

SEQ ID NO: 505701 - DNA, 265 bp, Homo sapiens
  misc_feature (40)..(40): n is a, c, g, or t
gggttttttttaaccggccccccccccttttcaaaaaggnccttttaaaggtgggcccgggttttttccggccccccgggggtttggggggtttagttaacccaaaaaaggccccccccccccccaagttttttaaattattgggggggtttccccccggggctttttcccccctttttttcctccggggttaatttccctaaatccggggggtttgtttttttttggggggttcccccaaataaaagggacccggttttcccca

SEQ ID NO: 505702 - DNA, 181 bp, Homo sapiens
aagcttttttttttggtgatagtagtaagatacatacaatataaaatttatcatttgagcttttaaagcatagtggaatttagtgcatacaccttgttgtgaaggcatcatcactacctagttctggagcgttttgtattattccaaacagaaattccacacctgttcagcactcaagctt

SEQ ID NO: 505703 - DNA, 844 bp, Homo sapiens
agcggggtgggagggcgaggaggtggagaagggcggggaggtgtagcgtggcgctcagtccgcctgctactcggtcccggcgctgggctgaggggaggggttgtcttaaaagtctctccttccccctgtagtgtggcggcctggcgagtcccagtgagagctggagtgtgtgccagaggtagtggggccgagaaacaaatgttccctggtggcttcctccgtgtggccgcggtcgtgggctgcgctgtttgacctgccccctcctcgcgaagtgcaatggcttccaaactcctgcgcgcggtcatcctcgtggccgcccggctcgggcaaggtgcaccgtgtgccagaggatcgcccagaaactttggtctccatgcatctctccagctggccacttcttgctgggagaacatcaaggccagcaccgacagttcggtgagcatggccacagcagtcatactagagcaacaagtcttctatgggttccatgaccatgtgatcacacgcctaatgcatgtcccgagttcggagaacaggcttggccaagcacaggctcctttgtatggaatatcgccatccgtgtacccttcagaggacagaggccgtacgacacccatggaaccacagagattcttgactgcagctgttgtgattcctagtcttgaataccagagatttgacataattgcccaaaataacgaacaggaacttgtaaaagcatccgcatctaccgagcacgggcacccatgagcataccactccccatcggctctaacacggaagcgggctaactcgttaactcttgccaccagtacacaatcaccacccatcgaatcgcacacct

SEQ ID NO: 505704 - DNA, 124 bp, Homo sapiens
tgatacgctcggttagtaccctcgataaggcacctcatacatatctatgaaaaaacttcctaccactcacccgtagcattacttatatgacatgtctccatacccagttacaatctccagcatt

SEQ ID NO: 505705 - DNA, 309 bp, Homo sapiens
  misc_feature (203)..(203): n is a, c, g, or t
cgaagttgtggaagaagttgaagctcctgtacgtcctctagtggttcgtgaaacaccacacagtgcacctacggggacctgttgtccacccccgcagcgtcaaaggagtccccatggtcaaggggaggtacctcgtcgaccgacggtacgaggggtcgcaccacgtcgtaaagcccaagttcatacactaaccgtagcctcanccgcggcctcggatacacgaccggttcaaacgtgagtagaaggggctggaccacctccccgaccacgaccacttgtagctggggttaccgtttccgacctatctga

SEQ ID NO: 505706 - DNA, 101 bp, Homo sapiens
gggtatacatagccgacggtaatcgctgatgtatggatctacaaaaaaaaaaggatacaaatgactttattggcaaaagagaaacagctttcagagacata

SEQ ID NO: 505707 - DNA, 203 bp, Homo sapiens
agtctccgaggctagggtgtcagtggtgcaatcatagactacagtgccaccttgaattccgaggctcaagggatcctcctgcctcagcctcattgagtagatgggactataagcatatgccaccacacccagctaatttatttatgtatgtgagatggagtctcactctgtcactcaggctgagtgcagtggaatgatctctg

SEQ ID NO: 505708 - DNA, 400 bp, Homo sapiens
ctggcgcacagttcgtgacactatgtacaaggaggtgatgataatgtcatacgattagtgaagggttgaacgcataagtatgcctattctggtccagagatccagatgctcaagaagcgtacgagatgagttttgcgataagggagcaagtagtattagtatagactctcacaatgtcaggagctgactgtaagactgcgatcatatgactgaggcactatacatgtgctgctacggggatgcatgcagtgccgatgttcaagaggacgccataagttgcaagcatgactgcatgttcgctagttactggagacacacaggaaggtgtattgagtgagctgcacatccaatacttcaataacatttatcttcatatacaagtccaatgctgcctgtctct

SEQ ID NO: 505709 - DNA, 875 bp, Homo sapiens
  misc_feature (7)..(7): n is a, c, g, or t
  misc_feature (9)..(9): n is a, c, g, or t
  misc_feature (167)..(167): n is a, c, g, or t
  misc_feature (169)..(169): n is a, c, g, or t
  misc_feature (224)..(224): n is a, c, g, or t
  misc_feature (232)..(232): n is a, c, g, or t
  misc_feature (279)..(279): n is a, c, g, or t
  misc_feature (285)..(285): n is a, c, g, or t
  misc_feature (405)..(405): n is a, c, g, or t
  misc_feature (427)..(427): n is a, c, g, or t
  misc_feature (436)..(436): n is a, c, g, or t
  misc_feature (478)..(478): n is a, c, g, or t
  misc_feature (482)..(482): n is a, c, g, or t
  misc_feature (484)..(484): n is a, c, g, or t
  misc_feature (487)..(487): n is a, c, g, or t
  misc_feature (493)..(494): n is a, c, g, or t
  misc_feature (497)..(497): n is a, c, g, or t
  misc_feature (501)..(501): n is a, c, g, or t
  misc_feature (510)..(511): n is a, c, g, or t
  misc_feature (513)..(514): n is a, c, g, or t
  misc_feature (516)..(516): n is a, c, g, or t
  misc_feature (520)..(520): n is a, c, g, or t
  misc_feature (524)..(524): n is a, c, g, or t
  misc_feature (532)..(532): n is a, c, g, or t
  misc_feature (534)..(534): n is a, c, g, or t
  misc_feature (549)..(549): n is a, c, g, or t
  misc_feature (570)..(570): n is a, c, g, or t
  misc_feature (577)..(577): n is a, c, g, or t
  misc_feature (579)..(580): n is a, c, g, or t
  misc_feature (591)..(591): n is a, c, g, or t
  misc_feature (594)..(594): n is a, c, g, or t
  misc_feature (596)..(597): n is a, c, g, or t
  misc_feature (600)..(601): n is a, c, g, or t
  misc_feature (604)..(604): n is a, c, g, or t
  misc_feature (607)..(607): n is a, c, g, or t
  misc_feature (615)..(615): n is a, c, g, or t
  misc_feature (632)..(632): n is a, c, g, or t
  misc_feature (634)..(634): n is a, c, g, or t
  misc_feature (636)..(636): n is a, c, g, or t
  misc_feature (638)..(638): n is a, c, g, or t
  misc_feature (640)..(640): n is a, c, g, or t
  misc_feature (650)..(650): n is a, c, g, or t
  misc_feature (691)..(691): n is a, c, g, or t
  misc_feature (710)..(710): n is a, c, g, or t
  misc_feature (713)..(713): n is a, c, g, or t
  misc_feature (763)..(763): n is a, c, g, or t
  misc_feature (850)..(850): n is a, c, g, or t
gcgcggngncaggttccgggctgcttaggttggcaccggtccgtggtccccgggggcgcagtcgcagcgctcccgccctccaggcgtcacgagtgcgcggtccagtgcggccggaacctggcgcaactcctagagcggtccttggggagacgcgggtcccagtcctntngctcctactggggcgtgcgctggtcggaagattgctggactcgctgaagagaganaacgcagnaaagccccagccacccatcaaatcagagagaaggaataccacccttntaacgnaaggcagttaaaaaagttacccatgtttcatgcacaccaggaacccaggtctttcaacggatccttgaagaatgtggctgtagatgaatgagcagcaggctgcaccgtcacagtgtctgnttgtagccagaatttgaaccgnaggccaaanaaaataaaccatggtaatcttccaaaccgaagtttttccaantagngnggnaaaccnnggnactncacaaccanntnntngggntgancgctaccngntgagacgagaaaagnttcggggggctgcccttatgntatttcnanngctctaccacngantnnagnntgnctnccagactngtaacaacacaccccangnangngnaaggggattnttttccatactcttcctttttgctcggtttatcacaaactngtggtccaaaagtgggtgntgntgacagctcctcgtcccctccctggcttgcccagggccagcatcaggggntgtcatcactggggggatgcagagctacctgtaacagcaacaaggaccattgtcaactccgttcccgtctgacacccacactgcacnttcagagctgaacataagggttacc

SEQ ID NO: 505710 - DNA, 364 bp, Homo sapiens
  misc_feature (9)..(9): n is a, c, g, or t
  misc_feature (162)..(162): n is a, c, g, or t
  misc_feature (353)..(353): n is a, c, g, or t
tcacttttntagagatgggggtctccctatgttgcccaggctggtctctaactcctggattcaagtgatcctcccaactcaacctcccaaagtgctgggactacaggtatgagccactgcacccagactttttttttctttttggaggcagggtctctattnttcaggctagagtgcaatgacacaatcgtggctcactgcatcctcaacctcctaggctcaagagatcctcctacctcagtctcccaaatacctggggactataagcacacaccaacacatctgggctaatttggttttttttttttgtaaagtttcactgatgttgtccgggttggtttcagactccgggnctcaagcaatt

SEQ ID NO: 505711 - DNA, 770 bp, Homo sapiens
  misc_feature (439)..(439): n is a, c, g, or t
ggcttggtcaccgccagcgtaggtgctaccaccgttgccgtcgccgcgccatttgtgatggcaggaagagtccggttctggacagctgagacagtggtggtgactgaaataattttaccaaaggaaaagctattgggcgaactatcttctccagcggagtatgccaatgtggcttgtgtaaccagagccagagtgtttcctatctcccaggatttgcgctctttaagtaaaaaaggttggtcaatcccaaaggccttttcgctggcaggatcatcaaggtcgggatgagtctcaatgtgggctggttgaccctccaagatatattgtctcgaacagggttggcctgattgaacatctagtgggacctttgtgacctcaaagatcagagggtcccagcttccgtgcaaccatacggttgggatgtggtcacctcaagtgngacttgtttccacagaaaggaaaagcgtgttccataaaacttgggcctgatgtctaggcagaaccttaatcagtgtgaacgacattggtttggtgcatcgcccaattattgttgactgactttccagggtaactcgatgctccttgttgcacaagcaaattacctgtgcagaacctttacttggacatgtgcccaacgtagctgtgtgccatacacaactttccggatgtgctgcgaaaggtttgactcctggtccagaagtcctaatggcaccctatgattctgctgtaccaaaaactagatgttgccggtggggacactcatgaacaag

SEQ ID NO: 505712 - DNA, 162 bp, Homo sapiens
tctacctgctgcagcctaatttggtttacgactcgagtgccctgttggggtcttgtgcgtgatcacgctaacccataatgggaacctttctgaggccttctcccttccttctattgtcccagccttttgcctccaagtggccgagcttctgaattagaatct

SEQ ID NO: 505713 - DNA, 988 bp, Homo sapiens
  misc_feature (70)..(70): n is a, c, g, or t
cccctgtgtaattggtgtgggcagttgtacacgggttgtcattcgcaagtattaattgggctccgggagnggagagcccgccaccggttataggcccacgggcacggtacttgcgaaaagccggaatttgtattcttgcgacgctccccccgtttactgggggcccacatgcgcaagacggctggtttgtgaaggtcgaacacagagaagggctgtgtccccggaagcagggcttcgctactatgtagtgggtggaccaaaagtgaatcaggggcacctggggtcacagaaaccaataacggcggtaaatcttgccccacgttgcagttactataacaacgctggcgtgtgtggcacaaaatctttgaaacagggtgtgacccgccgcccggacttcggcttgtttaattataacggagtagtttaaaggacagtctaattagggggaggggaccacaacacaccagagcggcggtcaaatatatttattagggcacattgtgcaagtagaacccgcccaggcacgcttgttttccgaaaagtcggcgtaacaatatgaataaacaattccgcgtcgagtgcgtcagaaaacaagttgtgtaagacccccttgctctacaatgtcgaaggaacccttgcgccactcggtgataaaggaagacccgccctgtggaagctgataacagagaaagttttctcccaccggtcatgccggggcttcttgtgaggcaaatttccaccttcgtgcagtcacacttagtgcgagattcgtgtattcctttcgactcactgcccgcacttaattatgtgagtgatatccacgccccgaacatccacacgcaagtgcgattagggtagcgagtatttctgtaagacaataaaagagatagacgcgaatatagggggtatctccaggaacatataattcctccggggctccacggtggggggttcatctcacccccttgcagaacccgcccacatgaca

SEQ ID NO: 505714 - DNA, 269 bp, Homo sapiens
  misc_feature (160)..(160): n is a, c, g, or t
  misc_feature (195)..(195): n is a, c, g, or t
tcgacttgatgtgaaatagggctccaagatgaggtggaacttggccaggtgatcctctacgagactagttatgtccctcagcccagaactgtacacatgctgaggagaaattgaagacattatcatcaataaaatcacatcgagcccgctctcaaccaanattaaccacatgtggcctgggcgcatgtggctcantagcctgtatatccccatgcactttgatgggctgaagcagtgcgggatccactatcagaatccgtgaatatctt

SEQ ID NO: 505715 - DNA, 210 bp, Homo sapiens
caatcagcttacttctaattgtttaaaaaatcgggcgagttatgcataaatctaagacctttttgaatgtaacattgtaagacctgtatcccacagaaaggagggtctcagaacgccggaggatggtagttaaatcataaagatatatattgtttcccacagttactgggtcaccacatagcaggcattcaataaaaaagtgtttgttta

SEQ ID NO: 505716 - DNA, 90 bp, Homo sapiens
  misc_feature (59)..(59): n is a, c, g, or t
atttggcgggtttttcggccactcagttctgccaccgtcactgagaagctcagcgatanttttgggaagcaggacgttctcaccaggaga

SEQ ID NO: 505717 - DNA, 645 bp, Homo sapiens
  misc_feature (130)..(130): n is a, c, g, or t
  misc_feature (195)..(196): n is a, c, g, or t
ctcatttcagtttttctgattctcaaatttaaaaagccaccctaacaagcaaagtaataaatactaaaggtgtgttttcatagagaatcagaaaaattgagaccaggtgagcccaaaagtgaagcttaanagaaagcaccttactggcttttctactcatggcaattattatttgttaccttgtattatagttanntgatgtacctctgtgccatgttacttcaagtaagtatgaaattcctggtggggtagagactgtgaactgacattttgcctttacagacctagcactgcttttacaaggtggatccttaaataattattgaacaaatagcctctgattgatatgagaggtgatatttatagttaagtgttacctttctaaaatgtcattcaggccgggtgtggtggtttacacctataatcccagcactttgggagaccgaggtgggttgatcactagaggtcaggaattcaagaccagcctggccgacatggtgaaaccctgtctctactaaaaatacaaaaatcagccatgtgtggcgcacatgcctataatcccagctactccagtggctgagggaggagaatcacttgggaggcggagattgcagtgagccaagattctgccattgcactccagtc

SEQ ID NO: 505718 - DNA, 874 bp, Homo sapiens
  misc_feature (132)..(132): n is a, c, g, or t
ggctagtcatcacaccatgtgcgtatgagtgttcctctgtgtagactcaacctgacgcctcgctcgtcccccattacgcacacccgatgcccgagggtgctcgactacgcgtaccttacagaaatgctccgncgaccgcatccgctcgcagcctcagaagacgtatcctgggagtccgaagcgagctgcctctctctgagtgaacctatggagatgatccgcggactcgccatgcgccactggaaggtgggcttcaggcgctcgtctggagagaaggtctggagaggataggaggacagaggcaaagggagaaagggacgtcagagcatcggcccttatacttcaggatttccatcctctcgcgatgtctccacgatgacagtgtagagattgggaagcaagagctgcacctgaggcaggtggatccatgggaagggagctcatctagccacagactattggactcgcgacgacggagcgtgatgaggttcctagatagagatgtcatagttgcttgttagtggcaagcatagaggagttggcatcatggggcctgtcattactcgcgatagcaactagtcatgtgcatagtggtaaacccatgaataagtatgaacgccctggcgccactgaaagtccagagtagacgtcgagcggtatccctggcgtcaagctgcgcgagtacgcaaacacgcggcaacgatcctaagggtgcgacatagtgggttcaaccgtgggccgttcgacttagggtagaccgttggaattggaggaaggcccggaaaccgaatgaaaagcgagagaagacgtcgaccatttagcctagcaagtccctttgataagggaggcaagtgcgtggggaaacctgaaacgc

SEQ ID NO: 505719 - DNA, 386 bp, Homo sapiens
ggcgggcactgttagatactacgccagcaacagtcacgacgatgtcaaacgtcggccagtagattctaataagacacgctataggaccaactgggtaccgggccacgcctctagccttctagccatagatcagctagcgtttcttttgcaacttgaatcgtattttatactgaaaagaattcaggctagagttggtagtaggatgcaacagcttctgggaagggggagctcagtctgaacctggggaatcaggggagtagtggactctcaccttgtccactgatgttaggtatgactgttactcctctcccttaagcacagtaagaacttggtcagtaacaatgcctgtgtaagtgctcatggctgctgtgcgtctgctgtacaag

SEQ ID NO: 505720 - DNA, 143 bp, Homo sapiens
cgctcgtgtgctcacacgataaacccgaggagcacccaacgcgccacccaaagagccacgcgatgagccaccccatgagccacgcgacgagccacccgaagagccgcgcaaatgtagccacccgcacgcgccacccgagtgag

SEQ ID NO: 505721 - DNA, 103 bp, Homo sapiens
  misc_feature (1)..(1): n is a, c, g, or t
ntcggtaatttactaaacacaagttgttatagccagaggaacaaagatgatataaaatattgtgctctgacaaggaatacatgtatttcattctcgtatggtg

SEQ ID NO: 505722 - DNA, 105 bp, Homo sapiens
agataatagggatggcgagtgatgtcggcgcatgggggggaatcgatatatatgaatcgcggcgctgaggtcgacatatgggaagctcccaagcgtgatgcatag

SEQ ID NO: 505723 - DNA, 229 bp, Homo sapiens
cttctccatgttcattgaattgaaatgcctgctttgaatgtggaatattatgattatgaaagggattatcgtttgttctgaaggtcaactatttttgtctttagatggctttgtaacactttttctccagataactcggaacttttgaaaaatgtcatgagattttcattaaaaggacccttttcctatgtttattgtatacagaaattatgcaataaaatttctttat

SEQ ID NO: 505724 - DNA, 214 bp, Homo sapiens
ctctataggatcccctcaaagttatgatcaattgagtatagtagtacgctttgactggatgaagtcttagcatgctactgctcggaggattgggattctgctccgaggatcgccccaaccgcaaatttttaaatgcagcgtttaggtagatttagcgaccatgtggagtttgcttagcgtatctgttctgcagttacataaacttaagatgctc

SEQ ID NO: 505725 - DNA, 400 bp, Homo sapiens
cgagatcacaccactgcactccagcctggtgacagagcgagactccatctccaaaaaaaaaaaaggaaccataagaatactatcataatgttgttacccttgactgaagatccaaacagattggtgaaatgaggctctaggaagattatctgcagtatatgcagccagatcgttctctatactttaacatggggcctccctgtgcaaggtatcttgtgagggtagcctgagtaaaatgtctaaatcattaaaatgtctggtcatttaacatgaagcaatttatcaacactttggtcactaacacttaacaagtgcagcataattatgctttcaaagccttcacactcagccattaatactttggtcccagtcatagaaacttattaatattcctcctcca

SEQ ID NO: 505726 - DNA, 113 bp, Homo sapiens
accacataggtcacgtcatgaaaccactttttaaatatgaattaaatgtgagcttcccctatatataatttctctgattggctgcgcatggtggctcatgcctgtaatctcag

SEQ ID NO: 505727 - DNA, 1478 bp, Homo sapiens
  misc_feature (572)..(572): n is a, c, g, or t
  misc_feature (576)..(576): n is a, c, g, or t
catagcctgacacagaagacacatactcgtggcacacaccgccacaaagccatgcttgcacagagcaaaggtgtcataagcatctctgtgcctggactgcacctgcatgacctcccagggtccccacctcatcagagattaaggagagctttgcttggagacaccacccctgaggggtgtctccaagggggagtagagccagtcacaagcaccacatacaggcacacagcctgaggtctagggatgcaattgggatgactggataccaccaagttcagctccttattgaacagatgggcgcctgaggcccagggagcagtggtggctggccttatcacccagcagggcaggggatactctggggccagagcctggctctgggcagactctgtttcctggccctgccctcccctgggccaatcctctgggccaggctgcctctgaaggcccctggctgaaccgatccagcagagctccaggcagctcccttctcaagctagagctgagctgcagtggccacgggagccggagccaggatgcggtgggcagggcctaggcctgggcgggaggancatncctgcaccatctcctccccaagcatgtgaggagccagcccgccctgcccgcctgcccgctgactcaggcctccaggagccaagcctgctcagctcccgcacgcaaccgtaagctgcttgcccgactagttcggctctggttcccctctccactggctggggcaggagaagacggtgagccctggtaggaagaccatggggacacaaatcaaagcctcacagcccccgacatagctcagaagggctgattgtgaaacccagctctgttcaacatagttgaacaccaaaacttttattttcttctggtataggattaggttttggtacggtcaaaccccaagtgcatgtgcagtctggtgtaacgaagtcagtgtcgcatagcctgtgggctggatctgcctcagcaagccccagtaggcagcactttattccctttcgcaacaaagagactgagactggggccagagggacagatgggacctgctagagttgcacaacaggggaaatctctgggcgcgggctgacactcgaaaccaggctccctgcatcaactccttagaagtcacactgaagaacctcgtttagggccaaggaagacggggacagcagatctccccgtccagatgagcgacgggacaaggcgcgggatgaaccccaacgggggcgggaactgctcaacggcggcaaacagggcacggggaggagaacccgccagagccctggcggggcatggcagggtagcgaagcagggaacatcgatgcagaaaacgcgtgagccaacctgagggacgaccgcgctagaagcggaccagcggaggaggacacaacgtcgaaagaacaatagcggcaccgaacatcgggtataacaccccaatacgcaaaagggaagagggagacagcgcc

SEQ ID NO: 505728 - DNA, 145 bp, Homo sapiens
atgctcggtaacctgtggttcaggtgagaggacggtgaatccaggacgagcatggaggacgagaagactgcctagtgccagcgtactaaaactgtggacactgaaggcaatgttctcgtcctccatgctctccctggaaccacag

SEQ ID NO: 505729 - DNA, 1055 bp, Homo sapiens
  misc_feature (311)..(311): n is a, c, g, or t
  misc_feature (436)..(436): n is a, c, g, or t
  misc_feature (657)..(657): n is a, c, g, or t
  misc_feature (762)..(762): n is a, c, g, or t
  misc_feature (959)..(959): n is a, c, g, or t
  misc_feature (1015)..(1015): n is a, c, g, or t
gaagcagatggcggatgacgccgagtcgaacgcgcgaggcccgaggggccctgggtggccctggtgctgatgatcgacaccgcatctgaggttccgcaagaccgcttatcatccagtgttcatccaggcgagccggcgatcatcgatgcgtgagaaggcgacctgatgcgcatgcacgcgaaacatctgcgagagagcgaaagcgcggagcgcataaagcgacgtggcatgcccggtcgagcgaggtctgcgcgtctgatatggtcaaagagcacatcgtagagatcgaaagtaacccaatcgtgggcacnatcgctattcatcgtatgctgcccttggccccacattgcacacgtgaatcaagaactatgcgatatggaatcttcgtatcacatagcgtggcgctcgtactttccatcagataggacatagcagngtcattgcgcaggggctatattattgcaccacagtcggcgagcaccatgtcaagaaaccaactggtagacgcagagacacgaagtctggcaaacctacgcagttgcaaaaagtgccaaatttgtatgcgtattccgtagaggaaactaacagaggtggacacagacggtcaggattcatggacgctgttttagacgttgacgtctcgaacgtgcaggtgtntggtccgagccgatcatctcacgttgtgggggcacaagtcaagtctcttggtccaaatggcttctcacaatccggtcccctctcgtgcttggcaggtaatgtgcntacttgtgcgcggggatatcgacacgcatccggggtcaatgtcccccgaccaacattgtgtcccgttggccgaagtgtggacgagtgccggtctgcttggcggtcatgatgcatgagttaccagcgcgtcaatcctccgttgcaacccatggggtcaactgtggcctatcagatcttccggtgaactggtggccgtnaaagaaatgctgggtcaatgaatgggctgtgtagtcggattggacgtgcgtaacancatctagtccaggaggctttggactttgacaaaccttggg

SEQ ID NO: 505730 - DNA, 143 bp, Homo sapiens
gttgtctatccccttccaccctcatcttattataatctcaagacactttcctgatgcgtcatctcactccccttccatcctcatgctcgcacctcagcaactataatatcaatacacctgccagagcgtctgctgaattccgc

SEQ ID NO: 505731 - DNA, 151 bp, Homo sapiens
tatctgacttcttttgtattttattttattttaatttttttattgccatagcctttgggggaaacaggtggtatttggttacatgagtaagttctttagtggtgatttgtgagattttggtgcacccgtcacccgagcagcatatactgca

SEQ ID NO: 505732 - DNA, 405 bp, Homo sapiens
tgtttatcgatgccacaaaaatacacctgacactgatgaaagaaatcatagatggcacaaacaaatggaaacaaatcccacgctcatggataagtagaatcaatactgtgaaaatgaccatactgccaaaagcaatctacaaattcagtgcaatccttatcaaaataccaccataattcttcacagaattaaaaaaaattctaaaattcatgtggaacaaaaaagagcctgcgtagccaaaacaaggctaagcaaaaagaacaaatctggaggcataacattacctgatttcaaactacactataaggccatagtcaccaaaacagcatgttactggtttaaaaataggcacatagaccaatggaacagaatagagaacccagaaataaacccaaatacttacag

SEQ ID NO: 505733 - DNA, 227 bp, Homo sapiens
atccatagaaaatctgatctcttccctggtggctctggctcttccctgaagtcatcaggcacctgccatgcattgtggttctatccccagagcatctttccctgtcccccaactacctacccaaaatgcctccagaatcaacctgcaggaccacccatggctcctacccccatggaccacccatgtgctcctccccttgccacaacctgggataccgacgctcgaat

SEQ ID NO: 505734 - DNA, 1417 bp, Homo sapiens
ctcgtggggcgcccggtcgtgttgggttcttccgctgtgcgtttggcgtccctcctgttttattggtgtgttgggccgcgcgccttctatttgtgagttccgccggctgtgtgtgtgtgtggtcgcattcataggtctatcgcgcgtctgtgttggggttcattcgtgcttctcttgcggtgggtggtttctcctccgcgccgaggagtgattgtgtgtgttgcggcgccgatcgcggcgatgttgctgggttgcgtctccctggtcggtgatcgcgtcgggtctgtttttgttttctttatttcagtaatcggagtgttgatcatcacagacaagaaggtagatggttgttgtaatgtgagtaggtgttatgtgtataatttttgttctatttagtgattagggtaggtgcgcggcggcggcggagaggaatagtaagagagaggaccgcccgtgcttgttggtagtgcggatgatatgaattatagtatttctgcgtcgcgcggcggcagcatgataagcttgatatggtagtatattgtggtgtattgtgtattggggtagcgcgcctctccgccgtctcttcttcggctttttgtttgttgtgatgtttgctcgtttgttgtattctatgtattcggcttcgtcgtggccgaggacggtgtggtggttgacacttagatgtatgttgttactgcatcgcctgctacatcttgcttgttctgctgctcttccacggcaactactcgtcctgtagtagtgtggcgcggcgccccgccccgctggtggtgggtttggtggtagctctcctctcgctcggcggtggggtcacgtcgcgccgcgttcgtggcggcgcgcgcgcgtgatttatatatatctctctcgcctctcgtgccacctcgcatatatatctgcccccccctcttgtttgttatttgttttgctcatctcccgcgcgcgtgcgcatctcgtgtgcgctcgtatctcttcttatcggtggtgtgcgcacactacgctgtgtgagtgtgtttctctctctctcgtgtatatacacccccccctctcttgtgtatagataataaacactcaccactcccaacagaatatagtttcgttcttctccttgtgagagttgtgctcccccccctttgtggtgtgttatacacacacaaaaacctttctctccgcgcgtgtgttttcacaccaccccccctttttctctctctccccctccccgcgcgcgggggagaacaccgctgctgcccttattttttaaaattttggggcgcgcccccccctttttttctcccccttttttgaggagagtttctctctctctctattttttttaaaagagggcgcgcgtgttttttcttctctttgcccgcccccctcctctctcccttttttgccccca

SEQ ID NO: 505735 - DNA, 198 bp, Homo sapiens
  misc_feature (6)..(6): n is a, c, g, or t
ggcgangaaatcactgaaactcctcctgctcagaatgaagattatcaatatatggtcaaataaatatacgcaaatttttccctaaaaaaaaaaaaaatccctcagaaaagaatgtttttgagttctatcatgttggccaggctggtcttgaactcctgacctccagtgatctgcccaccttggccttgcaatatgcaa

SEQ ID NO: 505736 - DNA, 780 bp, Homo sapiens
  misc_feature (6)..(6): n is a, c, g, or t
  misc_feature (63)..(63): n is a, c, g, or t
  misc_feature (76)..(76): n is a, c, g, or t
  misc_feature (118)..(120): n is a, c, g, or t
  misc_feature (122)..(122): n is a, c, g, or t
  misc_feature (158)..(158): n is a, c, g, or t
  misc_feature (164)..(164): n is a, c, g, or t
  misc_feature (174)..(174): n is a, c, g, or t
  misc_feature (188)..(188): n is a, c, g, or t
  misc_feature (195)..(195): n is a, c, g, or t
  misc_feature (201)..(201): n is a, c, g, or t
  misc_feature (219)..(219): n is a, c, g, or t
  misc_feature (264)..(265): n is a, c, g, or t
  misc_feature (281)..(281): n is a, c, g, or t
  misc_feature (308)..(308): n is a, c, g, or t
  misc_feature (347)..(347): n is a, c, g, or t
  misc_feature (366)..(366): n is a, c, g, or t
  misc_feature (549)..(549): n is a, c, g, or t
  misc_feature (602)..(602): n is a, c, g, or t
  misc_feature (607)..(607): n is a, c, g, or t
  misc_feature (610)..(610): n is a, c, g, or t
  misc_feature (677)..(677): n is a, c, g, or t
  misc_feature (692)..(692): n is a, c, g, or t
  misc_feature (704)..(705): n is a, c, g, or t
  misc_feature (742)..(742): n is a, c, g, or t
tatgtnactttttttttttaaccaagaataatctaagttatggcagcatgttcaatgaaaggnaagtccggcccantttttctatatctgtttctcagataatccggcccatcatccnnncnttacattacgataccataatggccctcagagcgcangtgccnttaggtgggnatggggcgtcatangtgttcntttttnggggagggcccccctttngtggtataggcatacccctaataatcttactctactgtgcaaatnncttttcacccacaagngcggcctcaagtaactttcattttggnaagctatcaaggcatgagacagagtagcaaaatgccacnctggactttgcatcttggngtttcaattttgctttaggatttagaccccagtttataattaaaaccaaatcattcccacattattatacttatgtaggaaagccttgctgtgtccactgttaacacaaagatagaaaatgtcaaatagtttaagcaagtatttggcagaccacagacatgaaacagtgccgtcggaaacggnaacactttagtgttttagaggtgaagagattgatgggtgtcattcaaatttcncatcnccntcttctacatctttcagattgagtacttccaaagaacctttgcctttagtttccttttttattagcncatcaatttctcggnagcagcccgggnnaatcagacatacgatttctaactgttggccataatcntcactttctatgaccttgatcagtggcttgagcctttc

SEQ ID NO: 505737 - DNA, 573 bp, Homo sapiens
  misc_feature (8)..(8): n is a, c, g, or t
  misc_feature (27)..(27): n is a, c, g, or t
tgggcccntaaccaagcccgacccacntgaatggggaagaattaaccggtgacaagtgtgaaaaaaccatttatggtctttaataactgtttttgctaggttctgtttattcctttcaaagtatgttatttaaaatgttctgcaattaaaaaaaaaagaaacaggatggtctttttaaaaacaggtttgagataaggaaaaaattgattctatcagcttggcaaaaacacctcctgcagcacaaaaactccacgaacgtctgtgtgtgccttgactgggaacgaggagagggagtcagagggcagcgaggccgggcagcgagggagcagagcccttctgttggtgtggggtggaggcagccttttatcctgcgctccggtgctgtggctgggaaggcaaggtactcatgccaccctccaaggtgaagagaagacccacctgcttttctctgccatcaccagatcctcccaggcactgtccccacagtcggtccagccaggcacactcggcctgatctagtgattcaagctgtctttccaggacttggcctctgcaggtaagtccttagtcttc

SEQ ID NO: 505738 - DNA, 785 bp, Homo sapiens
  misc_feature (23)..(23): n is a, c, g, or t
  misc_feature (66)..(66): n is a, c, g, or t
  misc_feature (71)..(71): n is a, c, g, or t
  misc_feature (105)..(105): n is a, c, g, or t
  misc_feature (149)..(149): n is a, c, g, or t
  misc_feature (152)..(152): n is a, c, g, or t
  misc_feature (154)..(154): n is a, c, g, or t
  misc_feature (169)..(169): n is a, c, g, or t
  misc_feature (171)..(171): n is a, c, g, or t
  misc_feature (180)..(180): n is a, c, g, or t
  misc_feature (185)..(185): n is a, c, g, or t
  misc_feature (192)..(192): n is a, c, g, or t
  misc_feature (196)..(197): n is a, c, g, or t
  misc_feature (199)..(200): n is a, c, g, or t
  misc_feature (205)..(206): n is a, c, g, or t
  misc_feature (209)..(209): n is a, c, g, or t
  misc_feature (211)..(211): n is a, c, g, or t
  misc_feature (229)..(229): n is a, c, g, or t
  misc_feature (231)..(231): n is a, c, g, or t
  misc_feature (248)..(248): n is a, c, g, or t
  misc_feature (255)..(255): n is a, c, g, or t
  misc_feature (258)..(258): n is a, c, g, or t
  misc_feature (270)..(270): n is a, c, g, or t
  misc_feature (275)..(275): n is a, c, g, or t
  misc_feature (277)..(277): n is a, c, g, or t
  misc_feature (280)..(280): n is a, c, g, or t
  misc_feature (283)..(285): n is a, c, g, or t
  misc_feature (287)..(287): n is a, c, g, or t
  misc_feature (289)..(293): n is a, c, g, or t
  misc_feature (295)..(296): n is a, c, g, or t
  misc_feature (305)..(305): n is a, c, g, or t
  misc_feature (308)..(310): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (321)..(321): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (362)..(364): n is a, c, g, or t
  misc_feature (379)..(379): n is a, c, g, or t
  misc_feature (384)..(384): n is a, c, g, or t
  misc_feature (388)..(388): n is a, c, g, or t
  misc_feature (399)..(399): n is a, c, g, or t
  misc_feature (408)..(408): n is a, c, g, or t
  misc_feature (412)..(412): n is a, c, g, or t
  misc_feature (422)..(422): n is a, c, g, or t
  misc_feature (425)..(425): n is a, c, g, or t
  misc_feature (428)..(428): n is a, c, g, or t
  misc_feature (447)..(447): n is a, c, g, or t
  misc_feature (461)..(461): n is a, c, g, or t
  misc_feature (483)..(483): n is a, c, g, or t
  misc_feature (488)..(488): n is a, c, g, or t
  misc_feature (493)..(493): n is a, c, g, or t
  misc_feature (498)..(498): n is a, c, g, or t
  misc_feature (500)..(500): n is a, c, g, or t
  misc_feature (614)..(614): n is a, c, g, or t
  misc_feature (752)..(752): n is a, c, g, or t
aaataatgcaggagaggattagntttaatagtggtgtggtggtaggattagaggtgtgtaaaaagngaaangagggagagtggtggattagtgaataaaaaaagntgtggagattgttaaaaaaaggagagtatatcaagggggttganaantnaaggattttggattnanaaaaatggnttggnaggttgngggnngnntgtgnntgngnagtgatgtgggggagggngnggggattagatgttagnatagggntgnggaagaagtggnagggntnagngannnantnnnnngnntaatatagnagnnnaaaangngngngagagagttgaagaaaaaaagattaggatgtgangnatntnnngaaataagaaaaggnaaagnaagngaataaatttnagggatagnaagngtgggtttgnggnagnatgggaaaaggagttttgntgaaatgagagggnaaaaaggtgtggatgagaaagnaagtngtganaaatngngtgtaaaggtaagtgtggagaatattaagtgtaacatattaacaagagccttccaagataatatacagtagacaagaatgttaatcctacaatgctgccttcttgtacattggnagcacatacttctcctataatagacatccaagatccattctcaaagtctttagcattctattacgaaaagcacagccatgctaacttcagtacacaaaccataatcccacacctacaaaacaaaaatagattagtggnagtttattgccttatacaaatttaaccaacatg

SEQ ID NO: 505739 - DNA, 766 bp, Homo sapiens
tgcagtggctcacacctgtaatcacagcactttgggaggtcgaggcgggtggatcatgaggtcaagagatcgagaccatcctggccaaccatggttgaaacttctgtctctactaaaattaacaaaaatttagccttgggcgtggttggcgcacaccctgttagttcccagctaacctcaggagacctgaggcagggagaatttgctttgaaacctgggacggtgcgaggtttgcagtgagcccgaggatttgcaccacgcggcgactccaagcaggagcaagactctgcctcaaaaagaagaagacaaagaaaagaacacaaaatccctgtgtgtggcgcgcggcctttggggcccctctggagagaaaaacgctgttctatagacacacacattgcggttgtgtggcgcgccgcgggggcccccaagagagagcgtatacggggttagaccaatgtggctccaatacgcgtggggtccccctatagggagaacacccggggggtccctgtggaccataaacggggcgtgggggtatctcttcacccccagattaagaaaagcgcgccaccggggggggtacaaaaccgggagagcggcgtttctgtggagacaaagatatcttccagaaagtgagcgagattttacgatgagagggtgctcaatataggcgggggagactctctactttcacacgcgaggggagtctcacaagaggcgaaagcctccgcgaattattcacatttttaggccccccggggcctgt

SEQ ID NO: 505740 - DNA, 1295 bp, Homo sapiens
gtctctacaaaaaaaaaaaaaaaaaaagaacattccagaatatagaaatctcaggtacagagtaccccaggtaaaaaaagctggcccctttgtgggatttaagtgggtcagaagtgcgtgagtggagtttaaggtagttaagcaagcaagaaaagacagttcttagatatagtggtgatgaggagattgagccaggtacgtgcaggggcatggtaaggcccgtgcgtgaaagaaaatttgcattatgtgggtttgtgggagtgggtattttttattattttgtggagaaaaggaagttcttggggtaggcccgcgggcctgtggaaggtgaaagaggggggggagaactcgtggaggaacacaccggggacaacacgcctcgcggcgctctccacaaagagtcacacgcgcacatattcctcacctccctcagagagcccccacaaagaaagagagggtgagagaggcgcgccgcggtgcacacacacaaacccagagagacatagagtatctgcggagcgacaattttgacaagagaaagaaaaagagggggggggtaccaccccaaaatacccccgaggggaggggggcccgctcgagagctctttatgcgtgagcaccccgcggagaaaccccacaccacacaccccgggggggcaccctgcccacaaagaggggcggcgagggggaaatatacagcgcgggggcgatatagagcccccaacccacaggggcgcgcgcgggggagaaaaagagacataattggggagaacaaatttcaaaaattatccccaacagacgaggggagaccaacagagggggcacaaccccccatatgtggggaccccgcgtgggcccgtgtaaacagccgcccagggggcccacaacaagtggacacgctctcccccaacgcgtacaccacggcggcaacacaacacgagctcccacaaaagacgcgtcacacaacaaaatcacgtgccgcgccggacacaaccacaaacagggtactatctgcaacagatgtgacaacacaagattatgtaagaagtgggggagagataaagagagggcgcgtcccaaaccaccggggggggggacaacaacccgagagagggcacaaccacaaatctctcgctccaatccaacaacgcccactagttgtgatagaaaacacccgcccgcgtcttcgaagagaaacacaacatcccgatggagagacacacccatatgggggggcgccacccacgcacacaacactccacaaaaaaccaacaggggcgcgccggggaaacaat

SEQ ID NO: 505741 - DNA, 299 bp, Homo sapiens
gcttcagtgatcttcccatttgccccccagtttttttttctttaaaaaaacggtttttccctctctatgggcctgagtgatgaaaccatccctgtttagttactaaatgaacaaatccccagaatgggtaaaaagtagaatttgaactatatcttgccaaatattattccaacttgaatgtaaatataaccagtatgtatattttttaaaaaaatttgcctgccatgcccttataagtgccctttaatgtcatagcatgtaaagggttttttttgtaataaaaattatagaatttccca

SEQ ID NO: 505742 - DNA, 159 bp, Homo sapiens
atgtctagtcgtacgggctgcattaccaaaatctaagctgagtgactgtaagcacagatttaatttccacattcctaggtgggaggagtcagagatcaggggccagcatgccagcttctggttcaagcctccttccaggttgcaggtggctgcctcccc

SEQ ID NO: 505743 - DNA, 105 bp, Homo sapiens
  misc_feature (5)..(5): n is a, c, g, or t
  misc_feature (24)..(24): n is a, c, g, or t
  misc_feature (73)..(73): n is a, c, g, or t
  misc_feature (87)..(87): n is a, c, g, or t
  misc_feature (89)..(90): n is a, c, g, or t
  misc_feature (97)..(98): n is a, c, g, or t
gctcncgcggagaaggtcgggttntagaagctggggtggccggcagctcgctcatcggtgttcgtgggctttntcggtccgtgcctngnntctcccnngaaaggg

SEQ ID NO: 505744 - DNA, 136 bp, Homo sapiens
  misc_feature (83)..(83): n is a, c, g, or t
atccctcgaaagaggagtggtctaggagcagctgggcggatagcaccgggcattattttggaatggagtgaggtcttggcacncctgatgcagtaccagcgatggacttggtctatagttagagcaattgtggcta

SEQ ID NO: 505745 - DNA, 476 bp, Homo sapiens
cggcaagagacatggactgagactttgatgagaaagtattcagaccctcagaatgatcaacccagcacgtggtggacttgctatgtgaagagacagtacatgaacaagagtacttatcaggacctggacagtgaagggagcccgggcagccaccgtctccagagaccctgggcataattatccagcaagaaatgtccacaatcttttgccttcatttctgtcaccagttttatcacagcaagcagcagcaagcagcatgtctttacttgaataactcttgctcaagcaatttgggtgggagacaagacaagtgggttatcaagggtgcattagcaattttctgcagcattaaagctggcgcttcactaagcaatcagtcatacataaagcaatttctaacattccatgtcagaaaaaacttaattgccagtctttgacattcacttacaatttgtcatggagctgttgtaaactgg

SEQ ID NO: 505746 - DNA, 171 bp, Homo sapiens
cttctaaatcagtgcaaactttctatgtggtccctcttgctgggagaggagatctgatagaaatactgactttctgaagatcggaatgtggtcctgacagggcgaggaccattcattctttcatacagtgagcatttgtctgctctggccctgtgccttgaactgctccat

SEQ ID NO: 505747 - DNA, 1270 bp, Homo sapiens
  misc_feature (545)..(545): n is a, c, g, or t
ccaaacggtatccagctttattaaagatacttcccataaacaatcagggttattccaggcaggaacagtgggcagacaactcgtttaacagttatacaacaacttttcaaacctccctttcttcaagtggactaccaaaaactcagaaaagccacttataaaacccaagtgaagttcttcatcgtgagtgctcgtgaacgagggaaagttttaaaggtgagggttgtgcacattttcacatttatagcattgctgtgctttaacaactttttcacaagccgacccgtgactttctcaggaagtgtgaaagtgaaccagtggcagaatttactctgaaagatccacaactctaaaagtgtggaaccactgtgcctcttttggacagggtgccactcttcaggtggccttccactgggacaaagttcccagaatggccgtgacacacgtggttacacccaatgtgactaggggtcccgggttctctcaacagaatgttcgtgggccttagagggcagcttaagttcatatggcgtgaaaagcgtggnacagggggacgaaggaggaccttaaaacacaaatttgggtttttcatttacccacagggcctttgggtgcccagggggggcccaggggtggttgctccaaatgtcggggaaaatcccttcccttccgtgggggacgcccaagagggaaagttcttctcaaaaactcttaagaccggggcaaccgggtgttttcctcccaaatcaaatcccaggtttgggacaaacatttccatatcagcgagaaatttttgccccctttccccccaaaaaaaaaactaattgacagtgtctcgggggtcgctaaccacaattagtttttcacagacaccaacatcatccggctaacccaaacttccggcgttttcataacactgtgtaacgaaatctcgttgtccccccttgtcctgcccccaaaaattccaccgccttctcataacttcgcactctctccgtggggctctcaccaactcccgatttggtcgcccgcggggggggggctctcccttcgtgggggggtatccctcctgtgggaagcaggtttcctgttcccggggggagttctccctcgtgggaggcgcttgagtggcgccggctgacgcggcattatcaacacagctgttctcgtggaccgtgttggctcaccaccctatcgtggggcgagggaacacttgattatggtcgtatcgcatgttctctttcttccgtgatcctgttcctggttgcgc

SEQ ID NO: 505748 - DNA, 1041 bp, Homo sapiens
cccggggtgaattcggacggagggcgtacaagggggatgaaagtcacgggagcatgttcactgagagcgtctacgtcctggccaacgagccatccgtggcctggacccggctgcatgagcatgtgcgtcgctccctccccgaggctggtcccagcacaaggcagacatgcagcgttgggaggagcagagccagggagccatctacactgtggagtacgcctgcagcgaccgtgaagaacctggtggacagcatcgtctacttccgcagcgtggtagggtctgctcaatacaggccatcagcgatccgggaccatatgtaatgcccacgtgcccaggccacaggtagcctcctgggaccgctccgccccccactgccactcccagctgcaaggatccgtctctcagctgcgctgggaaccgctgcttctcgcttattagagaattgtctctttcctttcgtcctggtgtctggtgacctcctcttgtcctgtggcatctatacacctgacgttcatgtcacttaagttaccgtaggtcctgcatctctgctgtgtgcctggtccctggggctgggcactggggacataggcagtgaccgagacagacaggctctacaaggagacatacgatcaaccaggtaaacatggcagacaagagcatgtcagatgcgctgtgaagaacactgcggggcctcctagcggtggcatgagttacatgcgacagaggacgatccagggccaagactggagttccatgtggggcagtggtgagggctagacgctctgtgggctggatccctgggagtgtcgagaagcaccgagagcttctgtggctgagcggccagctgggaaatgggccggaaatgggggggcactcctgtccgacccaaccaaggaggttagccagactggttaaagaaaccaagctgacttgcgaatttagtacccttgatggcttataaacgtttagacaacaacaaacggttgtggaaaatagggtctatccattagaacgctagtcacacaataagctctcaaacaa

SEQ ID NO: 505749 - DNA, 172 bp, Homo sapiens
gagggcccatgttgcacggatcggtgaggagtataggagcagggcgtctttgtgcagagtgtcctgccatacttcgtagctacaaaacgggctaaaatccggaagccaactgtggataagccctctccggagacgttgtgaagtctgcaattaaaacagtcggcctgcaatc

SEQ ID NO: 505750 - DNA, 1009 bp, Homo sapiens
  misc_feature (775)..(775): n is a, c, g, or t
tcctctgtgatgtgctgcacacgatggtctgctgtgacacatcgctgcaactccacctgtgacgttgcctgcttgatgtgtgatggtagtgacccaaagtcctttgcacatgtgccagcgtctactatctgcattacttggacgggctagaccccctgcctcttcgtttcctccaaggacgacctgtccgaaggtgtcgcggtgtctggccccatcaacggacgagtgtggtccgcaggtcgcacagggatacaaccgtcgtacctcgttgtccgttatcatcccatgatgactaggtccacagtcgccggagcccgacgactaacccatcacttcctattcacccagtctcggcaacatggacgtcttcgcacattgggtccaccgccagtagttctgaatccctcttgccttctgggttctcgagtgagtgcatgcatgggggggtttcgtcatgggctctggacagttgagctcggaagtccacatctaagtcgttcctccaccttcttaactaagtggtaccattgggttgagaaaagtcatgtgaagggcccggcgtacccaaagtcgccgcgtcccctgatctagtgggttgtagactcggctgctgaggtgctctgcgacagggtagcataagattggtcgtgcaaagccaggcttgcattccggtaaacgcctttgcggcaaggattattagtctctgaatggcatcgtcgatctgtatcgcgtggctgtatgctgggcatgccaccagccctggcttctgctggancctcagggtgggccgtggccttgtggctgaggccggagctcgcgagagttgcgggcaccgctgtcagggattggccacccctgggctcatgtgtgtgggccgggagcactggtgtggacactgtatcccagactaaatcttagggtctcgccctttctggcctggtggccgggttttgcggaggtggccggggtttggccaccaggtgggggcccccgtggctcttttaacccg

SEQ ID NO: 505751 - DNA, 208 bp, Homo sapiens
acgatcctcacacactccccatttgttgtcccaggaagtataacaccccctttaagactctgttccttactatcacagtggggatgagagtgaaggaaaagaaaagaaaatttgttaagttaagagaaaaacaaaactaagaagactctgtgcctttacaacatcctcgtgcaaagccattactgagacatctaccactatgcttagc

SEQ ID NO: 505752 - DNA, 320 bp, Homo sapiens
tattcatgctgtatgacttacacctggtgaatcagatgtacaaataagaaaggtaatagttggtcaggccaatgttatcaatcgaaagtagttagaaaaatgctcgtcctattctaccaaatttttaatatctttcttcccttatcttgctacacacttgatcacagagttactccatcgtgctttgacacttagaaattatgtataggatattttaaatcattgagttatgtggaggataaaaaggtaaggtgtgtattcttttgtttcagggaaaatccgtgtctttatcttgtattcccacatggtagaaccagatt

SEQ ID NO: 505753 - DNA, 398 bp, Homo sapiens
catttttgagcagtactgactagtcatagaacatccttcttaatatttcttcatggttgaatttagattatgccattttttgcaagaataccataaaggtgatgcttgtgcccttctcagtgcatcatatcaggaggcacacgatactgatttgttgcattactaatggtattaacttcaatcatttggttaaggtgctgtcttccatgtttctcaatattttcccctttgtaattaacagtatcttgtgggaaaagcctttgaggttatgtaaatagcccatttctcatcaaactttttctcacaaactttagcatccattgatgattcttgcctgcaacaattattactgtggtgcttgccaaatgttgactttctatttctaccatttccattat

SEQ ID NO: 505754 - DNA, 341 bp, Homo sapiens
  misc_feature (43)..(43): n is a, c, g, or t
  misc_feature (50)..(50): n is a, c, g, or t
tcctgagttcaggcgattcccctgcctcagcctcccgagtagnggggatnacaggcgtgcaccacaccactcagctagtttttgtatttttagtagagagagggtttcatcatgttggccaggctggtcttgaactcctgacctctggtgatctgcccgtctctgcctcccaaattgctgggattacaggcgtgaggcaccacacccagcctggttttgtatcttacataacatttttttctgagcattaaatattcttcaaagatatcttctaaaaaacattttattgacatcaaatatgctgacagaaaagtgaataaaatataagcgtactgtgtgaa

SEQ ID NO: 505755 - DNA, 464 bp, Homo sapiens
aaggttatggctcatagttcaccccaaagcattttagatgatgttgccatggtccttgatgaagaagcagaagtttttatagtcaaaatgtggagattattgatatatgaaccagaagccaagaaaattggtcttgtgaagtaaaactttttatatttagagttccatttcagattttttttttgccccccttttaaggactttgaatttttctttgtctttgaaaccattgtgagatctgtaattttttttttttgtaaaaaatgtgaattttttggtcctctaatttgttgttgccctgtgtactcccttggttgtaaagtcatttgaatccttggttttttttatactccccaggtacaaatttttggttttttttataacccccagctcctgtacccaccctttttgatataatcttgttttgctgattttttttttttaaatattaaaacgcctcccca

SEQ ID NO: 505756 - DNA, 139 bp, Homo sapiens
tcacagaagagataaggggcttccagcagaagaagcacctctcacgtttctcggaatgtatgacttcttgcaaatgatcatcccaggtaaggaagaacagataaggaatgcttggtagcaagtgactcagagccatagg

SEQ ID NO: 505757 - DNA, 733 bp, Homo sapiens
gggtgcagactcagtcaaaggaggatgtcgacaatgaccgagacagaaccctcgactgtggctgatggacaggccacttccatgatgatctggactctgaccactcagtacatcatccacaattacagacacaggcgtcatcccaggacctgttatccctactgcagtgaggagaggccgccgatcgtcaagaggatagggagacaggagattcctgcatggacgggccccggagggactgggcatgttatgccacagtcgacagaggatatcccagacgtgcccccgatgacactggtcggagaatgtgattggggcggactgtgtccttaaccaatacgtcatagcagctcgaatgacgaattcatcacagatccacagacaatgatggatcagacaacagaagcagacgctgccctttaaggagggccaatatcctacaggactttgaaggaagagatgctcgtatgccacaagtaaaggagtaaacatctatggtaccatataacctattggaaaaacaaataacaggatcttctaaacaagacgcagagtcaaagaggctaggattatagcaaaaggagcccaggaggaacattccaacggaacaacataacagagtacatgtacagaaggattctgcagcaggcgcggattatacagtttgcacaacttcagttcctggacactaaagagctcttcagaagcggacaacttgatgtccgtgaactga

SEQ ID NO: 505758 - DNA, 654 bp, Homo sapiens
ctagagtaacactggtcatccagtgactgcgtagctaggattacaggtgtgcactgccacacccagctaagttttgtatttttagtagagacggggtttcaacatgttggccaggttggtcttgaactcctggcctcaaatgatccgccagccttggcctcccaaagtgctgggattataggcgtgaaccactgtgcctggccaaggcattcagttttaagagagaaacagggcataaaagtttggaaaatttgcagcctgacaatgttaaagaaaagaaaattccattttttgaggagaaattcaagctggctgcagaaatttgcataagtaacgaggagccaaatgttaatccccaagacaatagggaaaatgtatctggggcatgtcagagacctttgcggtagcccctcccatcacaggcctgaagatttaggaggaaaaaattgttccatgggcagggcccagggtcccagtgctgtgtacagcctagggacttggtgtcctgtgtctcagccattccagccatggctaaaaggggcaacatagagctcgggctgtggttcgaggatggctggcagctcctgtggtgtgatcaagcgtgagtgccgaagccagatgaggttggaaacccggccgattcgagatgttgga

SEQ ID NO: 505759 - DNA, 850 bp, Homo sapiens
  misc_feature (99)..(99): n is a, c, g, or t
  misc_feature (103)..(103): n is a, c, g, or t
  misc_feature (117)..(117): n is a, c, g, or t
  misc_feature (139)..(139): n is a, c, g, or t
  misc_feature (141)..(141): n is a, c, g, or t
  misc_feature (143)..(144): n is a, c, g, or t
  misc_feature (162)..(162): n is a, c, g, or t
  misc_feature (174)..(174): n is a, c, g, or t
  misc_feature (181)..(181): n is a, c, g, or t
  misc_feature (189)..(189): n is a, c, g, or t
  misc_feature (215)..(215): n is a, c, g, or t
  misc_feature (228)..(228): n is a, c, g, or t
  misc_feature (234)..(234): n is a, c, g, or t
  misc_feature (247)..(247): n is a, c, g, or t
  misc_feature (262)..(262): n is a, c, g, or t
  misc_feature (270)..(270): n is a, c, g, or t
  misc_feature (289)..(289): n is a, c, g, or t
  misc_feature (291)..(291): n is a, c, g, or t
  misc_feature (314)..(314): n is a, c, g, or t
  misc_feature (321)..(321): n is a, c, g, or t
  misc_feature (326)..(326): n is a, c, g, or t
  misc_feature (332)..(332): n is a, c, g, or t
  misc_feature (348)..(348): n is a, c, g, or t
  misc_feature (351)..(351): n is a, c, g, or t
  misc_feature (372)..(372): n is a, c, g, or t
  misc_feature (380)..(380): n is a, c, g, or t
  misc_feature (384)..(384): n is a, c, g, or t
  misc_feature (389)..(389): n is a, c, g, or t
  misc_feature (415)..(415): n is a, c, g, or t
  misc_feature (438)..(438): n is a, c, g, or t
  misc_feature (460)..(460): n is a, c, g, or t
  misc_feature (488)..(488): n is a, c, g, or t
  misc_feature (495)..(495): n is a, c, g, or t
  misc_feature (501)..(501): n is a, c, g, or t
  misc_feature (669)..(669): n is a, c, g, or t
  misc_feature (816)..(816): n is a, c, g, or t
tgcctggacccagaggcccccagggagctcttggggagcccggaaagcagggatctcggggagaccccggtgatgcaggaccccgtggagactcagganagcnaggccccaaggganaccccggcaggcctggattcancnanncagaaccccgaggagcanccggagaaaaangcgagcncggcccangcggccccgagggaggccgaggcgantttggcttgaaangagaanctgggaagaaaanaaaaaaaagaaaacntgcggatnctggtccccctggtgagcnangccctcgggggccaaaaagagtnccaaganccganggtgancccggcccccctgganaanccggtctcacggagtgatgangtcatganctangtganggaaaactgcgggtgctgcgactgtnaaaagcgctgtggcgccctggangtggtcttcgtcatcgaaaacnccgaaaacattgggtacaacaacttcanactgganaagaanttcgtcatcaacgtggtcaacaagctgggtgccatcgctaaggaccccaagtccgagacagggacgcgtgtgggcgtggtgcagtacagccacgagggcacctttgaggccatccagctggacgacgaacatatcgactccctgtcgagcttcaaggaggctgtcaanaacctcgagtggattgcaggtggcacctggacaccctcagccctcaagtttgcctacgaccgcctcatcaaggagagccggcgccagaagacacgtgtgtttgcggtagttatcacggacgggcgccacgaccctcgggacgatganctcaacttgcgggcgctgtggacccgacgtcaca

SEQ ID NO: 505760 - DNA, 211 bp, Homo sapiens
ccgcacagtttaagtcggctgctaggcgcggcgaggtgaggtgcgcgcggggtcaagcgattctcccgcctcagcctcctgagtggctgggattacaggcacatcccaccatgcctggctaatattccttttttcgtttttgaggcaagattttgtcgtgttgcccaggctggtctcaaacccctaggctcaagcaattcacttacctcag

SEQ ID NO: 505761 - DNA, 432 bp, Homo sapiens
  misc_feature (15)..(15): n is a, c, g, or t
  misc_feature (28)..(28): n is a, c, g, or t
  misc_feature (46)..(46): n is a, c, g, or t
  misc_feature (222)..(222): n is a, c, g, or t
aatggggaaaaactncccaaggtgtgtncctaaaaactgtgaagcnaaattaaaactccaattgaaatactattttccacaaaatacatgtaatgccttatcctcactttaggatgaacccaattcctaaaaatccctacttaagaaatagttatgacccggcatggtggctcatgcctgtggtcccggcactttgggaggccgaggcaggcagatcgctanaggtcaggagtctgagaccggcctggccagcatggtgaaacactgtctctactaaaaacaaaaattaaattagccaggtgtggtggtgggtgcctgtggtcccggctactcaggaggctgaggcaggagaatctcttgagcccaggaggtagaggttgcagcgagccaggattgcaccattgcactccagcctgggtggcagagcaagac

SEQ ID NO: 505762 - DNA, 267 bp, Homo sapiens
acatgatcgagtcgagctcggaccatgcttaagtcatttcagtgcagtattcacacataagagatgcacacaacatgtgcttggggcatacatagaaatagaacctcgagttatagagatggcaaaggttttttaaaggaagaggtcatgaagttgaaccttaaaagagaagaatgtcccggtataaatggcaagtagaaattgcatatatttaaggcatacaatgtgatgttttgatatatgtatatattgtggcatcgataaaca

SEQ ID NO: 505763 - DNA, 289 bp, Homo sapiens
agtgaccaagattgtttcactgtgtccagttttcaagatgtgtttagaaatactgtaataactaggcagtagtgatataaagaatgatatccaaggtaatataaaacccattgcgtatgaatgcacccgtgtgtcatgatgtgtgatattctgtgatctattgtccactaggtatcttgttaaatgccagtatttcagtttttgtgaagccctgaaatggtaattgtcgcatttcagaaaatgtctttcacatcaatcaataaaaagcttttgtcaagaaaacaataga

SEQ ID NO: 505764 - DNA, 182 bp, Homo sapiens
tgatgtgtcgttcctatcaaaaggattcgaaactataccatctgtgaagaaagtggccctttctcccgcttgcaaatagacattctcaattccaaatgccggccaagaccccaatttacctgaaagcgccataacagaaaggaagaatataaactgagggcatactgtctcctgattgatcg

SEQ ID NO: 505765 - DNA, 108 bp, Homo sapiens
taaggtttatagcctactgaggtagtgtgtatggtaataagaataagaggggaggttatataggtctcttccgatatatagtggttagagcaaatgcttaaaagccat

SEQ ID NO: 505766 - DNA, 273 bp, Homo sapiens
catgttggctctcgctgtaatcccagcactttgagaggctgaggcagaaggatcacttgagcccaggagttcgaggctgcagtgagccatgactgagtcaatgcactccagcctgggtaacagagtgagaccctgactctcaaaaaaaaaaatggaggtggggggcggaacggggggctgatagacattattcagaatgtcaaaagatagaaaatgaatgacaaatgaatggataaatgaaatgtggtatatacatacaatggtccgagcgga

SEQ ID NO: 505767 - DNA, 186 bp, Homo sapiens
  misc_feature (37)..(37): n is a, c, g, or t
  misc_feature (46)..(46): n is a, c, g, or t
  misc_feature (93)..(95): n is a, c, g, or t
  misc_feature (98)..(99): n is a, c, g, or t
  misc_feature (160)..(160): n is a, c, g, or t
aaaaactctaaactttttaaagattatagatacactnccaaacatntcaccttaaaattgtataaggctgaatgaaccttccatacagaatgnnnggnnactctcataaaaatacagtaaactagtgtagcaaaagtatctgtaaaatccatggaaaatnaaagttgtatcattctttttcaaaaa

SEQ ID NO: 505768 - DNA, 1094 bp, Homo sapiens
  misc_feature (1094)..(1094): n is a, c, g, or t
tagtagatatggggattcaccaggtgggtcaggcgggtctcgaactcctggacctggtggatctggcgctggcctcggcctcccagtattggggattacagggctatggagccaccatggcccgggccttaaaatggccttcttaaaggaaaaatggccaactccatccttaatctcaaggaaattctggattggtgccaaattaagatctggtgaatattggtaacatatttaatagggtaactggctggtggtaaaattataaggccatattttaaaagggttttaaaagatacttatggtggctccttgtgggtgatataatttctaacatttcgtgctcgtggtgagtggggggtataaattgggtaagaattaagaggcaagaggaagtggttagcattacgcaaaagagtggtgttgtgacagtgagtttaacctttttaactcgcaacccttagtggtgacataaaattacctccacgggttaaaaaaaaaaaaaaaaaaaaaaaaaaaaaaaaaaaaaaaagggggggggggcgccaaaaaaccccgggggggcccaaaataaggccacacccattttcggtgacacaggggggccccaaagaggggacaacataaaaccacgagccgcgccgccgcacaaacgaggctggcgagcgaggcacacacgcacacagagggacactcggggaagagcaacccaaaacgagggggggggacacactggcgcgccacaccccaccaagaaaatatcaagcgcccagggggacacacacaatacacggagtaccgcggtaacaccagggcacacacacagcgctagaaaaacggcacagcgcacacaagaaacttcggggccacctacactcaacacagagacgaacgaccaacacacagccaagccacgcagcagagaaacgcaggcgccacaagacggcacaaaccacggagggcaccgcgagagcgaacaactcggccgagacaccagagagaacacagggagcgagagcaccaggcgcgccagagccgagcacaggcgaggactactacaacgcggaccacgagccccgacccaagcacacaaaacn

SEQ ID NO: 505769 - DNA, 957 bp, Homo sapiens
ggagtcagttccgtggtaaggtgatctgactctctgtacgctcattttgcatatgtttgagaattgtccccgtagtatccaatcgatgtctgaaccactcagagtcctggtgactggagcagctggtcaatttgcttattctctgctgtacagtatcagtgaacatgagagtctgtctttggtaaaggatcagtcgctataattcttgtgctgttggatatctgcccccatgatgggtgtcctggagtggtgtcctaatggcaatctagagagtttgtgcaccttctcgcctcctgtaaagatgtcatcagctaaacacgaataagaagagacgacgttagcctatgcaaatgacccatggagtagtcgtgcgcagtaattctttggtggggctcctatgacaccacaagagaggggaagggcgaatgtgacgaggatgagagattgcagcgttgaataggcacagattgttgacaaaaatctatcacatagtcccctaagtggcttgtcgatgctctgtagcatggatttaacgccatggaagttccaagctaaggttcatcggtacgtggggtaaatactcaagcctagataacctaatctggtccttggtagtaggtttcccaagttccagactaccaatacctatcccccaaggggaggaacttttcaagtaaggcatagagtccgtttgagagtcaacaaatccggcacggctaatagtgcctccccattggctcttgaaaaagtatgcgcagtggactttgctcaaattgagttgtccaatgaaatgttcatttaagtcttggggcgcacaaccatttgcctccaagatcagtaattccaaggattgtcgaaccaattggccaaaggcgaaaatttcgcacacgaagcagcgaaggtcaggtcgttattgaagcctcctgaaagatgaacagtgggctcacgggacaattc

SEQ ID NO: 505770 - DNA, 773 bp, Homo sapiens
aagaggagctcccctgcatgagatctcacttttgcctgctaccatttatgtaagatgtgacttgctccttcttgccttccatcatgactgtgaagcttccccagccatatggaattgtaagttcaattaaacttcttttctttgtaaattacccagtctcgggtatgtctttatcggcagcatgaaaacggactaatacagtaaattggtaccaggagtgggatgttctgaaaagatacctgaaaatgtggaaacgactttggaactgggtaataggcagaggttggaacagttttgagggctcagaaaaagacaggaaaatgtggaaaagcttggaactttctagagacttgttgaatggctttgccaaaaatgctgataatgatatggacaataagacccaggctgacgtggtctccgatggagctgaggaacttactgggaactggagcaaaggtgactcttgttatgttttagcaaagcgactggcagcattttgcccctgccctagagatgtgtggaactttgaacttgagagagatgatttagggtatctggcagaagaaatttctaagcagcaaagcattcaagaggtgacttgggtgctgttgaaagcattcagttttaaaaggaaaacagaggatagaagttcgaaaaatctgcagctggaatgcgatagaaaatggcatttctgatagaaatcaggcagtgcgaattgctaaggaaggagggcaatttatcccagaatggggaaatgttccggcgttgagtta

SEQ ID NO: 505771 - DNA, 113 bp, Homo sapiens
caacttttatttcctcagagtcttccttaatcctatggaacacgaagctgcactgaatctgggcccagtatagggggctggcttttctacctccctccccccaactataacaa

SEQ ID NO: 505772 - DNA, 113 bp, Homo sapiens
agtcaaatctacagatccccacctgtagcttccaaagcatcgtcaaccacatcaccacgaaatccacaaacacacagatcaataccacaatgccacggttccatcccacaaat

SEQ ID NO: 505773 - DNA, 354 bp, Homo sapiens
caagtattgctgaatgaataaataaataatacatggtaaatgtctttttaaataaatgccaacataggctgggcacggtgcctcacacctgtaaccccacttctttgggaggccaaggcgggaggatcgcttgagcccgggagttccggatcaccctgggcaacatggtgaaaccccatctctgtaaaaagtgcagaaattaactggacatggtggcacatgcctgtagacccagctacttgggaggctgaggtgggagggtcgcttgagcccgggaggttgaggctgcggtgagccatgattgccccactgccctccagctcgggtgatgcagtgagacccttgtctcaaaaa

SEQ ID NO: 505774 - DNA, 148 bp, Homo sapiens
cctccctaaaaattggatggctgtaagcctttaaaaggcactctaggcactcttgtaagactcagctccaaggcaggaccccatatggtccttattacaagtgaaatatatttgaggccaggcctattgtaaaacctcctggcctgct

SEQ ID NO: 505775 - DNA, 1396 bp, Homo sapiens
gcacgggagaaaggtctcggtgaggtatcgggccagcgacgcaagagatggaagctcggggcggatgcgggagcggcggctcaatgagacacgggagtgctgggcggcgacgtcccgtgcgtccagcttccgtctcgacctctaccacgttaacgctcgtcggtgcggcttccaccgcatgcgactctaagcggcgcgagaaaactcgggtgacacacaggaaagatcccgtgggttagcttgttactgtaaaaggaactgtcgatgggaaatagcgatagacccaggacgtcctgtagtgctagttttgcgtcgtctcgagaggtgtagcctccgcgagtgatcgcgttgtataccgcggctgtaccgtgtcatggagcagagtggtattgcgcgcaggctagaaggggtgtgaccgcggccaggctcttaccgcagggcgtcacgcataagagggacatgctcagacgcagcgtgaggcgcccggtcgcgtgcatggcgtaacccatgtgctacgtccgcctgactgcgcgtaggctgcgaaaaaagcgatgcgggggcaacgacgctattgaaggaccttgctagctagccactgggaaacttgcgtttgcgtaccaccaccgggtagagagccaaacatcctgtgctccgaggagttgagggcttgatacccttggcctacgaggtaatgcgctatacgcgggcacggaagacgttatgttcgcggataggagcacacctctcgaagcgcaatacatacaggtggaggctttaacccgcctggggggcgtccccggccagaggtcataaacgctttgaagcccttagcgcacgtcgaaacgaaaagtccggagggtccgggatatcccaagggtacacctgtgaggcccacagataggcttgagacatatatattagccctgtggttgcgcccaaaggactcgaaggcaccaagggatgttatagttagacgttctaccgaggcgatggcgtagtaggtccattgcgagtggcgcaagcagtattggggatgcagtgctacgggggggtaagccgcaagtgggggaataggcccaaggacgacctaacgacggagcagttcccaaatataagagacctgtgttcgcaaaccttggggacctctcagaaacctacttttaacggtccaagcactaggaatcgcggaattactggaggtgacaagttcaggcgaaaagtttgggaatcttacctggggaaggtatatacaacccagggttttatggaaaacgtaagggtaacgaaactaagtgaaaaattaagaacacgggcgtcggggaccagagaggggcagtatcatctgcacgagagtggaagtatctgggaatggcagggtgcccgggaaagaggcggg

SEQ ID NO: 505776 - DNA, 436 bp, Homo sapiens
tctacctaggagagtgccttcgagagcgagagggaggtgtctcctgacgctaagagcttgctgctgaacctgggcaaagacagcaacaacgctggtgcgctgctacttcaactcctctgcttcaaccgcaccacggacgaccccaacaccatcgtgcgcaacagaagcgacggcggggcctgggagcaccgaacagcgggaggctgtttttcccttacaccctgaaagtgtcgcagaggtgcgcatcatcttagaccagcccaacctgaccgtcaagctgccatatggatacaaattcaagttccccaaccgtctaaacctggaggccatcaactacatggcaggtgacggagacttaaagatcaagtgtggggcctttgactgaaatcacccaccccatggcccccaataaaggcagctgcctgtgctctctctg

SEQ ID NO: 505777 - DNA, 1698 bp, Homo sapiens
tattagggggggtgaaaaattgttgtgtgtggttaaacacatcttttggggtggtagtaatgcctcttcgtatgtttggttggtgttaaaaattgtgtggcgattagttgtggttgggttgtgattaattaacagcgttgtggtgtgtatgatatagtttggtgtgttgccccccataacaacaggaagtgagtgttttgcgtgggggttgccgcccactacatatgtggtggcccattccttttgtgggccccccccgttttggttttgtgatggttcgggccctctcgagtaggtatcttgggtgggccgtgtgttcttcgtcagtgatagaggactcgtctttggtgatctcacctttcgttggtggttgaagaaagtaggattgttggtggctttcttgtggtgatgttactccccccacctcaccgcaggatggattgtttttgtggtgtaggtccctcctcccccctctggtggtggtgtactacacttgttgggagtgagtcgttctccccccctcacttgttagtaggtaggaggtggtagtatgtaataaatatggtgtccattcagcgtgcgggatggaattgttgtagaattattgttggtgtggttgttgtaggtgctgctagcaggaggtggaatatgtaagtgggagataaatatatggttgtgtgctcccccacactcgtgtacaccaccacagttgtgttgtcgtctccacagtgattattacttgttcatgatgagacttgctggttctgttgagggacgaccaccactccactaccctacactgtggttgtagaattagtgtggtggtgttgtgtgattaggagtgtgagtagtgtggcccccctctgctgtctctgtgtttgcctcttcttgtgtgcgctctgtgtgtgtgtgtccctctcactgtctccacactgtggtctcctcccctcgcccctactgtggtctccctgtgtcaccctcgcagtctgtgatgtgtgtgtgtgtgtgtgtgagagagctcccaccatggggtgtgccacaagcagtgtgtgtggtggtgtgtcctccctctgtagtagtgtgtagtagttgagtagtagtatagtagttgtgtgataaacagagcgagtagtgtaagtgtgtggagacacccacatgtagtgtgtgtgtgtgcgggtgtgtgtgtgtgtgtgatagaactgtggtctcgtgtgtgagaacctgctcccccacgcggtgagaaggcgcgtgaaagagtagaggactcacacatacgcgtgtcgctgcggggtgtgggtgtgtggtgtggcggctcacacacagcagccctggagaagtctccacaccaccgctgtgtgtggagagaccgctgtggggtgatgagagagagaagtgtgcagctgtgagagcccaccagagaggtgtgtgtataaccaccccgctgtgtgccacacacgcgcgccacaaccccacgtgctgtgtgtgtcccacacaaaataaaaagtgagaccccgtgggtggtcacgtaaaaagtcgtggtgggtcccacacccccgctggggaagtgcgtgggggtatagaagagtcacccgtgaacgtgccccgtgggggtgtgaagtcgtcccagtgaacgtggtgggccccccggcacgtcccaaccgtggggtgaaccaaggtaagaacccggtgtaaaaccca

SEQ ID NO: 505778 - DNA, 210 bp, Homo sapiens
gtgtctggtgtgagaacgatgggcacctcaactgcttcgtctcggccgctgaaggcgtgttcctgtcgctaattcagaagcactttcctgtccaccaatgagaaatgcgggacagatggagcgggcagcaatgcggaaacggcgacctcggtggacgctgtggccaaagccccctgtgcttggtgtgcgagacacgcgggcgtcactccg

SEQ ID NO: 505779 - DNA, 793 bp, Homo sapiens
ggttccggcgcacgtaatcgccgagggcacgtgcatgcccccctgggttaagagttgcaggtagcggtagcgatggaccactctggatcgagtagtaaagcccaaaacggaaaagagccaagagattccttgaagaagagagaaccgaaactcaattgacaattattaaaaagtgccatgcttgattaaaagcgggggaaaatggcaaatatgccacaggtgacaaaacagtaccttaacacgattgtgtatgcaacgtggaaagaaacccataggggtggtacctaatataaaccacgggacaaaactatttacaaggaccctttttgagggattcagaacattcaccgtgacaatttccttttacaaaggaacgtccaggattgtgttccttttattcacaatgttttgggcctccccaataaataaggaagccggccaaataatctagtacactaaggtcgtatgtattgaccttacccattgttgcctgggatattgattggacacttgacggtatggcagaaatttggtctctctaagagaccttaggaaccagtaaattgtcctgagggaacaaaaacccaatgctgatattggctggcgatgatttgcgatgtaacagaagattatagaagattaaaaaagtcttcttaatggattcttcagaggcccacagtatcaatattccgctggtggatcagagtatgtcctgcacttcacttgcactgaatggcacgattactttcgagctaaagtgctgtggaaacactcgtgttgcgaaccacacgga

SEQ ID NO: 505780 - DNA, 117 bp, Homo sapiens
agacgagatagccatagtacgactagtttactagtctacagttagatagaccataccagtacatcccaaggctggtaaacccatacgaggaccccatgcccttacactagcccaaca

SEQ ID NO: 505781 - DNA, 874 bp, Homo sapiens
ccctgacccaccgcgggtaactgcagttctccgccccgaatccggtttccggcccccacataacgatcgggcggtgccacagccccacccctcgtgtggggccgctctgcaacccggggatgcagtggagcccctgtatagtggccgtgcacagtgccacacccccatatttgtgcgtccctccaggtggtatggctccctttctacgagaccacaggcgagccgtaccgttttgagatctccgcccagcaccaagagaagctcagccaacattcccgcgggtacctatatattcgggccccgctactgtttttcccaccggcgggacagcgcggcgtgtgccgcactaccatgatcgcggcgcattcctggaacggggagtcaccaccgctagcggcatttcgtccacgacaccgcgacacctttctcgcacgtgcagacccgcccctagggtagccccccacccttggctgcaggcatgaaaacgccttgtcgccgccgcacctccgtgcctagaaatatattagaaatcgttattcctccactccagggtgtccatcatctcgcctccacaaagccattgagaaagaccaccagtgattctctgtggccatgcatacacttctcagcaatagaattgctgcttcctcctccagggctcccctcagtcgcgcgattcttcaagccaccgcagatacccactcctcaacagttcatgaggggcacccccacttatcacttattccctaacatgtgtgtaggctttcccatcatcatacccattactgttcctaccccccacccaagacaccatgtgatcaccaccctgtcatccccaccctccatcatgaaatttttcccaccccacatgaca

SEQ ID NO: 505782 - DNA, 931 bp, Homo sapiens
  misc_feature (32)..(32): n is a, c, g, or t
  misc_feature (65)..(65): n is a, c, g, or t
  misc_feature (68)..(68): n is a, c, g, or t
  misc_feature (91)..(91): n is a, c, g, or t
  misc_feature (97)..(98): n is a, c, g, or t
  misc_feature (104)..(104): n is a, c, g, or t
  misc_feature (118)..(118): n is a, c, g, or t
  misc_feature (123)..(123): n is a, c, g, or t
  misc_feature (129)..(129): n is a, c, g, or t
  misc_feature (131)..(131): n is a, c, g, or t
  misc_feature (148)..(148): n is a, c, g, or t
  misc_feature (152)..(152): n is a, c, g, or t
  misc_feature (159)..(159): n is a, c, g, or t
  misc_feature (164)..(164): n is a, c, g, or t
  misc_feature (172)..(172): n is a, c, g, or t
  misc_feature (186)..(186): n is a, c, g, or t
  misc_feature (210)..(210): n is a, c, g, or t
  misc_feature (219)..(219): n is a, c, g, or t
  misc_feature (227)..(227): n is a, c, g, or t
  misc_feature (331)..(331): n is a, c, g, or t
  misc_feature (434)..(434): n is a, c, g, or t
  misc_feature (449)..(449): n is a, c, g, or t
  misc_feature (453)..(453): n is a, c, g, or t
  misc_feature (459)..(459): n is a, c, g, or t
  misc_feature (461)..(461): n is a, c, g, or t
  misc_feature (819)..(820): n is a, c, g, or t
  misc_feature (916)..(916): n is a, c, g, or t
ccaggatggtctcaaactcctaggctcaagtnatcctcccgtcttgccctcccataatgctgggntgncgtgtgagccactataccttgcngttttnntttttnaatggttgagttantaggntttgantnttggggacatgagaatnttgngggagtnaaatntgggggtncataaatggttttnggtggggcgcagccatgctcattngtttatgtntctgtggntgcttccccaccacaacagcacagttaatagctgcaacagaggctatatattgtgcacaaagcctacaactttactactaggccctttacagaaaacatttgcngacccctgctctagaccactgaaaaccctcatgctcatcattctcaacctgaagatctctctaccaaatcctaactttaaaaccttgctcagaaatccatctnttccatgaagttatntttnattatntnacccatctttaatcaatcaatttcactaatctccaaagcacaattacacacataatttcttggagctgattcagttacactttttgtaagtggctttctccttactaaagtttctgtaagaacaaactacagcagctgttttttattttatttttctatttctgagtataaagctctgatacacaaacactttattaatgtttttgaatgactggctgctcagagtctttcaggttattgtacctttcattgaagactcaggtccgctggttctttgagagccatgagcagagctgttgttggacaccaccactggcccaggactctggcccagggaagggatggtgttaagggtatnnccaatttggccacttcattgctattttcgcctgtcacacaggtcgcttcacagtgacaaagctggcaatgctcactgcaggtggagaggggaaggngggagctagcttggg

SEQ ID NO: 505783 - DNA, 315 bp, Homo sapiens
agtacacatgatataacacagactgaactaagtctgaaaagcagaatacagccaggagcggtggcccacaactgtaatcccagcactttgggaggccaaggtgggtggatcacttgaggtcaggagtttgagaccagcctggccaacatgacgaaatcctgtctctactaaaaaatacaaaaattagccaggcatggtggcgggtgcctgtaatcccagctactcaggaggctgaggcaggagaatctcttgagcccggaaggcggaggttgcagtaagctgagattgtgccactgcactccagcctgggcgaca

SEQ ID NO: 505784 - DNA, 1730 bp, Homo sapiens
  misc_feature (307)..(307): n is a, c, g, or t
gctggaagcttgcgccgcttgtcccggtcggtggctacggcgtcgtgcggatgcgcgtcgttacccgctcctactggcgcgtcgttcgtgcggcgtgcgtggctctcggcgcctggctctggtgccatgggccctcggctcgtggaccgcgtggcgggcgtcccgcccaggtcgctctcttacctagctgagtgctgtgcatgcacgagtagggctccggggcacgtcaaagcagcgaggacgctcgaacagtggtcgtatcgtggtggcgaggaaagaggcttagtgtgggcatcatgaataaggngaaacgtagctatcaaccccaagcgtagctaatgcaagataggtaacacaaaaagggtacatttcttgtggcgaaaaagtaccaaaccaagttcccagtcaaaggcattagcagaaggatgccgtagttctcctcgggaataagtagtagagacagggattcgccgtagtgggggaagcagaggggtggcgtgctacccaagccaaagtcgcgctaaacgcgaacttacatgcagaaaagctcctttttaaccggaatggcaagccccttgagggggaggcattcagtgtggggaactcgcgaaacgccagcgccaaacttacaagtgccgtcgattaccaaccggggaagccctggcgaccggggagggattagccacctgcacgggcccgatgttaggcaactgagaacgcgtgggccccgcgtgtccatgcccttttcgcgacgccattgtcttatctgagcgcgcattaatgcaacacacgaaatgggacccgttgggtagccaccctttcgcgttttagggccccatagctttggcagacgatggtctgtgggtagccttcccttcattgggaattccgaatgagccaagactgtggcttgcaaaagcgactttggaggcgcctttggacattaccaatagtggacccccaatactacaggctttagaccccacttacttgtggtagggggcacagccggagtcgaacggttgccacttgaagcctttggaaccttggaaggggcctggcataacacagaggcgggcccacttgaaaggcgtccttccaaggccattctttaagtgggtaccccaacgaaaactttttccacagaggaagtgtcgccagcgagattccaagagcaagcttaactctcgcttacagcttggcgggacatccgtggtatagccgtggtggtggaaacacctggggtttgtccccgggtgggcctcctgtcgtggagaaagagacacgcgagtcccaaacacaaaggatagccaagcacccaaacaagacggggaacgatgtagcccgtgacaacgtttcaaattcgcaacgtcaaaggggggccacaggtcttggccaagcccacagtagacgcccatgagcaaaaaaccccccagggagaaggcaaccacacactagaagaaacatcagcaggacacccccccttggtgagacaaaccaccctttcgtcggtacatagagtatcgagtgcgcacaacccactaggggaggccacaaaacagcaaacagccgtgcaacgggacacacagaccaaagagaaagccggtgtatggccacccgacctacatgaatggcagcctcaacagagacaacccaacttagtgcaaaaatagacagaccgacacacatagcgaacgagcaccacgacgcgcgcgcaaacagctcagcaa

SEQ ID NO: 505785 - DNA, 545 bp, Homo sapiens
tcagcggtaccgcactgctcccatcagtgtgtaagttacatcatggtcactgtatgtaaggcagttaaaaatctcatgtgttaatttatgaaagttttttttttttaagattcatggcttccaagtgcaacaaaaataaaaataaataaaggggatctaattaaactaaaatgcttctgtatagccaaagaaataaccatcagaggaaacacacaacccacagagaaaatattggcaaactacgtatctgaaaaaggactgatatccagaatagaaggaacacaaacaaatcagcaagaaaaaaacaaataatcccatcaaaaagggggcaaatgagatgaacagccatttctcaaaagaagatatacagatggctaccaaacatatgaaaaatgctcaacatcactaatcagggaaatgcaaattaaaaccacagtgagacaccaccttactctggtaagaagggccattattaaaaggtgaaaaaaaaaacatatggaggtggatatggtgaaggggaatgcttatatacggcagaggggacg

SEQ ID NO: 505786 - DNA, 817 bp, Homo sapiens
gacagaggctgtcgcagagctgtgggagatgaatgccagaggacttggatctgagctaaaggacggtcttccagttactgaggacttgtcagcaagtggaccttttgaaagtggcatgatcttcttcggtgacagaggttatgttctctgttgtggaataggcattgaccttttgccatagttgccatcccgcattgagatgtagtccagtaggaataggaaatttccaggctccacatcaggatcaacatgatcttttgcggcaccactgagaaagattcagggtctattggcttccgcgcatcatcattgcgaggatggaattcaagggcagtgcgagctgggttcatgcgtcttcggattggcttgtcaatgctcaaatctttcatctggatgtatggaggggtaatgattgagactattggagtttgatggatattcttgagatgatccattcacaagatgcgaagtcgatgggagaggcagcacttgaatggtggaagtatagtagcttggtttacatgtgaaggtagtgtgctgttcatgggaaaccgaggggcatgcatcttgttgaataggttcgattctttcgtaacggtacattttgggtgtaactcaaacgattcatgagtgctgaccacctgagaaatttctgcccaaggtaggatcgggatcaatcttacaccttggggggggaccttggtctacagcccatgttgacacattaaagggccctaaagggggacatgtcaacgctctgaatttatttaacacacgttccttggccttacaaggttgtggcgccgagattttactg

SEQ ID NO: 505787 - DNA, 87 bp, Homo sapiens
  misc_feature (5)..(5): n is a, c, g, or t
ggaanccttctcctccctcccccctcccccctcctcaagggagtggccgtggatatccggtttgttaataaagacaattcaaccagc

SEQ ID NO: 505788 - DNA, 130 bp, Homo sapiens
cacatgatcaacactacatcgacatcagaagagctaacaattgctggaatgacctttacaacctttgatcttggtgggcacgagcaagcacgtcgcgtttggaaaaattatctcccagcaattaatgaga

SEQ ID NO: 505789 - DNA, 183 bp, Homo sapiens
ggggggggggttggtttttaccccccccccccgggttttggcccccttgggccaaaaaaaaaaaacccccggggggcggggggtaaaaattggggttccccccccccccccggggtttttttttttttcttttttttttggggcccccccccttaaagggggggggggttttttttttcccca

SEQ ID NO: 505790 - DNA, 859 bp, Homo sapiens
  misc_feature (56)..(56): n is a, c, g, or t
  misc_feature (78)..(78): n is a, c, g, or t
  misc_feature (102)..(102): n is a, c, g, or t
gaaaaagtacattgaaattaggaaagaagccagagaagcagcaaatggggattcanatggtccttcctatatgtcttncctgtcatatttggcagacagtancctgagtgaggaaatgagtcaatttgatttctcaaccggagttcagagctattcatacagctcccaagaccctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacctgtcgagtgctgaaggattgttatccatcccttataggttaatatttgaaaagttttccggtaaagatcctaattctaaagacaactcagtagggattcaattgctaggcatcgtgatggccaatgcctgcctccctatta

SEQ ID NO: 505791 - DNA, 806 bp, Homo sapiens
  misc_feature (2)..(3): n is a, c, g, or t
  misc_feature (5)..(5): n is a, c, g, or t
  misc_feature (20)..(20): n is a, c, g, or t
anngnatcaggctacagtgncacagcagagtgaggagggagcggtccacaaaggactggcgtgtgaaacttaggcgggggtcatccttcctgaacatttcatacacgctttccagaaggcctagacctgccactggtcgttttcggagacgggagcagcgggaccccacggtgcatgatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacctgtcgagtgctgaaggattgttatccatcccttataggttaatatttgaaaagttttccggtaaagatcctaattctaaagacaactcagtagggattcaattgctaggcatcgtgatggccaatgcctgcctccctatta

SEQ ID NO: 505792 - DNA, 699 bp, Homo sapiens
gcgcaataacctagacctgccaatgaccgggaacgcacaactgaccgcagaaagaccacaagagcgcgagatgatgtgctggagctggagatggacgagctcaatcggcatgagtgcatggcgcccctgacggccctggtcaagcacatgcacagaagcctgggcccgcctcaaggagaagaggattcagtgccaagagatcttccttcttggatgaaattcctccatggcaaactgggaaatccaatagtaccattaaatatccgtctcttcttagccaagcttgttattaatacagaagaggtctttcgcccttacgcgaagcactggcttagccccttgctgcagctggctgcttctgaaaacaatggaggagaaggaattcactacatggtggttgagatagtggccactattctttcatggacaggcttggccactccaacaggggtccctaaagatgaagtgttagcaaatcgattgcttaatttcctaatgaaacatgtctttcatccaaaaagagctgtgtttagacacaaccttgaaattataaagacctgtcgagtgctgaaggattgttatccatcccttataggttaatatttgaaaagttttccggtaaagatcctaattctaaagacaactcagtagggattcaattgctaggcatcgtgatggccaatgcctgcctccctatta

SEQ ID NO: 505793 - DNA, 938 bp, Homo sapiens
ggggtggggcggcaggcgcccgccggagcacctccagttctgccggcttctgcgcgcggggccgctctcctcccgccggtgccgcgcgcttcatggaagccccggaggggcggcggaggggggcctgcagcgcgtggccggagggggcaggcggggcgccgaaggccagggtgcaccttccgagtggccgaggttcactcatgcaggcggggtgtccaacggctcggggatgggggccatttccccatgtgcctagtgtttgcccccattttcacccataagtttcctttgtgggcgagaaccaaaaccgtggaggccttatggaccctttaacctggatgtggccagttgtttcttccacaatttatcgtgggggcccgggcaaaggtggaaccagagccagcgcaaccgttgcgggacctcccgtggaacattcactccagttggtggttccaacgagggttacttttaaacccacagggcggggaggccccgtgggaagtgggacctccccgttgcgggaagaacctcgcgggaaccacgccattcgggggcaaggtggtggagcctcctcacattggctggaggagttctgggcgcttccccagggttctctttccaggctatccacgacaaaggtaccttgctcacactaacctgggtttcccctccaaaaagtgggtagaacgggccacaggtgggaagggaacccctggtggccggcaccgcctgggccgtggtgggggacagctacactggggcgctgggcctccgttcagggccagaaatcggcggaggggggccaacgtggcctgagggttacgggagtcgaggggccggcgaggaaaggagaaacggggggggagattaaccgggaccgagtccttaggcggccaggcggcaaaaagcaagggggggccggatgacagcgcgagggc

SEQ ID NO: 505794 - DNA, 932 bp, Homo sapiens
  misc_feature (4)..(4): n is a, c, g, or t
ctanctcttacctgagaggtgtctttataaaaacaaatcttggcagctgtccttagacatggtttatttaagaggaaatgtaactgggatctagttaaaattagatgtttgggcaacatatcccactcacaaaacattcaggttggaagccagcccggatcatgaaggaggaactagggtgatatgctaatcctccctttgggatttagatgaggctgtgcttttaaaaggtccttggccgtgacttgaggtggaaaggggaccttttggagtggtcatttggcactttcaaaactaatttgctgggaaaacaatatttatagggcttaaagccagatttcacatatcataatctaaatatgtgtgcctatctgaaaacttggggctcattacatggtatcttacccaaaattcacgaagttaaaggggctttaatggtgttgatctatatttgtttttatttcaatggattgggcctgtctatgttaggctacaaaaataagctgaggagtatggcttaccaatttaaatgtgcatgatttgtataagcggaacgacataacgagggcagaatacatgaaaaaagaaaaacagcagagaaagcacaaaggagaaggagaaacaaacagaccgagcggcggccccccaacaaaaagacacccaacacagagaggcaggcaagaaaccacgagaacaccgccaacagttgtcactatcacaagagaggacactgacataaaaggatgagaccacaaaaatgaacaaccagcgcacccccactagtagaacaacaccgaaacaagtgaacaacacacgcacgagacgcgactcacagatacaacacaccacacaagcgagacaggagacaaaagaccagcacacccacacggagaaatcgaccagacacagacaaacaagacgaggcagcagaa

SEQ ID NO: 505795 - DNA, 1406 bp, Homo sapiens
  misc_feature (638)..(638): n is a, c, g, or t
  misc_feature (652)..(652): n is a, c, g, or t
  misc_feature (684)..(684): n is a, c, g, or t
  misc_feature (1013)..(1013): n is a, c, g, or t
catacccacaccgcggcgtggggttgatacccgcccccctatgatgtaggtgaagacacctccgcgggggggcctgcggatgtctccattctcctttccccggagatattttttttagcccccttttgtggcgcccctccgggggggcccggggtagtgttacacccaacggtggtttgccaccgcaccacggggggtaataccatggcctttaatgcggcacccccacttaatgggggccccccatattattttttatagggtgagatcccagacgtaatattattgagggaacacacaagagtgttgtggggcacccacaaagaatatatcagcctacgggccgtggggggttacacccgggtttccccgggaaatttttcccccccggggggataactccggtccggaaaccccccaaccaggcggttcctccgcggggatacgacctttggggggggaaaagaatgtgtgcgggagaggtgcacacgagtaccctcggggggctcttggattgggtttcgaagggcccactagaatgcccttggggcccgccttgtgcagggccaacatttgttgggccttaaaccacacgcgtgatccttggcctggggccgcgaaaaaggttgtgattgtgntctgtatacacgcntgtgtgaaaaggcaacgtctaaaacaacaatngtctgtgcgcgaaaatgttgtctgtatcaaagagagagcacaaggttgaaaagtaaccctgggcgttttctctttctcggaatagccgcgagtgagatcaccccacaacccccttttctcgcgaggggcgccccctataccacacgtgttctcgggcgccacccacagcccgacacatttttctgggcgggagccaggtgtcagagagagtatatgctgtcgctcccatcccaaaaccacacagcgagagacccacaggccccgcttctttggagccccggtcttcaaaagaggtgttttgagccggcgaatctccacctccgcccctnttcggaccacaagagaaaaaagcgcgaattggtgggtgttctctcgctgcccttctcacaaggttcgtggcgttctgagaagcgctacacacacaagagaaagtttggcctaattcttggggcgcctcgggtctcacacgagaggtttggctgggagaagtgaaccacggcacgtgacacgccacccctggaaggaagaaagaggagaaagaggaaaggcccaagagatccacctatccggagaagaagaaaacacgctcacatgaggggctacggagaaacacggccgagagaaagaaacgtggagagaaagaaaattgacaaataacacagaggtcctcaagacccaccggaatcctggtttgagccccataaagactgttaattcctcca

SEQ ID NO: 505796 - DNA, 660 bp, Homo sapiens
tgtagtgtcactgtatatcaacttactaacattttcctcatcccttccactcacccataatgtatctatgcctctcttaactgtgaggctaacttctctattcatgggatttattccagccagataccaggcttaaacagtattctctgatccttaagtctatattccctgagtggatgaaactgttaattatccatccattgtccccgtctttctttctaataataaaaaggctccccaaggttttaggtagacacatggttacccagaaaggaaaactaaatttccccaggactccctttccagctaaggggtgacatgttataaatctctgggtcaagggtggatgggaggcaggattgtggccatataccaatgtccatggttcacatcttttaaaaaagggaaaactggcttggcctttccatttacttcctctctacatttccactggctagaaaatggtgacagtgagtaccagactcattgtacaccaggagacggaagccacattttgaagatacagagctgacctactgacctgagcccttgatgacatcattggtctagcgcccaaaatcaggtaccccctgtcaagtgacctcaaggtacgagctcgatcgaatctggtctgtgttctgtggatgtttcggtaccgaa

SEQ ID NO: 505797 - DNA, 485 bp, Homo sapiens
ttggtagcgaggggcgtaaggcttgaacgaatgtggggggtcggccacaactgaagttcacgactatttgattgagagccgtttattgcttctctaagcggatacaggtgctttagatgcgaaataatggcaacctataaggttactcggcaacgtgttggacatcgccctagcgtaatgaatcgggccgtcactcattgcgcgtacatggataaatcggccgctcttattgacgatgaaattcggcaaccatcggcatcgcgctatggcagcttcgcggaatgggtacttgctccagcagtcattgccgcattgctgattgccatcattcggcttgaggcgacggggcaggcggctcgcttactctggagcattcttttagcgtcattctgcgtggggctacttgtcgtggcctatgccaactacacgcgtcagtgtcgatgtcttgcgatcgtccgtccgtagtaagagcctctagagccaat

SEQ ID NO: 505798 - DNA, 937 bp, Homo sapiens
gcttaccacttcaggatgactatcctccctccagtggagaagctgaagacggtgctgcagaaggtgaaagacttccactatcaacttccgtggagaagtacgcgtgaggacgcctgagccccagcgggagacctgtccttgggctcttcctcccaatgcccgtcaggctgaactcgcctcccccgtgactctgcctcgggcctcgcagaggccgctggtcacttcgtcatcatttgcccctggagacgtctttcttgtgccttgatgttgagagcgcctctctttggagcaaacgaaggcattctatatgcaacagagtagaggggagctgctcaggcgggtgtgagccagggtgctctgaagctcgcgtagtggtgctcgtggatggaaagttcgaagtgtggggggttgacaacaactaggatgtgtgggtgagactgtgtcaagatgcttggagaaaactgagcgagttgtggagaacagtgtgtgaacttagacgtggtgagggtgaaaatgcgtaactcgcactaggatctgggagtaaagcctttaacggtgtgaagatccggtctttgaacagaaggcctggaaggcccctggggtgagaaaaggggtcgccgggggcactggaggcgaggcgcagggagccgcatagcaccgtgggacgggacgggctgtcgcacctaagctgggcggaagacgccgggggatgcgaccccggggccagaaagcgccccacgggaaaggtaggtgagaacccacgatcaaggagaaagggggccccccgctccccagcaacgccgccaggcctgaacaatcagggagccgccggcatgagaagagggcccctcacatcgctggtgacccgcgaaccgccccaccgcaaaacacacgggccgcaccacccccgggcaacgcgcagctgcccccctccaga

SEQ ID NO: 505799 - DNA, 604 bp, Homo sapiens
gcttttatagcaagggagcagcactcactcaatctgcagatagtcagcagcagaggagtggcagttttatagaggaaaatgggaaagcttcaagcctgccctgactggaggctgttcgctaggaagctggcggctggctaaggggaagcagctcatccactgtgatcggctaggggagcatatttggctttctctctggttggtctgaagttagaagtggggacaaaaatgagggaaactaatcaagtcctagctgttctgggcagactgttgcagaggtccttgtttggcttctcggattgtttgctagagacagtggtccgggccgggcatggtggctcatgcctgtaatcccagcactttgggaggccgaggcgggtggatcacaaggtcaggagttcaagactagcctggccaacatggtgaaatcctgtctctactaaaaataaaaaaattagctggatgtggtggtgggtgcctgtaatcccagctactcgggaggctgaggcaggagaatcgttttaacctcggaggcagaggttgcagtgagctgagattgcgccactgcactccagcctgggtgacagagtgagactccatctca

SEQ ID NO: 505800 - DNA, 408 bp, Homo sapiens
taaggatccgctgctcctcttaggacttcagcctagttgggggaaggcaggtacatgatcactccattacaaagtatctaagtacagaggcagcttgatggggggcaggatcagtaaagctttatcagagagtggtcttgagctgtgccttgaggacaggtggctggtggtatgaagacagcatttacaggggccctaactggtgcaggctctgtgaaggaggctttatagagatagatgtatttttcaccacggtccaatgcattaggtttcgttgtcttttgcacatgacaaatctgacaggctaaggacacattcaggtaggtgttggagcttggctttgagcttccagcctgtgctgtggggagaattccatcttatgaggtgaagaggggggcgcagcggtac

SEQ ID NO: 505801 - DNA, 265 bp, Homo sapiens
tagttacctctgcccctatgagaaacatccttgctcacactctgaaaataaggtcatcgtgtactctccttagcgcccctttcaaacgagtaggaaaggctaggagattagtctttaaactctaggtgtggactaagaacctctggatgtttcctacatactataagggttctctgaacaccagcagcggcaactggttgcagctaactcaagaccaatgtaaatttttcagatggctatgtgaagctcctagaaccaaagagaa

SEQ ID NO: 505802 - DNA, 343 bp, Homo sapiens
tatctaggctgtattacgtatatccattaaccaagttctgggtatataccctttccagtccctagataactactattctactctctaattctatgagaccaactttttttaccttccatttggaagtgagaacatgtgatatttgtctttctgtgcctggtttatttatttaacataatttcctccaagctcatccatgtagctgtgaatgacaagatttatttcatttttatggctggatagttggacagtactccatcatatatatgtaccacattttctttatctcttcttctgttgatggacacttaggttgattccatatcttgcctatagtgaatag

SEQ ID NO: 505803 - DNA, 465 bp, Homo sapiens
catatgggcgagcgtccctacagctttcagacgtgcggtcgcagcttccctgcaacgcgcattctgcggcgtcacctggctattctatcggagcccgggcaggagcatgccgagccccgcagtgagtgcgtggagtgcgtgtagagcttcagctgcagctgcaatctgctgcgacacctgctggtgcacactggcgcaggccctactccgtactgcagtgtggccgcagcttcagccgtaactcccaccttgcgtccacctgcgcactcacgctcgcgagacgctgtactagcttggcccgccttccgccagtttcgccctgcgccacctacccggggtcctccacagcggatgcctgcattaatgtcccttcccaccacaccccacttccctctccttccattttcatagctgtccttccctggccgtttcattgctttctggcctcagctatgtaattaaaac

SEQ ID NO: 505804 - DNA, 382 bp, Homo sapiens
cacaccacctgagtcataaatggagtccgtccagaggtatgtttactatctaagctatcgtgtgagctagtcatatataagttgttggctcacgaggatgataattcttgtgccgcgagagtgagtagtagaatgtttattgagcctccggtgttgtgagtgtaaattattgcgacgagtaggggaagggagcctcctacggtgtagaataagaaaaatgtgcctgcgtttaagcgtctggctggttgtctcatcgggggatgataaccaccgtggggataagtgtggtttctaagaaaatataaaatatgattagttctgtggctgtgaatgttataattaaagagatttgttgggagattagtatatagagggggagttt

SEQ ID NO: 505805 - DNA, 131 bp, Homo sapiens
  misc_feature (4)..(4): n is a, c, g, or t
  misc_feature (46)..(46): n is a, c, g, or t
  misc_feature (118)..(119): n is a, c, g, or t
gctnttcagtgactgtccggtcagtggcaagcaaggaggcaaggcncgcgccaaggccaagtcgcggtcttcccgggccggcatacagttcccggtggggcgtgtgcaccggctgctnngcaatggcaact

SEQ ID NO: 505806 - DNA, 297 bp, Homo sapiens
  misc_feature (40)..(40): n is a, c, g, or t
  misc_feature (58)..(58): n is a, c, g, or t
  misc_feature (62)..(63): n is a, c, g, or t
  misc_feature (71)..(71): n is a, c, g, or t
  misc_feature (85)..(85): n is a, c, g, or t
  misc_feature (101)..(101): n is a, c, g, or t
  misc_feature (105)..(105): n is a, c, g, or t
  misc_feature (107)..(107): n is a, c, g, or t
  misc_feature (119)..(120): n is a, c, g, or t
  misc_feature (125)..(125): n is a, c, g, or t
ttcggcacaggtagaatgttggcttctcttgggctgtctnctccttgacatcaaaggnaaannaggcaatntgtgaagccaattngtccctaaccggggtncttnangcaatttcagannaaccntctgactgttgacagacactccctggaggcccacaggacctcaaatccgccatgacataagcacacacggagctcatggcctgccccacacctcagtgtgcatgggatatcccgccttagcccatggcattcccatccagaagctaaatcgtggtaaaatacacataacagc

SEQ ID NO: 505807 - DNA, 707 bp, Homo sapiens
agcgggttgccggccgttcccacccctgtgttcggtcggccgggtgttctgcaaggctggtcaaaaaggggaagcggcccagatatgttaagttctatggccgctgcagggtctgtgaaggcggcgttgcaggtggcctgatggtgctggaagacatcgtagagctgctgcgtggggcccagaagcacggcaagtgaggtgtacgaagccccacttggcgaggtgcttctcagaccggaatgggaggcccggctccctggagggcagctatactttaggaggcaatccccaatagccacgggatgactagtcggcactggtgtatcctaagtacatctcacagacaaacaccaggaaggattggtagcaccaaaagcaattttattaatccgtacccgtattgcccatattggcgttaggaagggaactatgcaattgcgaatcacaaggaccacgcagcaccacacgggaatccttttgaactggttggtagagaacagcgcattcacaaacgtccattgtgacaagggtcaattcggcgcacaacgcatattcgtcaccttcagagcggggcacatctttaatattaccacaaaggcgtcctcccataaagccggttttccaagaaccaccaggataatttacgaccgcggtcatgacattgcggacccaggtaaccttcaagttgaaccacctttgaggcctat

SEQ ID NO: 505808 - DNA, 1751 bp, Homo sapiens
tattacaacagatcttttaatgactatttattaacataaagatggggtggtttgtgggaacaacatcttattctctttggcacacaatttccactaaaattttcaagtggtattaaatacacgtgcaccgaaacataacgtccgtggtggtccgtggtcacacaattaagaggctcccatgaacatacatacacccccctcccaagaccccccacccaagagcctcacaattctgtgcggcagtgggttccgagcgcagaaacacatcagacacagagcgcccagaaaatacaacacagagaaatcaccagtgagcacattaacgacagagagtgttacacagagacacacacgcgcactaaggggtatgtaccacactcacatgtgcgggtgtctccctcacaccacacaaacacagacatatccacacacagtgacacagaagacacacgtgggacagtgacaactcccagacacagtgagtccacaacacacactacaaataggggtgccgcacacacacgagtgcgcatgtcatccagaactgtgcgtcgctgtctcacacacacatctcacaaaccattgagaggggcggctcacacaccactctctcacacacaacaccagagccggcacacacggagacagccacacagcatcaacacggaggcaacacgacaacacacaccaccacatccaccgatctcaaccacaccacgccgtcgctcacaacgtcatcacaacgaacgactagtagagaaggagcacatcaccctcccaagcacccaccccatccaacccgcacgctggcgggatacataatcaagcatcaccacgcacgaaaaacgatcaacctgatcaagcaacaaccccgatctggtggcgcgacaaaacacaccaccaacaacaacaccacgcgtggctgggcgtcgcgcacaccccaccagactgcacgaaagagcaagcgcctcgcacgcgcacagacagcgagagacgaccgactacaacaccacccaaccagacgactagctggtcactgcttgtcctgaggggcggacacaaacaacgatacctcacgccgacaggcgacgcactcaacacacacagacagacacgaccggcgctcgctaggtagcacccaccctgggtgggtgtcgaccccaccatgcaaggactggcgccaccaacacaaagaagtggcatgtatacaccacgctcccccgaccccccacacagagaagaaagcgaacgacacactcatccccgcaaccttcctgtggacagcacaaacacagccaacacccggggcgcccaacacacacacacaaagcaagtgagtgtaagacacgaggtggacacataccaaccaaacaaaccaagccactaatcccacacgaaacacccacggcgtgatgcctccccatacaagaagctcactccaccgaggagtaaaacccatcttgaaggccacacaggctaggccaccgataacagacaccgtggaccaagcagcacacaacacctcgacgcacaacagaaacaaaaaatgccgacacattgagacccgcgcaagcctcccccacactaccactcaatagggaggacagagtggagacacgcatgaggcgaacaacactaatgccgttgggcacacacaacccaaatacacaaaaaagaccacagactagaagaactccagaaccaacagcactcccagcgtcagacacaactactaacaccccaagaccgac

SEQ ID NO: 505809 - DNA, 411 bp, Homo sapiens
  misc_feature (340)..(340): n is a, c, g, or t
gggtagctgggactacaggcgtccaacactatacccagctcatttttgtgtggtggtttttttgttttttgtttgtttgttgtttgtttttgtagagacagggtcttgtcatgtcgcctgagctggtctcgaactcctgggcttgagatactcccatcttggcctcccaaagggctgggattacaggtgggagccactgcacctggctggaactggtttttgtatgagatgtcttactggtggcttttcctaggcaaagggaataagatctcgagttcctactggaacctaagtgttagagatggggattcaggttaaatgagtggatgtgattacctgngcaaagcatgaggcatgcgaaggaatgggtaaagaatggctcttgagcagaatcagcctttagtggtgaaa

SEQ ID NO: 505810 - DNA, 776 bp, Homo sapiens
ctggagtggattaataacaatggaggtgccgcggccatgggggacgcttagctccatcacatctcaaatcgaatttagtgagattattgataattctcacagggattctacgtttgtcccgtggagccccaagagatttaagctagagtgaatattgccattccgcagttgtgcaatgccagaatggagatgatgctttataaaaacagattctcttgatattagctcttgtagactcaaattatgttgtccttgaaagggcagtaggtctgtgggaggcatccgggcctctctgtataatgctgtcacaacttgaagacgttcagaagctggccgccttcatgaaaaaatttttggagatgcatcagctatgaacacatcctaaccaggatatactctgttcttgaacaacatacaacgtttacaatgtaacttggggatggctactaataaagttaaccacagtagtgttttctcgaaatgaacgatgttttgattgccaggattgcttcatttctttgaaatgaacaagcaggcgaaaacgatccacaaatcttgttaacagctggtggggacctaaatgtcgaccttaagttctgacttgaactggaagcattttaagaaatcttgtagctttttacttaacaaaattccccgcgtattttgccttttgctgcgtacttttagctagttaggattttcaaacttgccctgtggactttaataacttgcaacgtttgcgaatttaacttaatttctagggaagtcatggggac

SEQ ID NO: 505811 - DNA, 954 bp, Homo sapiens
gtctaggaccttgttcagtccatatcctagaaaggtggctacagattcgattctgtgcttcctagtagcaaaagcaaaaaagggaaataggatccgtttcaaatgccaaacatttagaattggaaactaatcagttatttaaggagaagcagatttttttcctggtactggaccccatgcaaaatttctttcataatttctttttttttttttttggaagacgggagttccggctctggtcccccaggctgggatgtggcagtggaccgcgatctcagctcactggagaacctctggcctccggggtccaaggcaattctcctggcctaagcctcccgagtagctggggatccacgggcactggccaccaaacccagctaatttgggtgattttcagtcaaacgatgggggttccatcatatgggtcaggtgggtctgggagctcctgacctcaggtgatctggcctggcctgggccacccaaagtgctggggaaattacacggtggtgagccacggtgcccggggctcataattcctagtaagaagatgctagggatatgataggcatggcctcaaggacttgatcaacaaagttatatttcatggttttaccatagccctttatggcataaccaatccaaagcatcatcagagtgttatcatacatatatcgggggtacagaggtaatccttgggtaagactccagaatttctggaaattggttgacaggattggtatgctaagaccatagtaatattccggtaaatataatctgggaattgggaaacacggtgatatcggggttattcaaggcggaaacttcagttgtaacatgtaagggtaatggcaactctaagttggaataaagagggtggattaaagtcctgtcttgaagaaggtagagtaggggaataacggttaaagggaatggagcacagggtatggcagagaa

SEQ ID NO: 505812 - DNA, 627 bp, Homo sapiens
ccagacaaccttagtccaaagcacatttagccaaagtaaagtataggcgatagaaattgagaacctggtcgcaatatcatatagtaccgcaagggaaagatgagaaacttatagtccaacgcatacagtataggcaacggactaaccccgtatagccttctgcgagtaatgaacttaagcgtagtaaataatctttgcaaggagagcctaaacgctagagagcccccgaaaccagacgagctacctaagaacagctaccaagagcgcacccgtcttatgtatgcaacaatagtgggatagactccatagggctagaggcggagcgaaacctacccgaagcctggctgagtagctgggttgtccaaagactacgaaatccttagcttgcgaagctttaagggttgtggcccacacgtaatccccgtcttacaagtccccctttgggtagaaggtttaaaacatgggttcaggatccgagagagggaggggagaccaagtccgtcatttctgggatacacaacctaagggaaagatgacacacacccatttgattagccaagcaggcaggctacatataaaaacttgctacagcgaacccccaaacttaagattagcgggccataaaaa

SEQ ID NO: 505813 - DNA, 209 bp, Homo sapiens
ccgccagaaagggagtaggttggccacgctgtaacagtcttgagagttacatgttgcagtttttattcatcatagacttaaaaaaaatttcccacctctgtcttaacgtgtctgcctttgctcacgtatccgtgcttacctggtcaatctacttctctttatcctacatcgacgtttctgccctattctggttggggtggatccctcta

SEQ ID NO: 505814 - DNA, 380 bp, Homo sapiens
gtgcatagcctgtggaagccactcacggtactcagccagcaggtatataggggtaattcttccaagcagccagcaaggctacataggcagtcagcctatctctgcaacccagggctacgcagcaaggctctaccgtacaggggctagcagcctaggcccacgtacttcagcataggtgccggggctaggacagcaagacaggctccgcgtatgacggccagctatgcggaaagacctgccctatccagacaggaaaccggagcaaacgtgcttgtaagcgggtcaattcccctactggaaaaatccactctcgataggcgcgggagccggccaggcccacgacgatagaaccacgctgggccccggtgacccgggctacg

SEQ ID NO: 505815 - DNA, 455 bp, Homo sapiens
  misc_feature (58)..(59): n is a, c, g, or t
  misc_feature (92)..(92): n is a, c, g, or t
  misc_feature (109)..(109): n is a, c, g, or t
ccaaaccccacagcagtcaacaatttgtttatctgggtagatgtcctgcactacaccnncaggccatatcttattacaaagctgttaggaanccctctcaggaaccaanttatactgtcgattccttcctctctctgacttgtaatgttaacagccttatcaaagaggaactagctgggcgtggtggcccatgcctgtatctcagcactttgggaagccgagatgggcggattacctgaggtcaggagttcaagaccagcctggccaatgtggtgaaaccccttctctactaaaaatacaaaattagccaggcatggtgacttgtgcctgtagtcccagctactcgggaggctgaggcatgagaatcgcttgaacctgggaagtggaggttgtagagtgagctgagatcacgccattgtactccagcctgggcaacaagagtgaaactctgtccc

SEQ ID NO: 505816 - DNA, 185 bp, Homo sapiens
aattcaagcttctaacgatgtacggggacatgatttgaggttgaatagcttcgtgccgaaaccatccccccacccccatcccgctaccccgagtccgtgaaaaattgtcttccgtgaaaccggtccctggtaccagaaaggttggggaccactggcttaaaataccaataaatttttgaacctta

SEQ ID NO: 505817 - DNA, 278 bp, Homo sapiens
cggtgggtttcattgccagaaggtgagcaggatagagaaagagactggtgagtgcctggttggataagaggattgaggcagattacgatgcccgaccaggtgatcctgagtcagcactgattctgtctctgggttagtttaatacgggaaagggttccatccaagagcccaataggactcctctcgcaaagctgcataggatagtcaaacttataggggtggtggagggtcgtttagcaggctaggagtactgcctatgtatctgcaaggaacccacg

SEQ ID NO: 505818 - DNA, 972 bp, Homo sapiens
ggcgctatgacctggtgcggctgttgggagaagctggtcgagcctggaggtccggcatggacggagcatgcattggggatgatacctaggcgcttaatggaggtctgcctggtcgctggtgctgaagaagtggggcacgcccgaggaggcctccaggaggggccgggggactcaggacgtctcgggccaaggacgcctgtatcttgcgcttgtccacgccagtgacggggccgcctgtgaactaggacgataggacagttccaagttacatggacattcgtgcggatgtccaggatcagttggcccatgggactggtaccctgcagcatgcattggaacggcacgatggtgtcatgccagggcgcgagactgcgcctgtccaggaattgggatcccacggaggccctcaggggaagcgcgtttgatgggacccgtcgaaggaactcttggaaccgctcgatccatggttttgacgcaagggcacgggtgccccgcttcggcccattgtgacttacagaacattcccttgaagacccaaagaaaggggggccccgttccgcttcttgggcttgggccctgggccatagcaagcaggggggaacttggacaacgggggttagggcacggccgggaatgggggcaccttttggcttcggacgggagcttatgcgacataatgccgggcggtcaaacactcaatctccgccaattcaaatcgcggaccagacggacatacgaagcacacatactggacacaccgccgagagccataaaggaccgaatcagagacaactaggaccgcaatggcataacgtgacaaccaaaagacaacatgaacacaaataggtacaaccacacaacaatgcacacacacacacgaccccgaacatctactagacacccagacactctcaagcgcacacgggacacaactgtatacacagccgacagtagtgagcagcagcacccctc

SEQ ID NO: 505819 - DNA, 1256 bp, Homo sapiens
  misc_feature (770)..(770): n is a, c, g, or t
  misc_feature (776)..(776): n is a, c, g, or t
  misc_feature (866)..(866): n is a, c, g, or t
gcgaaatctgtcagagtaggagttgcagcagctgaatactctaagcaggctagtattgagctgggtgctcgtactgaggtcacatcacgtgctggaaagactgctaaacgtccgtgggagcatactagtgttgtgcgtgattgaactgaagcaggtaacgttcaggttgcggacgccgcctgagttgctctatcgtcagttgcaagatcagcgagcaacaaggcaagcttggacatgacacgcgatatgcccgttggagtggtctttaattatgggagcgatgcttgccactgcgattatagtacctcatccgttccgacaacaggacctgtctgactggcagagagcggtttggcatagaataacacaccacctagcgtctctgtgtctgcaacgagtgtctctgctcacgggtgcattgtgtggcgcctggcgccaatattctagccatgctgttgcaatatgccctaggtgagtgcgagcacttcctggactcgctacgcagataccacacaatcgatagatccttgtggagacacactacgcatgcgaacattcctctgtctcctatggcgcatttttccagcgaaatcacgcaatttccgagatgttcgaaggctatctccttaccggtcgttccttatccagtagcggtccactgcaattgcaacagtaaagcgtagggaagcccgcatcgttctacatgggcccacttgtatcaatgtaccattgggttacccccagcttgcgagttccctcttgtttgagcnactaanttcataggccgcaacattacaaatttaagcccaatacgacacacttaattctcttgatcatgcgatggacagatattacccagagttgtnaacctggttaagagccttgtggccgttacggacaccgccaagtctggggcggacgccttacatgtcccccgatttaccttaacagaatctcccgaaggaaaccgaacggcacccccccattagacgccgccctggctttgccaacacgttatcactttgactcgctttccggcagtgatatatcataggcacatctgctgcctgggagcggtaacagcgccccggaacacttggcaactcgtaggaaaccactctatcgccacacagcatgggtcgcgtcctccatcactatatccgacacacgactattccgccatttcacccctcgcgccataccgtccacaacctcacaaccatcatcgcgcgcgacagcaatgtgtgcttaggcac

SEQ ID NO: 505820 - DNA, 353 bp, Homo sapiens
gccatagcgacacgtacgggtagtggtgctggtggccagaggcttaagacagctagaaaaggagactttcaagtgcatcattccacaagtaatcattacctactatgtgaattattcagtgcagaaatttgaatggtgaatggagggacacattgttcctgaaggctgtcttgagcagcatctctttcaaaagctacaagagcttctctaaatatagttatgacacttttcaaagctgacaattctacaactctgttccttcaaactctgaggcttgtccttttataggtttcatttcttaaaaaaaaaaacctttgaagagcaaatgtactaacagtgtacggtgtcgctat

SEQ ID NO: 505821 - DNA, 186 bp, Homo sapiens
  misc_feature (52)..(52): n is a, c, g, or t
  misc_feature (145)..(145): n is a, c, g, or t
  misc_feature (155)..(155): n is a, c, g, or t
atgtagttttggtgttcacagactgcaaccctggacagagcgcagcagtggncacaagagcgaggagagcgagaaaagatgaacggcccttttaaaagattggaagccctttgagctacttcttacaaaattcttactcctgggngccaaacctncaaaaaaagaacagcaagtttcatcaagcct

SEQ ID NO: 505822 - DNA, 337 bp, Homo sapiens
  misc_feature (188)..(188): n is a, c, g, or t
  misc_feature (218)..(218): n is a, c, g, or t
  misc_feature (223)..(223): n is a, c, g, or t
  misc_feature (229)..(229): n is a, c, g, or t
cacagccagctggccctttcttcagtatcctgggactgaaagccttaggtaagttgccttgtaggtaagcggcctaaggggtgtctaagtacaaaagtgacccatttagagactgtccctgaaaccttgtacttccccccatgaggaaggaacagcaatggtgtcagtatccaggcttggtacagagngcttttctttttttttttactttttttgtnttgtnttttanaagatgaaataaagactcagggggagaatggtttttttatggggagtcaagtttggggggtccttctccacacccactttgtccatttgcaaatatattttggaaaac

SEQ ID NO: 505823 - DNA, 717 bp, Homo sapiens
  misc_feature (109)..(109): n is a, c, g, or t
  misc_feature (165)..(165): n is a, c, g, or t
  misc_feature (200)..(200): n is a, c, g, or t
  misc_feature (206)..(206): n is a, c, g, or t
  misc_feature (211)..(211): n is a, c, g, or t
  misc_feature (394)..(394): n is a, c, g, or t
  misc_feature (414)..(414): n is a, c, g, or t
  misc_feature (452)..(452): n is a, c, g, or t
  misc_feature (530)..(530): n is a, c, g, or t
  misc_feature (623)..(623): n is a, c, g, or t
caggaattcggcaccaggccggatgccccacacaccgacagtgtcataccaaagagctgagctgcttcggggccatgcagccctcctgccagccccctgcccttttctngccctgtctctgaaccttcagaacattgatccttgccgcagcccactagccagagnaacagagaagaccattcccctgcctgtcctgcggncctgtnttctnagggtctctgtctggggttggctctcttaaccctttctctgctcccagactgcctcaccagggaaggttggaggggcctccctctggcttctgcatctgcgccagcaaacatcactgtcgctggtctctcatgacttaactggcgttcctctgctgctggcttgggcttctcctaaagctcgngctctcctgtgcttctgagntgctccttgggcaaatcttcaagctccttcttggtttnctcaatcctctaccctgtactctccccaaaccatgggtccttaggcaccgctcttgtcttctcattggccaacaatanggaggggcaggggtaaggggaactgaggataagggtggggaaacaaggtgtccctgagggctctgggggcttcaggggaagaggaattacttntggctcttttaaaggcgctaattccaacccaggggctctttggtttcttgctggctacacgttggtagggtggtctttggcttggttttgtccg

SEQ ID NO: 505824 - DNA, 127 bp, Homo sapiens
gagcatccgattatggatctgggtacctgacaacctgaaataagcggaaggagcgccagcgctattacaacccaggcaatcctcacaacgtctacatgcccacgagccagccgccgcacctccctac

SEQ ID NO: 505825 - DNA, 371 bp, Homo sapiens
  misc_feature (1)..(1): n is a, c, g, or t
natcccgggtttatcgatgccacctaggattatgaaactgagctcaatctcaaaattaaagaactgtactataggcggggagcagtggctcacgcctataaccccagcacttggggaggccaaggcaggcaaatcacttgaggccaggagttcaagaccagccgggccaacatagtgaaaacccatctctgctaaaaatacaaagattagccaggtgtggtggctggggcctggaaccccacctacttaggaggctgaggcacaagaatggcttgaacctgggaggcgggccatgagcctagatcgcaccactgcactccagctgggatcacagagcgagagtgcagtggcatcgataaacaccgggtacc

SEQ ID NO: 505826 - DNA, 129 bp, Homo sapiens
acgtgttgggagagagtagagaattaagacacgcgcatagtgaggctaagagcagccaggcaattgaagaaagcgttcaagctcaacacccactacctaaaaaatcccaaacatatgactgaactcacg

SEQ ID NO: 505827 - DNA, 415 bp, Homo sapiens
cctttcccctgggggggggctttggggggtggccccttggggggggttttccctttggggggggggcccccctgtggggggttttttttttttggggcccccccgggggggggggttttttttttttttttgcctttccccctttggggccggtttgggggtcccctcctttccccggggggggggtttctttgggggctggggcccccccccccctttttttttttttggggcccctttttgggggccccccccccttgggggggggggggttgtttttttttttggcccccccccccgttttgggggtttttttttttggccccttgggggttgggggggaatttttgggtttttcttttttcttcggggggggtttttcccctttgggttttttaaattttttcccccggta

SEQ ID NO: 505828 - DNA, 126 bp, Homo sapiens
aaatgagaacacctaataatatttcatagatgagagcagcaccgttcccgctcacctacgggtgcacccacccctttgatacttgcagagaccctacgactcagtggaatcaaacgtggagaggta

SEQ ID NO: 505829 - DNA, 1546 bp, Homo sapiens
  misc_feature (961)..(961): n is a, c, g, or t
  misc_feature (1141)..(1141): n is a, c, g, or t
ggagagagacactgtcgcacacataacctaaaagttagacttgaaaagctccagcataggtgtgactataccagtgtcttgtgagaggggtgctctctgcgtgttctgcgcgaggacgtagcatgggcgagctaggagcagagtctccgtggtcacgtgcacagcttacgtggcgcatcccaggagtcccaggtgattgcgtccttgccttctgggcatctctcgagttgagctttcacatgtgaggaaggggactcctaggcatgaagttgtaattctatgtgtgtatcttctttgtatgcacatatgtaccataagagcacgatgtctgcccttgtgagacgcccacgaggggaggcgaaggagggtccgcctgagaagggtaccattgcctccagagtgtgcaagcggggggacacaagcccactctcgtcgtgcgccgagggtgtacccatacagtgtgggtgtgccctctctctacacgcgtgcctcgtgcgcacacacgcgcgatatgtacgagtgggcgcgccatagatacgcgccgttgcgttgcgctccgtgccgcctttacggtagagtacatacaccgtgtgtacctccacgcgggtatatggtagggatttgtatataaccaatggatcctacgagccgaggtgagcgctcctaaacccatgacagtccaattcgagacctaaggaggaccgaaggatgccttcggaattgtgccactttggaacggcttgcacgggtgccattgcgcgccggcgcggggtgggcgggggccctcccccacgaaaaaacgtttagtcggcgagggggagtataaccccgcgtggagtataagcacccctcaaggggcagagcgacacggggaaggccccttaataatggtttccgcagagactatggatggacacatgccagcaaaaagggcacgggggttcctcccttaactcgtttngcatggagcgcccacatgggggtatgtcacctgcactcacgccacgcaccgtggtaaacaacatgggggtggggcagaaaacaagggctctgtcgccccctagtgaggggggagtccacccgagaacatggggggtccatgggggaagacccctaaccagcggcgccccatgcgggaacngcaacactctgggatggacgctcgtgaattaggacagaccctgggggacagtcgcgtagcgacacagagtggcgacgcggaaggaaatgcgaaaccgcggagagagaacacaagagcgcccctccgtttggcaccacgcacggataaactaattttgaaaagccgtgcaacatttataccaaaaggcagtgaaatgtgtacacaagagacgataatgagaggagcacacatatatcgtgggccgagcagactagccgacgaagaaacaaccaccactatcccacccaccatacatactaggggccaacaccactcagaccacgggcggccactaatagtcatgtgacacctcgaccagctgcgaaccacaacacgccactctaaaatacgtggaccacccctggt

SEQ ID NO: 505830 - DNA, 655 bp, Homo sapiens
gctgcaggaattcggcacgagggcatttgcctgtagtcccagctacttgggaggctgaggtgaaggatcactttgagcccgggaggagtttcagtctgcagctgcactgagctatgaagctgccactacactccagcctgggcaacagaacaagaccctgtctcaagaaaataaacaaacaaaaaaacccgaaagaatagaaaaggcactttgggaggccaaggcgggtggatcacctgaggtcaggagttcgacaccagcctggccaacatggtgaaaccccatctctactaaaaatacaaaaaattagccgggcatggtggtgggcgcctgtaaccccagctactcaggaggctgaagcagaagaatcacttgaaccagggaggcagaggttgcagtgagccgagattgcactgctgcactccagcctggacaagaatgaaattccatcttaaaaaaacaaacacagagactatatctctgtaagaagacaggtgcaggggggtggaagtggacacctgattttctcctatttagatataatcccgggcttaatgcacgacctaatgaggtaagtgaggtcttgacccacagaatccctctcaggaattcgcagtttaggcaagccacctttggtgggcctttttttcttgcg

SEQ ID NO: 505831 - DNA, 180 bp, Homo sapiens
agtcaataatgtttgatgtattttacactaacctgtgtagccattggaaagcataatgaatcatacctgagtaaaagtgttccgtataactacgggggagttctaattgaccttttaatctatcattattacccttgatcggtcgtttttgtttagacatacgttttctcctatctaggg

SEQ ID NO: 505832 - DNA, 194 bp, Homo sapiens
gaaaacaccatagtatctaaagactcaggaggaagcagaactattataaaccatccagaaaggaaagacagatactatactttctcatatttaggatgctgaaagcacctggtatgccacataaatacttagctgtctgttgcccacttcttcgtcaacttggcaagattattttaaaggcttccacttgggtg

SEQ ID NO: 505833 - DNA, 449 bp, Homo sapiens
  misc_feature (3)..(3): n is a, c, g, or t
  misc_feature (33)..(33): n is a, c, g, or t
  misc_feature (38)..(38): n is a, c, g, or t
  misc_feature (420)..(420): n is a, c, g, or t
aancgaggctgctcagaacccgtgaaaataatntatcntttaccgattgattcatcccaaacaataattgggtacacacctacatccccaggtatcggggaataaagagcaatgaaaagcaagtccccttgtccctcaaggagccttagtttaacttaaaagtgttctccctatttaaggccagtgagtggctcacacccagtaatcccagcacgttaggaggctgaggcaggagaatcatttgaggcccaggaatttgagaccagcctgggcaacaaagtgagacattgtttctacaaaaaaaattttttttaaaacttagcctggcacagtggtgcgtgcctgtggtccagctacccagaagactgaggcaggaggatcacttgggcccgggagttcgaggctgcagtgagctatganctggctactgcactccagcccgagcgaca

SEQ ID NO: 505834 - DNA, 783 bp, Homo sapiens
atgcttgcatcgatgttattcgtagagaggagcatacttgtacaaatatttggcactgtcaaaccagatgtacagttgtacctactgtggaataaagctccagtcatatagatgtgtgtcgatcattaatagtgaggccctctgctcgtagtgtcgccccagtctgctctcttacgcagaacgaagtcgaagaacatattcaagaatcttttgaagataggaacgtagatgttgaattgaatcacgtgtgccggtgtcccatgcagtttgcatgatgagtgactctctgctcaacgatttgtccattgacgtttaagccaaagaaagttacacgtcctattgacgatcttaatcctgggaatagagtagctatgtagagtcgcctctgaacacgttccagtctgtgtaatgctcgatcccagtaaaatcgtcactggcacgtgtatcttagtgtaaatcagtcagaggcttgggtaaactagtttttgctcgtgcagtccctaatctgatttcaatgaagcaccagtggctctagtgtgactggactcggcatccggcaaaaccattggatccaccgtggggttaccttgtattttgatccgtactggtgctcagtgcacccaggaaaactttacacaactggcagcgcacgcagaaactatccaaaggtattcacgaaacgcgcacaccccagcaagtggtcccgccacccggcatttgagaaccacattgccgcgcacaattgaacccgccttgaaccggccacaccaacatccttgggcc

SEQ ID NO: 505835 - DNA, 93 bp, Homo sapiens
aaggaaagactcatatcacattgtcgtcattgacacgtagattcggcagtcacactactgcatctgatctataaatgcgtgcatcgacaaaga

SEQ ID NO: 505836 - DNA, 500 bp, Homo sapiens
  misc_feature (170)..(170): n is a, c, g, or t
tacctatgaacgggacatactctccccagttggagtggtcccgcttaaccagacagaagcaaggtatatcttatatatgtggatggatgtctcatgtataaaatgtataaaaccaagtggtgccccaaccagttgggtcttatgtggccaggacctcctgagggctgggntcacaggcacatgcccttagggtgggcaaaataaacttcctaaagtggacggagatctctctcagatatggggggtccacagcaacacagggagaccccatttctatccaaaaaaaatttatctataaaaaaaccaacaacagtacaaaaggacaaggaaggtactcacataatggatgaaggggttcaatgcaaggagaaagattaactatccaaaatatacacacacccaagatggaaccatccagtttcataaaacaagctctaagagatctatagagatagcaatagggtggggagaggtccaatcccatggacagcattagacag

SEQ ID NO: 505837 - DNA, 1023 bp, Homo sapiens
attagtgctccagtgaatgatgaggcgacacaaatacgacggctgccgaaggcgatatcgcacatggctgcatgttgatgaccggagcaaaattgcactgggcgagcatgcattccatgaatttgaattgtgagtattggttccatcgatggtgagcgatccggatcatcgcgtgaaattcccatccaccaattggaggcaaaagagagtggtgccgcatataggaagctcagagcttgaggtcggaggtgatcatcgtgagtgtcaaaccaggaagtcgaagtagtgtcttcactcatcatctaccaaattgaagggagctggctcatcatgtaaaagtcatggactattggccttctttggtaaagttttggcatctggtcgctctgtttagccagccagtacacctcttcgcgagatgggctatcatacttcagtctactctttcactatatcgctataagagatcccctgatggtatcgctctattcgagattagcgatctacgtaccgaaaggatgaacttgaatcacgtccgagtggcgtggatccgaggagcatgtcaaggaagattactagatagggtcatgatctccatgactcagtcaggtgggaacagctggttgaccgattggtgcctttattgggacgtttagccatttttggaagtcttcaaagtgaacagacgcgctgggtggtgaaaggagattagtaactgatttcccacttgaacttgtcatttggtaccccaatagatagtcaggttgcgacaggaaaggttgcgcagcgcagaaatgacgatgatagggcgaaacaattggtataggaccctactatcagacctaatgcaggccactgggtcttgtctatcacaaaaaaaagaggaaaattttggtgcgcccggaggatcataacgtggtggtggccatggtatgtcgtctcgacgcgcaaggagtgtacaacccgcgggggcaacgaatctgtacactcacagccctacgcatacaaatcactcatgcagtg

SEQ ID NO: 505838 - DNA, 826 bp, Homo sapiens
  misc_feature (544)..(544): n is a, c, g, or t
atgacccaccaatcacatgcctatcatatagttaaaacccaagcgcctatgagcctctaacagggtgccctcttctagcgccttccttagatgtacgcgtccgcggccatagaccatgtgatttcgacgttccgacgtccgataactgctccatcgatacgtaggccttacataaccaatcacactaaccatataccagtgatggcgcgatgtaacagcgacgaaatgcacatagcgcaaggccgaccacgacagccgactctgtccaagaaaggccttcgatgacggggataagtccgtatttattagcctcagaaattttccttcgttcgcaggattgtttctggagccttttaccactccagtctagccccttagcgcaccctaattagagatgggcacgtggtgccgcccaaataggctatctagacctcggctaaagtccgctcttagtaagtccacatctgcctataaacatcattccggatagttacgtcgtctattccggagttctcgaatcgaccatgagccgtcactcagtagntgctaatagaacagcagtgccgaaagccaacattcagttcaaggctgctgactgtattagacacttgttacctggcgtctctattttttaaccctcctactaggccctcgagagctacttcgagtcttcccttgcacccaatttcgccgaggagcattctacgtgcatcaagattttacttggtagccacaaggcttccaacgggacttcacgtcatgtattgggctcgacttttacctcgatatcaggtgcatgcggccactaatattgcactttacatca

SEQ ID NO: 505839 - DNA, 275 bp, Homo sapiens
gaaaggggcccccccgcccaaaaagccaaaaggccccaggagcccccagcaaaattttttaaaagggccccttaaggtgtggttcttcccaaaaatcagttttagggttggggctaaccttgggggacccttttggggattaagcccccaggagggccagaatttgaaaattccttggggttgttctttttccaaaaaaaacgggggccgaaaagttggaagggggggccaatccctccctcccctcccaagttttggggggtgcctccttccca

SEQ ID NO: 505840 - DNA, 492 bp, Homo sapiens
tgaggcagtccccgaaaaaagttcatgcatgctgctccatcagaatccactcttctatggatatgagatatctcttaacacccacccatacagtacacagcacacagcaacagcacaccgctcatggagcagagcaccctccccacacaccaagtccactggcaccttgatcttggacttccagcctcagaactgtgagcaaccaatttctgttgtttataaatgacccagtctaaggtattttgttatggcagccaaacagactaagacacatggtctcatggtccagcccttacttgagatatgagcttcttattcttgttaaatgagtcaatcaagatgggaatgataattcatttactcttagaagtgggagaaatgaccacacctcagatgggaggtacaggacctgccaatactcagggctagtatcaagtgtcgcatagtattcctgggctcctgcatgaaggagcatcttaagcagcggcaaat

SEQ ID NO: 505841 - DNA, 220 bp, Homo sapiens
caaatgtgcacggagtgtgacgtgaacggacggataaacagacattgtacctacatcccaactggtaccggcacacggataaacagacatgtgcacctacatccatgaatggatggataaaccagacgttgcaccttaccattccgtcggacggcatggactcacaccagacgttgcagctacatccacgaacggatgaataaacagacgtggcacctac

SEQ ID NO: 505842 - DNA, 472 bp, Homo sapiens
ccatattccatacccttcttgccaagccagggactaagcagcccagaagcccagtaactgccctttccctgcatatgcttctgatggtgtcatctgctccttcctgtggcctcatccaaactgtatcttccgttactgtttatatcagaaccaggtattggttgggtgcaggccaatcccttattgacttagtataatggttggaactaaacgtcaccaaggtggcttctccttgcatgagagatggaaggcgtggtgggatttgctcctgggttccctaggccctagtgagggcagaagagaaaccatcctctcccttggtacacctgaagaacaacatcccctctgaaggctggggtgagaccctctcccatggtgcccgtgcctctgtgctgtgtatgtgaaccacccatgtgagggactaaacctccgccttggccgtataataaagagcctacccccaaaaaaaaaa

SEQ ID NO: 505843 - DNA, 354 bp, Homo sapiens
tcttctccgaaaaggcacatgaggagagggctctgcagcgctgagaggggcctgtaggacgtgtgggaccgagtagctagcagacgcactttaggtgcttataactcttcctgctggaggaggaggtggtggtgtacttaatggtggaactgccgcctccagacagaggctgaggccacccccaatgggctctggccagctgctggaactgaagccaactccaacgccaagaccaccgccataggagtagctgcttcctccaccctggcctaagccactgccgacaccactggcaccgccatagccactggagacggtggactgcaccacagagatgttgcctttcggagaaga

SEQ ID NO: 505844 - DNA, 396 bp, Homo sapiens
cagatcttcaccaaggccttcttcagatccaaggccaaggtgatctacatcgggccgaacccccgggtacgatgtggtctccctctatcattactccaagatcgccgggcagttacaaagacccgggcacacccgaccagttcctgagggacttcctcaaaggcgaagtgcagttaggctcctgattcgaacacattaagggctggcttcggatgaaaggaaaagacaacttcctatatatcacctacgaggagctgcagcaggacttacagggctccgtggagcgcatctgtgggttcctgggccgtccgctgggcaaggaggcactgggctccgtcgtggcacactcaaccttcagcgccatgaaggccaacaccatgtccaactacacgctgc

SEQ ID NO: 505845 - DNA, 482 bp, Homo sapiens
gactgctggccagacctccaagctagcccgccaggcctccatagagctgcccagcatggctgcatccagttacaagagttggtggaagccgggtaggttataggctcagtctgcggccaagactccgtcctgcaagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccaggtggaggaaactcccattgacatgcatcacactccacatatgaaacccttctttttctgccctgtcactggggttagggattattactcactgcaacttagcctagcattaagttgcttgactaaaacaccttcccataaatgtcgcttcatttcc

SEQ ID NO: 505846 - DNA, 1174 bp, Homo sapiens
  misc_feature (380)..(380): n is a, c, g, or t
  misc_feature (800)..(800): n is a, c, g, or t
  misc_feature (1151)..(1151): n is a, c, g, or t
ttgattcggtgttgtgttttgtgggggttctgtccacgatcgccaggtggttcgggggttccatatcgcggcttgtgagcctggactcctgttgggggtccccccctctcggctgaaccgggtattgggcgcaatttgagggtagatgaagataccagcgtgcggccccatggcatcaggacaaatcagggtgtgcctcccagttactaccccaccactttggtgctccgggaccaccgccctctgccctgggccccacgctcccatattctggagaattcggagattcaacactgcccatgatgataacgttactcaggtcgggccattctatgtgaacgtgctgaatgaggaaccgaggaaacgtctgtgtgagaacnttgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgtcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaaatttgtttngacggatgattggattattcatttaaaatgattagaaggcaagtttctagctagaaatatgattttatttgacaaaatttgtcgaaacttatgtatgtttacatatcacctcatggcctattatattaaaatatggctataaattatataaacaagaccagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcacaggagttacattaatgttaattcagcactgatttcacancagatcaattttaattgcttaca

SEQ ID NO: 505847 - DNA, 247 bp, Homo sapiens
  misc_feature (5)..(5): n is a, c, g, or t
ggtanactggactcctctcaagacatctcacatacagtgcaagtgtgccccagctgattaaacattgcacctatgcaggtgcacttctttctgaagtaggtagagtagaggctcatgaacagtatctactataagatccctgcagaaaagccatcaagagacacacattctaatgccactgagagttggtctcttaaatctgaagattggaccacaaagctgtacagtcattctatttagacggtac

SEQ ID NO: 505848 - DNA, 199 bp, Homo sapiens
taagcagtgccccccaagtgactccagtgatatccttgacgtgtaccattcttcctgatccatggagggaaaaacccattgcagcaaagtatggaatttaactcaaggctcaacatccacgggtttaagttcctaacattcaccttagagatttgcacgtactgaccaactccaggatgctacggcatggacgggggac

SEQ ID NO: 505849 - DNA, 739 bp, Homo sapiens
  misc_feature (153)..(153): n is a, c, g, or t
  misc_feature (547)..(547): n is a, c, g, or t
aaaaaaaaaaaaaaaaaaaaatccaccattgaataaatattggcaggcctacatccaggggcacagatggatgtttctgtgggtctctgtgtgtgcaggatttcttccacactatgactgatcagggaaaggggtgggtttgggctaatttanagatcacaggcaggaccaacatgtcaaggcctttcacctgagacacaggacattatgaattctcctaagtgtcttggcagatggtgatagtggcaggaacaaaaccaaatgatctatagctatgtttacagtgagaattattcatatttcattcggtagctgggactatgatgggcaagcatgccactcaagcaagtgcatgccctcttaatacagccctcctcagtcttggattcacaatcttttacatggatttctaagttttcataaaggttcttttgtcagggcataactgctgtattttcataactagaagttgtgggtagagaacctcctattctgccatcttgctatgtcactccccttgtatgtttcactttctgatatgttctangccaaattatctgatttcaaattcaaaatttctgaaataaaatgcccaagtttacacattgtgtaataagtacatgtattgacatggctcattttcattagagcattttattaattattgagatgcattttcttttactgctttacatttcatgccaaagattcaaaatcctggctcttcaataagaacata

SEQ ID NO: 505850 - DNA, 1277 bp, Homo sapiens
  misc_feature (380)..(380): n is a, c, g, or t
  misc_feature (800)..(800): n is a, c, g, or t
  misc_feature (1158)..(1158): n is a, c, g, or t
ttgattcggtgttgtgttttgtgggggttctgtccacgatcgccaggtggttcgggggttccatatcgcggcttgtgagcctggactcctgttgggggtccccccctctcggctgaaccgggtattgggcgcaatttgagggtagatgaagataccagcgtgcggccccatggcatcaggacaaatcagggtgtgcctcccagttactaccccaccactttggtgctccgggaccaccgccctctgccctgggccccacgctcccatattctggagaattcggagattcaacactgcccatgatgataacgttactcaggtcgggccattctatgtgaacgtgctgaatgaggaaccgaggaaacgtctgtgtgagaacnttgccggccacctgaaggatgcacaaattttcatccagaagaaagcggtcaagaacttcactgaggtccaccctgactacgggagccacatccaggctcttctggacaagtacaatgctgagaagcctaagaatgcgattcacacctttgtgcagtccggatctcacttggcggcaagggagaaggcaaatctgtgaggccggggccctgcacctgtgcagcgaagcttagcgtcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaaatttgtttngacggatgattggattattcatttaaaatgattagaaggcaagtttctagctagaaatatgattttatttgacaaaatttgtcgaaacttatgtatgtttacatatcacctcatggcctattatattaaaatatggctataaattatataaacaagaccagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcacagtgggaggttacatttaagtgttcaaattccaggcactggttttnccacaacgaggatcaacttgggtaatgcttaacatttttaccaataaaattaattcgtggaggttaagaaaaacacaaaaaagaaaacagtaaaataactacaagaaaaagagaaggtg

SEQ ID NO: 505851 - DNA, 104 bp, Homo sapiens
atcagtgcacacatacgcgtgtgctgcgtccctccagcaacaggatcaagaactggctggcctgaagcagcaggccaaagagaatgcaggcccagctagtgggt

SEQ ID NO: 505852 - DNA, 646 bp, Homo sapiens
ggcaaaatttaccatcaacctctacatcatcgctacgagattagctctcaccatcgatctatctactatgaagctcataggcgatagaaatagaaacctggtgcaatatgatatatgatagccgtcaatggtgaaatgatgagaaaatttataagcaaagcatgatatatcaaggattaatgactcctaatatgcattctgcataattgaattaacgtagatagataagcgttgtgcaaggaagagcgcaaagctaaagaaactctgatatgaagatgagcttaactaagaatagttatatgagcacacccgtctatgtaggcaacaatagtgggcataagattccataagtgtacgaggcgagaaacactatcctgagtccatgtgctcgtagtacgacttggtttagtcctaaggatagacatcttgaattcatacttctaaattatgcaggagagaaaccgtataaatctctcgttgtaagttgaacgtggtgaagtccgaaagaggaacaggtcttatggatacgtaggaagaagaacgtgtgtagagagagtaataaatatttaagcacgacatagtaggcctaaatagctaggtcacccaattaagaaagctgttcaaggctcataagcacaatatttag

SEQ ID NO: 505853 - DNA, 109 bp, Homo sapiens
cggtaccttcttatgcaaggcaaggagttgtgttaaggcgagcggacgatagaaaaagctacctatggagctgcgcccctacgcaggtacttggccttgccatatgcaa

SEQ ID NO: 505854 - DNA, 508 bp, Homo sapiens
  misc_feature (102)..(102): n is a, c, g, or t
  misc_feature (108)..(108): n is a, c, g, or t
  misc_feature (129)..(129): n is a, c, g, or t
  misc_feature (153)..(153): n is a, c, g, or t
  misc_feature (156)..(156): n is a, c, g, or t
  misc_feature (221)..(221): n is a, c, g, or t
  misc_feature (231)..(231): n is a, c, g, or t
  misc_feature (246)..(246): n is a, c, g, or t
  misc_feature (254)..(254): n is a, c, g, or t
  misc_feature (328)..(328): n is a, c, g, or t
  misc_feature (357)..(357): n is a, c, g, or t
  misc_feature (405)..(405): n is a, c, g, or t
  misc_feature (464)..(464): n is a, c, g, or t
  misc_feature (467)..(467): n is a, c, g, or t
ggctccggctaactctgaggacacgcatttggtggacccaaagactgatccgtcggacagccagacggggttagcggagcaatgcgcaggaataaggaagcnacctgnaacccgacgattcttctactnaaaacaaaagagccaacagaacanaanaaaatgtttcagacggtccccaaatgcccggttctgtggagcagacgcccaagaagcctggcctnataagacgtnaaacgtaaacagctngaattaanaatatgtttccttggttatcagatcatcactgcttgatgaagcaaggaagatatacatgaaaattttaaaaatncatatcgctgacttcatggaatggacatnctgtataagcactgaaaacacaacacaatacccttaaatttaggcctnttaaatgattgcctttaaaacgttggatgtagcattatgcaaatagggttttcctatgnttnatggctacctgggatggtttacctttatgtgcacttttggg

SEQ ID NO: 505855 - DNA, 513 bp, Homo sapiens
actagcctttgatccttcctgtttaaggagctcagcatatagcttcacttccctgtcattcatcagaattcattctcagattggaattgtccagtcttagagtgatttttgtccccagtgacacttcccttatatccgtgctgacacaggttcaggagaacaggtcgagtcgaaatcctggctgttccgccttctaacaagctgcttcatctttctgtgcctcacacatctataaaatggagctgggcatctgtctccttcagttatggtgagaattaaaataaaaaacacaaagcacttctaagaaagtacaggagaggccgggcacgatggctggcgcctggagtcccagcactttgggaggcagagcctggcagatcacctgaggtcaggagttcaagaccagcctggccaacatggtggaaccatgtttctactaaaaatacaaaaattggcctgccgtggtggtgggcacctgtattcccagctactcgggatgctgaggtgcgagaa

SEQ ID NO: 505856 - DNA, 660 bp, Homo sapiens
  misc_feature (509)..(509): n is a, c, g, or t
  misc_feature (613)..(613): n is a, c, g, or t
  misc_feature (660)..(660): n is a, c, g, or t
gccacgtcagaaggcgattattctcggtagctttagcggcagcacgcccaatgattatgacgcaggttacaacctggagtcagtgtacgcgtttttgcgttcccgcctgtcgattccactcattaccggcctcgattttggtcatgaacaacgcacggttacgctgccgttgggcgcacatgccattctgaataacacccgggaaggcactcagttgacgattagcggtcactgagtcgttttaccagaacccgtttccccggcgacgatcaccacctggtgatcacgaatcgcttcgagaatgtcctgttttttctgactaaccggtaaattgtcaggataagtaatttccggtcgtgccgcttcacgcagcaggactttccctgccgcctggtcaatctctttcgccatctcctggaaaatggcctgttgtgcatcaggatttttaaccttcttcacgccgtgcagacggcgagaaaaggtcaatctttgttggtctgtcataacgntagtgggcagtagtcttgctgattaactttcttttaaatgatagatttagagtaccacatcgcgcctttctatgcgttgttaataaattcgaacataagcttcngattcattgcgctatctctttggcaggcatgtgaataaagtgccaan

SEQ ID NO: 505857 - DNA, 510 bp, Homo sapiens
accccgggctgtacgaatttggcacgagagcaatcaacacgtgattataacggtcactgtgaacctagcacagacgtgcgcataaggaaaggggaaaaaacgtgaaaggagcttgggaaatattaacccggctgtgcacagagtttgagaactatgtggccgatatcgaggtggatggaaagcgcgtagagagggctttgtgggacacaggttgtcaggaagagaatgaacgcctgagagccctcttctatccagataccggtaggatactgaggcgtgtttccatatacaggcctgagaggttagaaaacatatccaggtggagcccacaaggcaaggatttatgtgccaacgtgcccataaatctgtgtgggaataagaaggaacttcagaatgatgagcacacaaagcgggagctagcccagatgaagcacgagccggtggaacctgagaaaggcgcagatatggccaggtggcgctcttggggacatggagtggttaccacagccc

SEQ ID NO: 505858 - DNA, 99 bp, Homo sapiens
cttattctgacccatcatttgtcaacccggagcctctttttttttctttccaagaaaggctgagttctacattgatgtgattgaagtccctccgtcagg

SEQ ID NO: 505859 - DNA, 263 bp, Homo sapiens
  misc_feature (9)..(9): n is a, c, g, or t
  misc_feature (25)..(25): n is a, c, g, or t
  misc_feature (89)..(89): n is a, c, g, or t
  misc_feature (95)..(95): n is a, c, g, or t
  misc_feature (114)..(114): n is a, c, g, or t
  misc_feature (140)..(140): n is a, c, g, or t
  misc_feature (256)..(256): n is a, c, g, or t
ggaatagtnctttaatctcgcttgnttttcataaccttgatatttgtagttgaagccatgcattttgtggaatgtctctcaatttgggnctgttngatatattctcatgatganattcacctcatgcattgttgtgaggnatgccatagaaaagatgcttacggaggcacatgctgtcagttgctccgtttctggtgatgttaacattaatcacttggttaagttagtgtctataaggttactccactgtaaagtnatttttc

SEQ ID NO: 505860 - DNA, 725 bp, Homo sapiens
gggcagacccaagtgccggcggcggagactgcagtggagccagtaccggctgtagtggccgtgggccgtggcgggagagtcatgtcagagccgcagccgcggggcgcaaaagcgcgatctctaccgggacacgtgggtgcgatacctgggctatgccaatgaggtgggcgaggctttccgctctcttgtgccagcggacggtggctgtggctgagctatggcgtggccagctcctacgtgcttggcggatgccattgacaacaggccaagaaggctggagaggtgcccagcccttgaaagcaaggcccgcagccgcccggggttggactgtgcgctgtgcgtgcgacaccctttgtagtggcaggctctagcgtctgtggccatcccgggccttcaccatcaacccgcgtgtgtgctgcccttctctctatgtccgtgggcacgtgcccacccggtggcccctggcttgttccgcaagtggaccaccaccgcgcttgggcttgtagaccatcgcccatcattatccaggccccattggaacaggtcgggcggcattgccctccttggactcccagccctggcgcaagctcgtaaccccgaacagtggggggaaggcccaaggttcactcctgatcaatactcgtggtaaccttggcttggtgcaattcgggcctcctggtttcattgtcaacgcttcctaactcttgccgaggaatggtggcacc

SEQ ID NO: 505861 - DNA, 461 bp, Homo sapiens
acacttcaggagttcatccaagcagtcaatcggtcattttttataggatccaatgaaggctttcaaaagtgattcttgagtctgttataacaactggtagtgaatgaatgcatgaatgaatgaatgaatgaatggatttttcactgactgattgattgactgagaatctcactctgtcacccaggctggagtatgttggtgcaatcacagctcactgcagcctcaaactcccgggcccaagcaattctcctgcctcagcctgccaagtagctgggattgcaggcatgtgccaccatatcctggtaattttgtatttttagaggagatggggtttctccatgttggtcgggctggtctcgaactcccgacctcaggtgatctgcctgcctcagcctcccaaggtgctgggattacaggagtgagccaccaggcccgactggagatagctttttcaattttgt

SEQ ID NO: 505862 - DNA, 290 bp, Homo sapiens
  misc_feature (19)..(19): n is a, c, g, or t
  misc_feature (160)..(160): n is a, c, g, or t
  misc_feature (232)..(232): n is a, c, g, or t
  misc_feature (249)..(249): n is a, c, g, or t
aattcggcagaggtgcctncccccagaggtggagcctacagaggcaggcaggcctccttgagctgtggtgggctccacccagttcgagcttccttgctgctttgtttacctaagcaagcctgggcaatggcgggcgcccctcctccagcctcactgccgncttgcagtttgatcttagactgctgtgctagcaatcagccagactccgtgggcgtaggaccctccaagccanttgtgggatataatctnatgcccgtttttaagcccatcggaaaacacagtattcggtt

SEQ ID NO: 505863 - DNA, 128 bp, Homo sapiens
  misc_feature (111)..(111): n is a, c, g, or t
tttttcattttctatcattaactatgtgcctgatggcaactgtgacagcataggagagacgggcagctccaggcccactccttaacaggtacatcctaagcatccaccccntcatcctctgcccactg

SEQ ID NO: 505864 - DNA, 509 bp, Homo sapiens
gaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgtta

SEQ ID NO: 505865 - DNA, 1920 bp, Homo sapiens
gaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagctcttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagagagagagaaagaaagcatcacacaaagattttcttaaaagaaacaattttgcttgaaatctctttagatggggcttatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttcaaaaaaa

SEQ ID NO: 505866 - DNA, 529 bp, Homo sapiens
ggccagcgtaatcagagttagaggcaggaagaacactgagacttagaagaagagcaacttcactgtggcaccattgcatagtccattatcatagtgaagttctagtactgaaactcaagatgtataagcaatgaatgcagcttagtttaataaggaggagaaagatcatatggatattatcgtgcaatttttaagtagtctttcaaaggccattcatcccttagatggtgtattagtccgttctcacattgctataaagaaatacctgagactgggtaatttataagagaaaagtttaattggctcacagttccacaggctgtacgggaagcatggtggcatctgtttctggggaggcctcaggaaacttacaatcatggcagaaggcgaagtgggagccagcacatcacatggcaggagcaggaccaagagagagagtgggtagacgtcacacacttttttttttattttttttttttttttttaattttgtttatatgttcactacataacaaaagaaccacactct

SEQ ID NO: 505867 - DNA, 373 bp, Homo sapiens
aggctggtctgcaagcctaacctgcggtctatccgcctgcctcagtgctcccgtggcttctggtccttatcaggctcgggccagctgtgcgtcggtctctcagccccgtttctttcctttccttctcttttctttttatttttagaccggatcttgctgtgttgcccacgctggtctgcatcgttgccgtcgttgctttctgctgtataaaactcctgggctcaagcgatcccctttgtctcaaccttctgagtagctaggattctcaggtgcacaccaccatgcctggctaattttttttttcagagatggtgggggtcttgctatgttgcccaggctggtctcaaactcctgagcttaagcagtcctccca

SEQ ID NO: 505868 - DNA, 427 bp, Homo sapiens
agcagttctcagctgccgcgccgtctgtccgactcgcccgtgttcgacgcgcccttcagtcccccggactcactgtcggaccgcgacagctacctaagcggatccatgagctccagcagcctcagcggctctgagtctgccagcctagaccctggccgccgcctgccaatcgttagccgcctctccatcttcgacgactgaggcatgagggcgccagtgaggaggaagggaaggcggctcagagatgttggaggacacccctcgccatatcgcccttgctgggggcacggaagtgttgggggtgacatgggccctaagcagactgcaagcccgaccgctcacttgaactagaactctgtggctggaggaccgcacaccacagcacatgtacgcttcctgctgacactagatgacggctgaccccccc

SEQ ID NO: 505869 - DNA, 333 bp, Homo sapiens
aatgttgagattacagttgtgagccactaaacctggctagttttaaaagtttgctagctgatgccaaattggtttccatagaggttgtaccaatttacagtctcaccaacaatctgtgagcctgcttgtttccccacaccctcacgaacacaatatgctggtcttcgccaatctgataggtgcaatatagcatctcattttcttcatatgcatttctccagagccacggtgactcacacccgcaaccccagcacttggggagcccgacgccggagcatagcttgcgctccagccctgcctgggtgacacagcgacacccccccccattctcca

SEQ ID NO: 505870 - DNA, 350 bp, Homo sapiens
ttagaagtaggctgtgtttccaggtgttcacccgtggtgcccacagttgcgacccgtggctgggtcggagctccatgttcctaagctaggtctaggtctacacgcctagcaccaccgcatagaggcccgtgtaccctgtgacagtgactgtccccacctcctgtgtttagtggtgcccttactgccgtcgctcatcaactcgttgtgggacgtagatttcaccagcactgtccagtggcgtgtagggaacactgccctggctcagcgtgcgagctaaggtggcgatgtatgcgatgggactctgcatgggatagtacagttgtgtagacgtcttccaaataaattatgtg

SEQ ID NO: 505871 - DNA, 191 bp, Homo sapiens
attgaggaagtatacaagcgtttgaggacagtataagcgttgaggcagtataagcgttgcagaacagtatcacgcgttgaggcaagtatcaagcgttgagaaagtcataagcgttgaggaagtataaagcgttgagaagtatcaagcgtttgaggcaagtataaagcgttgaggaagtataaagcgttgag

SEQ ID NO: 505872 - DNA, 105 bp, Homo sapiens
atctgtgtacatgagctatgtaggaaggggatagtagcagcaagccaagcccccagcattgggagctgtcaggccacagctgctgctcccgtagtcctcaggctg

SEQ ID NO: 505873 - DNA, 442 bp, Homo sapiens
  misc_feature (38)..(38): n is a, c, g, or t
  misc_feature (134)..(134): n is a, c, g, or t
  misc_feature (167)..(167): n is a, c, g, or t
  misc_feature (173)..(173): n is a, c, g, or t
  misc_feature (176)..(176): n is a, c, g, or t
  misc_feature (197)..(197): n is a, c, g, or t
  misc_feature (230)..(230): n is a, c, g, or t
  misc_feature (276)..(277): n is a, c, g, or t
  misc_feature (305)..(305): n is a, c, g, or t
  misc_feature (339)..(339): n is a, c, g, or t
  misc_feature (375)..(375): n is a, c, g, or t
ctatgtcaagaaatggggagccataccagcattaagtnccactgaggtggcaatgcacacttcaacctcttccttcagtcacaaagagttacatctcatcacagacaaatggagaaacgggacaacttgtccancgtttcactgtacccagctcctgtagtgataanactcantantttgtgtgtgatggctggtantattggaacgatcctcttaaattcttacagtantcgccgactgataaaggcatgaggatgtggcctgcatgctgcctgnncttgcctagaaccggctgcacctgctgntctcttgtttatgcaaactggctgcacctgctantcctttgcttatgcccctacccctggctatcctaantccctgttctcctgcctcactattactgtattctctacttctaaataaaaataaaacaaaatacaaa

SEQ ID NO: 505874 - DNA, 100 bp, Homo sapiens
tctgcgcggctcgtgatgtgtctctgccgcggctgctgcctgctgtgctctttgcttccctggtcgtgtgaaggacttcccggcatgagctcatgaccag

SEQ ID NO: 505875 - DNA, 161 bp, Homo sapiens
ttacgagtcgaggtttaaccctccgactgagcaactggcatgatgatgcagctcatctccttcttagcaggtgtgttgtctttctctaggatcaggaacttgcagtccttgtgcaaaaggtcatcgctctgaacacttgttgttgcaggcggcggaggtgg

SEQ ID NO: 505876 - DNA, 970 bp, Homo sapiens
gaagatctcacgagagaggatcggcgccctcctctgtggatcctggccaggccgtgttcgacggttgctgtgagagcgtgcttcccataccatgctgtccgccttctctgtcagctctttcccgcgttggcttcccagccgtgctccgcgctctacggactgtactgcacgtcctggatcatggggctggccacctttctacgcgttctgtgtgctccatccatgcgtgcattgtcctcccgaaacatagagactacagatctggtgaactttgtggtgtcatagtctatcatggagttctacctgtggcttggattcccagtcatttggagagcgggctacgaataaggggtggaagataattctcgacaagtaccatgatattgtctgattccaggggggagctcgtcatttcatatagattatttgacagccccactagctggtggacatgccatgattccatgggtggtaactgtggggttgaatagacttgtgaactggtatgactgacctgaatgaggtgcctatgaggagtagcgtaactgggcctgaaataggctattggcaagactactggcgcgttcatgcagcgtgctcggagtggcgtcccttccgcgttcgacccctagtggcggctccccagtgctagcagttggtgcgtttggtggtggatccttaccagctgactcagtggtgttggaaaacccgtgtgtaatttgaactatacacaggggtatggacacactggaagtttgggtgtcaagcagccatgaatgggttcctccgggacatgcgtttcaggtggccggacattagaaccaagggtggggagacgactggaagaatccaaaacgcgaattgttgaaactctgctgtttgggagcactttattttggagctctaatttgtgcggagaaagcaaaaattgggtgcgcgccaaaaaatatttggttgcgcgaagaatgaa

SEQ ID NO: 505877 - DNA, 297 bp, Homo sapiens
cagtggttcgggggtggataatgaaatatattattgaatacttcggccgaatccagttttatttgcatgttatatgtattatatacagaagccttattaaacagttgattaacagattgtttgcatgctatatgtattatataccgtattcttacaataaagtaagccaaataaaagaaaatgttaagaaaaccataaggaagagaaaatacatttactattcattgaatggaagtgagtcatgataaaggccttcatccttgtcgtctggttggtgtgtagactgataaggaggaa

SEQ ID NO: 505878 - DNA, 110 bp, Homo sapiens
cactggcgaaacttaggataatagtgagctgatccttaaaggcatgcggctcctcacttagtgcaggtccatcgaccaaagccctgtctgactcatactcatgtacgcca

SEQ ID NO: 505879 - DNA, 470 bp, Homo sapiens
  misc_feature (73)..(73): n is a, c, g, or t
cgcctggcctaccaagggcagcagcggctgctcggcggccatctggcctcggccagcgaggccgagagccatncatgctgatcgcagccgccagtcgcgcatctacttcggtggcaactcttcgactacccgctcaagcccggcatggacctggtccagaagatggggccgctgcgctgcctgcagttcgccggcagctacatggcatccgctgcgcggcccatccagcccgagcagacgctggaagactttttcatcaaccgcttcggccgccagctctacctgcagttcttcaaggactacaccgagaaggtctggggggtaccctgccgcgacatcaacgccgactggggtgcgcagcgcatcaaaagcctatccatcggcagcgccgccaagcaggcactgaagaagatcgtcaccggcaagaccgacacccagcacacctcgctgatcgagagctttctttatcc

SEQ ID NO: 505880 - DNA, 419 bp, Homo sapiens
gttccttgtcctcttggtggctaacgttgtgtggtgtgttttgcactcctactgttgtctttcagtcagtcttctacatgttacctcattcacgatagtcaacgtattgtgtattcttggcctcatatgaagtccttacggacaaatcatttgttccagcagtgatgatacttctgtcttggttgtctttacgccccacaaattattcaagtttctagtttaactcgagtgcaaatggtgaggaagcattgtattgatatgtgcattatcagtttttctcctgatggtaagcactttacggcaagttttgtttaacttcctatgtttgcatgttcctactgttttcacacccccgcatgagattatatcattgtagtcgcagaatgttttcatttggcttggaaacggccaagggcata

SEQ ID NO: 505881 - DNA, 152 bp, Homo sapiens
gagacttttctgcagggtttaaaaactaacatcttgtcttacacctcttttacgatttgtctcttagaatctccagtcctcacaggaaaacccacccaattaaacaaaataaaagaataaagaataaaaagaataccactactactataaca

SEQ ID NO: 505882 - DNA, 291 bp, Homo sapiens
gctctgtggatcccggccgctcgtgactgcgccgcgacgggtgggcgggcgctgcggtgtgccttgtagccgtagcggcgcggtgctggggtggcgccgctgcgtgttcttatctgtgtgggtcgtatctactattcagacgtgtactttgcgatgctgaaggtggggaactggttccatgtgaacagcaagataacttgggtcagccggacctgatgagataggcgagcgccgatccgaagggccgggcgatgggctccgttgccctcgtcggatcgaaaatggaagtcg

SEQ ID NO: 505883 - DNA, 129 bp, Homo sapiens
tgacctgatttacatagccactattaagctgctaatagtacctatagggcgtgacagatactagaatgtatacgtatagtggcctgagcgtcaccagcaaacagaaagcatacaagcccacgaggtaca

SEQ ID NO: 505884 - DNA, 706 bp, Homo sapiens
  misc_feature (149)..(149): n is a, c, g, or t
atctccatatatgttaaaaatactaaatatataacttctggtgatcggtgtgtctgcctctgacctagttcatcacacgatgctcacatcatgtacacctgatggtaaatgtgagatactgatatagagatcctacaaatactagaggnttgtcacgctattgtacttatggacactagttgtcagctgccacgtgcctggcgtttgccacagtggaagcaactctagttacgacttcagactttacagataaattgttaatcattagagaattaatgccacgctgcacatgtattcttattagtacatactgggttcaagtctggagtaatatcactgattctgctatcgtgcatattactcaaagtataggacattgtttcagcggaaatatattaatacattatttaaagcttgcgagttgcgggctcgcgtcaataaaacacttaattttgtccatgtgttaataaagagtaggttttgacaggttgattttctagatagctatagtcattgtaggagtattattctgtaactggagagatcatattgtgagaatatcttacgtgtttgtaagaaagatagacgttcgtgtaataatttgggcctgaagattaacttagatatcaacacatccaagatgtgtgtgcgcagattagagtgcgaaagagtagaatggataactttctcacgatagttgaactac

SEQ ID NO: 505885 - DNA, 117 bp, Homo sapiens
agacctgcttgaaaactgaaacaaaacagcagcaataataaaagaataagcccctactttgaggcccttccaaaataaagcccaaatagcctccccagactccatttggcaatctga

SEQ ID NO: 505886 - DNA, 146 bp, Homo sapiens
tgagtgaagcagatgaaaggtgaagcttggatagaaagagtgattgaggagaagaggaaaattgaagaaaagtattaaaattgcatggactaaaagaaaaaaataacaacccactgcgtcaaataataaggcatgttgcatccagg

SEQ ID NO: 505887 - DNA, 430 bp, Homo sapiens
  misc_feature (97)..(97): n is a, c, g, or t
  misc_feature (115)..(115): n is a, c, g, or t
  misc_feature (132)..(132): n is a, c, g, or t
  misc_feature (140)..(140): n is a, c, g, or t
  misc_feature (194)..(194): n is a, c, g, or t
  misc_feature (237)..(237): n is a, c, g, or t
  misc_feature (288)..(288): n is a, c, g, or t
  misc_feature (311)..(311): n is a, c, g, or t
  misc_feature (348)..(348): n is a, c, g, or t
  misc_feature (379)..(379): n is a, c, g, or t
  misc_feature (412)..(412): n is a, c, g, or t
gcctcatgcttatacttcctcaacgcttatacttctcaacgtttatacttcctcaacgcttatacttctcaacgctttatacttctcaacgctcaangctttatacttcctcaangctttatacttctcaangttttatncttcctcaacgctttatacttctcaacgctttatacttctcaacgctttatacntcctcaacgctttatacttcctcaacgctttatacttctcaangttttatacttcctcaacgctttatacttctcaacgctttatacttctcancgctttatacttcctcaacgctntatacttcctcaacgctttatacttcctcaacgcgtnatacttcctcaacgcttcatacttcctcgangtataaagcgttaaggaagtataaagcattgangaagtggggatcctctag

SEQ ID NO: 505888 - DNA, 1425 bp, Homo sapiens
  misc_feature (1352)..(1352): n is a, c, g, or t
tttggagacagagttatcactctagggtaggcccaggcgggaattcaggggctcgatctgggctcaccacaacctcgggattctccggccttcagccttcccgagttagcttaggatgtgtaggcaccgtgccaccagtgcccggcttaatttggttgggtaatttaagatagagagtggggtttctccagtgttgggccaggcgtggtttcgaactccgtgacctcgagggtgatctacccgcctcagcctcccaaaggtgcgtgaaattacggggcggtgagccacctcaccgtggccagtgtcctttagtggaatactacaagtggtggtggctcaacgaggacttgggtatatccagaagtgctcaactcatctttcaatttctactattatttccgtgggcctaacaacttatatccagagtgggtggtgcagggaggtgccaaaaactagtggaaagccttcacccttaacaatccttctttctcgtggccagcccacacacaatttcaacaccgaaccaaacgggagtcgcactcccgtgttcgctcacagtgccgctgctcatacactcccttctacaacagtgttcaaccgtgtggtcccacgaaacatagaatcttcacaagtctgcgaagaactttcaactcgtcacacgtgcttctcccaaaaccccccgggcgcgtacaccatctggtattacacgtgacgcgaagacacagccacccaaatacctggcgctcccctccacctaactcgggactaccacagacgacctccgcgacctcatcgcaccaccggggccacgccactggcgctccgccagccccggcaccccaccccccctcgcggcacatcccgcgggcaccccccggggccacacgccactccccccccccacccccaccccccaccccaatagaagcccccggaagcaacccccacacgcgcacacggcggcctcaacttccaaccaccccaccgcgccgcccccccccgcccgaccctcccgcacgacccacccgccgaggcgccaaccacaccacccccgcccccccaaccgcgcaccagcggcaaacagcgcacccgcccccgccccgggccacaccacgcaaccccacccgggaccaccgcaacgaacccccccgcctacctacccgccgcactccccgctcagacccctcgtccgcccgccgcgcacacccaccccacaacggccggatacccgcgcacgccgacgccccctaacagacaaacgggcggccaccaaactcccgccgcgcgtacgaccacaccacgatacgcgggcgcatcacggaaccgcccgcagacccacacggcgcgcacgncccttataaaatgttgccacagccccgccacccgccctcacgtcccgcccgccccccccgcgcccctgccacg

SEQ ID NO: 505889 - DNA, 170 bp, Homo sapiens
  misc_feature (8)..(8): n is a, c, g, or t
  misc_feature (110)..(110): n is a, c, g, or t
taggtaanaagatcagagagacaagagcttgaggagtcaaggtaactaattgactgtatgtaatagcttcctctaccccgcgcgtccgcacccccacaagcccgcccgcntccatcgcgcggtgctaatctagcctcccggagagcgggccccggcaggtgtaccagagc

SEQ ID NO: 505890 - DNA, 126 bp, Homo sapiens
ctgacgggcgactctagccggatctctctctaagtgacgatccataaaacaaggaggcacggtgaggtgggacccgcacatattgaaggccttccttacttcctgcggctgacttgattctcagca

SEQ ID NO: 505891 - DNA, 608 bp, Homo sapiens
ggctaaggtacctccggctcctgtatatcctgtaacctggcaatgaggtccacgaagcttgatgaaattcaagtcgaacattaatcagctaattacatcgcagaaggtggcacataaatgtgggctgtctacaatctaagcaatgtagacatattgttactcggtgaagaggtaaatcaacagatattctccattgtgaaagtacatatgtcctttgtaattattatataagctgagatgatcacacaaaaactgagaatgaaacataattatattcattatctcaataaaggaacttggtgaggtaagaattatacttcctcctggttaaaccagatgaggaattcaaggctccaagaactgaagagatatttctgagggcagatggcaaaaacctgaaccacatccaggtcttaaagactttaaagccttaggccccttccagttttcactcttggctacctttcactctaatgaggaaccagcccccaagaaactgtggggttgaattaataacatttatgaataatcacaaaacactttgacattattacaaaacacaatcttcataattcaggtataatacatagtcaagctacagaaacaga

SEQ ID NO: 505892 - DNA, 272 bp, Homo sapiens
tgtggtgttaccgtccctccgtgtttttgtgtccttgggggcatgttgcttcgtggtcgcagtattactgttgtcactagcatcacagcttggtgctctgggaaggtgggcacctccactgcttccaggttgcctgagtcatgagctctaagccgcaagagagcatagaaggtggcaagggagttgacgctctgggtgcctcttccacataagggttttaagcaggggaaaaacacaattatatgtatacagattacgctctttttctcttt

SEQ ID NO: 505893 - DNA, 910 bp, Homo sapiens
  misc_feature (910)..(910): n is a, c, g, or t
gtttgagacagcctgggcaacatgatgacatcccgtctctacaaaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaaaaaaaaaaaaaaaaaaaagcgccaaattttttttgggggggcccccaaaatttttttattccaccccagggattgtcccaattgtcccaaagggcggggcaaattttttaaccgtgtgtgggacaaactaaatattactcctttaaattttctcttttttttttctaagttggagaaatctcagggtaagagaaattttatatttaaacttcttggggactatgggaaaacactcttccttgtggggggtttcaccagagaatattactattaaaaataggagaggagcattgggcgaggggactttagtggggggtaaactactattaattcttcaacgaggacgggagattggtttattaccaaaacaggggtaattgggacttctttaaaaattcctctctcccagtgtcccaaagtgtgttttatttttccaagaatggccaccatttgctcgggaaaaaaatccgcgggaaaaatttttcaacacacgcgttgaactgaggccaaatgtttaggaaggaaacggcgggccctacaagggagagtggagcccaaatgcgccaccctttttctttgaaacacttcccatcttacccccacctgtgtggctctggcgcagggaaaccacttttgtggtgccggaaactggggagatgacaagcccggggttaggtcctgttccgccacgaagtgcgtgaagtn

SEQ ID NO: 505894 - DNA, 173 bp, Homo sapiens
tgctatccgggacgtgaggaggtatggccaggtacaggagcatttcacatcactaacctatcttgggaagctggtagggaccatcttcaactggccttaagaggatgaaccatgacggctgtatgggagaatccacagcgagggagaggacggaaagggaacgtaggctggga

SEQ ID NO: 505895 - DNA, 111 bp, Homo sapiens
gcgacactcttggtttgaggcccccgcccaacttaatcaggcgagcgctgagcgctgcagaggtggcaccggccaatcaccccaggcaagggctctgcgatccttcattaa

SEQ ID NO: 505896 - DNA, 191 bp, Homo sapiens
aagatccgagtgtcttcagacgctgtaaaaccatatcctgccctcttgtgagacctgttcatagatggatgggctgggtctgtataactgtgcccagagatctgtgacagcttggaagctctgcagtgaggaaggaatgatcacaagtcccaagccttcatgctgaggcatctgtctgcgtgagaaacact

SEQ ID NO: 505897 - DNA, 152 bp, Homo sapiens
tctcccgggagctgcagcagcgcctcggcgacctgggcgagctggtggtcctgggtcgtgagcaactggacctgagccacccggaacagatccgccagcaggtgcgcgccattcgcccggacctgatcatcaatgccgccgcccacaccgcc

SEQ ID NO: 505898 - DNA, 412 bp, Homo sapiens
atgtgtcccgcagtaacatggttaataagaaagccttgtagactgcatttaacaagcaatagctcccacgcaatcaacgtaactcatgagtattaaatcttgctgcacacaagactgccctcgggatacagttgcatgcagaagcactgctgttcgtatcatgatcacgacagccaagtgtgatagtgctgaagctagagagcggatagtcaggacgtagttggggatatgaagttgaaggcatggacagttgaaggcgtctagagctcctctatgggggtcggcagctcatgatcacgagacccggactcaagcgccaccgtaggtgcaaatgcaacttccacatgtcactcctcggcgtgcaaagcccggagtgccaacagcgcaatgaccgacacagtcacaatatatt

SEQ ID NO: 505899 - DNA, 380 bp, Homo sapiens
ctgctggctcaggtagggaccatgctagagaccaagagaaagaagacgacgagacgacgaagagacagagaagaggagagacacgaggagacggagaaaagggagactgtgggttgggagtcaacttccaacctcattctccagactactctcttaagatctagcctctatgctcagccacgctcactcttatcctctgattttccactttcctatgatgcttctccttggcccattttattcttccccgggcctgcctcttctcctttctacccctcagtcttggtccgctccctaagcccctttacctcttctgcttttgtcgatcacgttctttgcgtgaagaggaacccaggtgctgacccttctccaattcttcc

SEQ ID NO: 505900 - DNA, 153 bp, Homo sapiens
ctcttctcttttagctgttactcatttcaaaacaccatttcacttgtaagctacttacttgggccttggttttcccttttcctctttattgttgaactgtttctatctagctcctgttgtaatttataatacaaagttagtagaatatagtat

SEQ ID NO: 505901 - DNA, 1381 bp, Homo sapiens
  misc_feature (741)..(741): n is a, c, g, or t
  misc_feature (992)..(992): n is a, c, g, or t
  misc_feature (1069)..(1069): n is a, c, g, or t
gacaacaccagaaagttgacatataagagaagccttagaaaaagctgattgacgattgccacacaggacttaaactgttagaaagtatctgatcccctgatgactggaatctctagcctctactattacttgcctattgggacatgtcctaacttaactgtgcaagggcgtgatgcgacggctggttctctgccacgttcttcagaagatatgatgatatctggcatacttattctagtctgtgaacttatgttacatactcctatcttccttgagaggctggccaagtatgcataaagtgctcagaactatgagatgagttttcaacaatgttcgataattacgagttatggatttaattgcccctttcaatactggctttcatatgtagcgctctgtagtaccatggtgttagtatcgagaaccttgagcccaccacctcaacatgtgtaactcatatgggtgtgccaacttcaggagattctggaggggcttgcagactgtgattcgcagaactcaccagagtgtttcccagacgcaggagtacgaatgtcaattttaccaagaaaagtaccccaccttctattatgagaaagtaagttgctgagcactattttccattggatatatttgtatccagaatttgcggctctctcacttggtttgaactatacattgcacaccattccatttggacaagtagacccctaatggggaatagcgcatgtgggtgactaccgngggccatctgttgagaatttttccgacatttcgccacaacaaaagagttcttctgccgacacctctgtgggcgacacgatggttaattttacgagcaatggaggtccaattttttcaaaacaccgtagtcgtgttagactaaatcgcaaacacgtcgggcgcataaccggtggccagtcgccttagtatagataaggtggacggccaccgccattaatcctttgtgttggcggccatttatatctgagganaagagttgttgtcttaccctcgacacgatagtgtgtggtccacccaaattggctccctgagggaggcattaacaganatcgtgaaacgtctgaaaccttttgggtagacctgtcgttgatacgtgtcttttgatccaaacatcttagttcaaaagatgctgagtggctaaagggccacagagagggggcagagaaagtgagcaataggattcgggtacccattgacgctatgtatgaggtcacatgtttttagccgccacacaaccccagttgtttcacatcagcacatgagaaacgggtcccaccctgtctcattagcgtactcaggacgcggatcgaaacatacctactgggtaatcggccgtactatggggtaggcaggggaaccg

SEQ ID NO: 505902 - DNA, 130 bp, Homo sapiens
  misc_feature (48)..(48): n is a, c, g, or t
accgtaaacttttcaatctctctaaagaagatgatgtcgcagtatgtngtaagaaagcccttctttattgaagggctttcttacaacatactggcggacatcatcttctttgcggggcactcctctagag

SEQ ID NO: 505903 - DNA, 166 bp, Homo sapiens
  misc_feature (158)..(158): n is a, c, g, or t
atagctggcccagagagactctcacgtacagtaacaggccagctctggcccaatcgccagctctcccgctctgatctgcactcttcactcgactctctgctcatgggaagacagaattgctcctgatgcactaaattcaataaaacttgtcttgttgngagcttgc

SEQ ID NO: 505904 - DNA, 122 bp, Homo sapiens
ctcggtggatgtgtgtcttgccttcccaggccaggtcgtcggcggcagttcatccaggaaccggctgggggcacaatcgatgacttcaccgtattgcttgcgcttggcggcaaaggtgaagg

SEQ ID NO: 505905 - DNA, 422 bp, Homo sapiens
cttcggtcagatagagaactcgatggtggcgatatagctgatgggcttaggcgggttaggtacaccctttacatttcgcctgtagtgaacctgcgctgcaccgcgccccatacgcaccacgcctgtaatctcgatatccacaatacccctgggatagagcgccatcgggcccagcttgtttgactccgggtcaatccattgacggtactcggccattaccggcccgctagacatgagctccacttgctcgtagttaaagagagcctgggcatcgctgtattcttcgcgtgcccggacatactggccgaggtagctggcgtccatcgcctgaccgtgcgaccactcttcggattcaaccttgacgagctccttcgctgtaccggtagactcgtcaatcatcatcacatacggctgcacctcgc

SEQ ID NO: 505906 - DNA, 1802 bp, Homo sapiens
cgagttttttttgtattttttttcttggtacaaaattttataaaagggtctttagaagagcaacgatccaaactccaaaatacagtctgccagggaaacccggtttagtgcgtggggggactgtggcgtggggcatgtggcagggggctctcgtggctttcccaccctttcgtgagtccgtgaaagtgggggtgtgggtggcgcagtatattcttcattcttgtgggagtttccaacacatgtgctctccacgtgtggtctcagaggcagagggtgcttctcttatagagggcgcaaatcttttcacgcgagtgtggtggctcccagaggggcgagcatagtgagactctattcacacctgtgtgagagttgccccagagcaacacacacctctgtgtgtctgtgagagccaaacacagtgtgtggcgccgccacacgagagccagtgtgtctccacagcgttgtaagatgatagtatataaagcggagggggtgctcactcgcgcgcgtgtgtggggaatctctaactccgaaggggcctatctcccagacaaagacgcttctacgagtgggagatcttatacgccctctctctgtgtggctccactgcgagagagattttttcccccaaatagaacacacctcaaaacaaaactctcctcgtgcctagcgaccctttttggtgtggcccccccacgtctctcctcacaatagtagatctagaacactgcggggactagtagaccatactaccacaatataaccgtcgagggggcgcctcgtcgcgtgcagaacatagcgtggaaaggggcgcccctatctctataggggagagtcgtttggtgtgatacacgcggcgccaagagaagaaacactccgatgggcaccgtgtggggcccaagaaggtgggggccaccccagacgaggacaacccactccataagaggtggggcgccccaaccctattattccaccacgggcgccaccattaaaagagggcccctccataaaccagggggggcctccccccttcgtgtggtacaaaaagaggccccaacaaagacacagtagcgttatccggtggcaaacccctacaagccaggccacaagaatcaacgagatgatcaccccccgagaaacaaatcaccgcggccgcaggggcccccgcttactttcataccaccgccaagaaggaaaaaccccacttccgcggcgggggaccatcaccggcgagagggggggcaccaaaaacagacaactcaaacgtggaacactgatccccggagggtccccccgagggagctcacatgagcgatggcaaaacaccaccatgctgacgcaactcacgcttacaagaattgtcccaccaagaagaatgtaatgtaagcgccccaactatgttataccaaggagcccacatgggtgtctgcccgggaggagggtagtataagagaaacaatactctcacactatttactgaggagctaccagagcatatatttaggacagtcaatgacccaccattaaaggcggggcaggacagacaacgttcagcccctacttcttcgtgggagggcaaattatatatgggcccgcggaggccatctttttccaacgagtaatactattcgtgcgccgaacagttttggcgcatcatcccctagtgcgtgataaacttgcatcggtcaaacagccgccccggagaataataattggtgtatccctaaggcccgttttgtacagaaacacctcgtggacgtcaggtgtccccaatggtaggacccgatatatagtgtcgaaca

SEQ ID NO: 505907 - DNA, 164 bp, Homo sapiens
  misc_feature (110)..(110): n is a, c, g, or t
tgagcctttccagggtgacatgaaccgtggcactttcttagcgatccagaataaatttctagctcgaaggtttaagctcttagaacaagctctggtgattgaggaacagntgcgccgggctgcttacttgaacatgtcagaagacccttctctctcacactccc

SEQ ID NO: 505908 - DNA, 882 bp, Homo sapiens
gggtgaaagagcaagacacagagaggagagagagagagagagagagagagagagagagagagagagagagacatcaacagccctcaggaactctagccccctcacctacctaagtgtgagtgcagattctttcgtggcgttctgctatcgagttatcagggcaccgcgtcagatgtgatctaagcggtgcgtgctcacgtgctcgtgtggggagtgtatcatccagatgtcttccctggtgacatacacgagaattcagcgctagagtatcgtggtcaccattacaagtgtgcaaacgccaatgtagcatatgaatatagtacagggctctggtttttaccctatgtgtgcctatcttatcaggcgtagggagaggatggtcaaagcaccccgaggagaagctatatatatatttcgtgtttcgtcgttgtggtgatttattatatactagtgctctttttgtgcgtagttgtcgtctccacgaagagggctctcctcttggaaaaaaagaatgaattgataccacattctcctccgtttgttgagtgcacttgttgtgatcatcgttttgttcatttatcatatattaacgctgtaaaccacatttgggggtcatcttttgtggaagggggttttgtttacaagagccatacggttaagaaagggtaaggatatctttacgcattcagtggtgttccacaactctcttattttaacattatgcgtggtcaaacggtgttgtgtgatactggttcatggtgaaggggtcaaggggtgttaacatcctaaataggggtcaatcaggtgggtgggcggggccattggtaagaaatccggacaggatggggcacccggagaacccaaaggccttttcattgaacg

SEQ ID NO: 505909 - DNA, 161 bp, Homo sapiens
ggccggtaccggtcgtatgagatggttaaaaggcaagataaaaggttctttttttttcctttttggtctatgaagtggcgtttatttttttgggccggttcgatgtatgtgtgaaacaatgtggtccaacaataaacaggaattttatttggcgagcgata

SEQ ID NO: 505910 - DNA, 161 bp, Homo sapiens
gatggacaatagcaggcgaggtgtaatcagggctcttgcatattttcaactctaaatattacgtactcagtagtgccctgcttctagggctctgaatacgggcttaaagtcatactagtgctgctggaattaagctgtgcagaagccataacgcctcccat

SEQ ID NO: 505911 - DNA, 475 bp, Homo sapiens
  misc_feature (41)..(41): n is a, c, g, or t
  misc_feature (209)..(209): n is a, c, g, or t
  misc_feature (219)..(219): n is a, c, g, or t
tcatggctaggcggagtgagtggtgtgatctgggctcactngaaacttggcctcccaggttcacgccattctccggcctcagcctcctgagtagctaggactacaggtgccgccaccacgcccagctaatttttggtatttggtttagtagagacggggtttcactgtgttagccaggatggtctcgatctcctgacctcgtgatctgnccacctcggnctcccaaagtgcgggaattacaggcgtgagccaccgcacctggcctggaacccctacattcttatcttttcaggccttaagtgatttgtcattctccctcactacatcgtggactggcagctccattcattctaccatcacctcaatttaaaagcctagtgggggcaggcatggtctgagctccccattgctgtacttccacttgcaggtaaaacacccttctgtcctactcaatagccctcttcctctcccaaga

SEQ ID NO: 505912 - DNA, 950 bp, Homo sapiens
  misc_feature (83)..(83): n is a, c, g, or t
  misc_feature (87)..(87): n is a, c, g, or t
  misc_feature (199)..(199): n is a, c, g, or t
  misc_feature (206)..(206): n is a, c, g, or t
  misc_feature (219)..(219): n is a, c, g, or t
  misc_feature (227)..(227): n is a, c, g, or t
  misc_feature (246)..(246): n is a, c, g, or t
  misc_feature (265)..(265): n is a, c, g, or t
  misc_feature (282)..(283): n is a, c, g, or t
  misc_feature (285)..(285): n is a, c, g, or t
  misc_feature (301)..(302): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (314)..(315): n is a, c, g, or t
  misc_feature (319)..(319): n is a, c, g, or t
  misc_feature (327)..(327): n is a, c, g, or t
  misc_feature (331)..(331): n is a, c, g, or t
  misc_feature (338)..(338): n is a, c, g, or t
  misc_feature (342)..(342): n is a, c, g, or t
  misc_feature (346)..(346): n is a, c, g, or t
  misc_feature (351)..(351): n is a, c, g, or t
  misc_feature (361)..(361): n is a, c, g, or t
  misc_feature (368)..(368): n is a, c, g, or t
  misc_feature (370)..(372): n is a, c, g, or t
  misc_feature (398)..(398): n is a, c, g, or t
  misc_feature (413)..(413): n is a, c, g, or t
  misc_feature (442)..(442): n is a, c, g, or t
  misc_feature (467)..(467): n is a, c, g, or t
  misc_feature (471)..(471): n is a, c, g, or t
  misc_feature (486)..(486): n is a, c, g, or t
  misc_feature (513)..(513): n is a, c, g, or t
  misc_feature (518)..(518): n is a, c, g, or t
  misc_feature (693)..(693): n is a, c, g, or t
  misc_feature (695)..(695): n is a, c, g, or t
  misc_feature (697)..(700): n is a, c, g, or t
  misc_feature (702)..(702): n is a, c, g, or t
  misc_feature (704)..(705): n is a, c, g, or t
  misc_feature (708)..(709): n is a, c, g, or t
  misc_feature (711)..(711): n is a, c, g, or t
  misc_feature (716)..(717): n is a, c, g, or t
  misc_feature (720)..(720): n is a, c, g, or t
  misc_feature (722)..(722): n is a, c, g, or t
  misc_feature (730)..(730): n is a, c, g, or t
  misc_feature (944)..(944): n is a, c, g, or t
tatacatataatctagataaggtgtaatgtttcctaatattaattactgtacttaaaaatttacaggacatgaacataaatanagcnctttaaaactggcaaacgtagtaatagtctgtcattcagtacaaggcatatttatgttatttccaaagccatcaccctaaaatcctaagttgccactcttaaaacctaaaantaatgtngaaaactaaagtnataaatanatgtatacatacatttgcntatttacacttatgcaganatcatcaatatactagnncncagctttaagactgtnnttgngtntgngnntgtnggaccatntgtnacatttnaganaggntcttntgttattttnagttaanannncaaaacagaacaactttggtcaagtnccagatgcatttgcnttatattacattctgtgttgctgcaagantctagtctacagagatccatatatnagtnctcatttggtttganaatgcattttaccatgaactgcaaaanttaanagagaccacaatcttttagattattttttatgatgacatctgttacagcatcaaaaacaaactgcacattcttagtatctgtggcacatgtgaagtgggtgtatatttcctttgtgtcctttcttttattgaggtcttcaaactgacattgaatatatgcagctgcctcttcatncncnnnngntnntgnntnttttnnttngnatatagtnagggggctctttttgattttttcttcaaagagatccttcttgtttagaaaaagtataatggatgtatctgtaaaccacttgttgttacatatgctgtcaaacaatttcatgctttcatgcattcggttcatttcttcatcttcagctagaaccaggtcgtagtcactcagtgctacacagaagatgatcgccgtcactccttcggagcaatgantcactt

SEQ ID NO: 505913 - DNA, 843 bp, Homo sapiens
gactgcgtgttacgggagagtgaagctgcgaggctcctcccgctgcgggcgggctcgccctcgctctcctcgtctccgccggcccggccggcccggcccgccatggagaagatgagctgatccagaaggccaagctgccgagcaggccgaggctagagaatggcacctgcatgaaggcagtgaccgagcaggcgcgagtgtccacgaggagcgcaactgtctccgtgcctacaagaacgtggtcgggggccgcagtccgctggaggggtcatctctagcatcgagcagaagacgaacctccgacaagaagttgcagctgattagggactatcgggagaaagtggagtccgagctgagatccatctgcaccacggtgcttggaattgttggataactatttcaatagccaatgcaattaatccagagagtaggggtcttctatctgaaaatgaggggtgatcacttccggtaaccttgctgaagttgcgtgtggtgatgatcgaaaacaaaacggatagataattcccaggagcttaccaagaggcatttgatataagcaagaaaggagatgaacccagaaaccaattccgcctggggcttgctcttaacttttctgtatttactaatgaaggattcttaataaacccagagttggctgcacgctggttaaaaagggtttttgatgaggccattggtgacttgatacactgaatgagacccatacaagaaagagcctctatgcggttgtaagagactaaattttggctcgaagtcggggagaatttttggggagggtcaaagcacacaggggcctcttctcgaacctttagtcccctttaccgt

SEQ ID NO: 505914 - DNA, 818 bp, Homo sapiens
  misc_feature (203)..(203): n is a, c, g, or t
  misc_feature (429)..(429): n is a, c, g, or t
  misc_feature (569)..(569): n is a, c, g, or t
ctggaactagacaggactcccaactagatacaactgacacgaagataaggtcactgggacccgtggctttatcactgatcatcactgctggtgcatgggtttgcctgtccaggtttggaatactgacgatgggtgtgagtcaagtgtccgagcctcacacaggggcatagattttcaggtccctggtgtccatagtgctatantcgcgttagaagaatggcataccacatccgtgtgctcgagcgggcacgtcaactctgggcagctatttgcaatcgagtctggaccgatccgttccacggcgcacttcattagttgatgctccatgcatttctactttgggatacatgtgaagagtatatgagtaccgtctgtgagtcgagactatactgactcctgtaggcaaccaatgccatgctctctggggcntaagtggtggcgttagtaggctgacgacgcaagtggcgcgtgtcgaagatcgtgcattgccatgactcctttgttccttctttgatgccaagaaataggcctcccaggtagtaccttattaagcattcggaaggttatanggacctcggatagagcatgggtggtcgaaagaaggctgtgaatagacaaaaaaaggctttcttgggaaaaaaagggcaccttctggaggagagggagactaagtggagactggccaacttggttgggacccggaaaaaagggagttatttttaagatggcgaacacaattggggaggcaacacaagaagggaagaggaagcgaagcagagggaaaagggcaaatcgggaagggtggggaagccgaggga

SEQ ID NO: 505915 - DNA, 225 bp, Homo sapiens
gggaggcgggccgagggcgttttagcttaggcccgcgttgattcttgggttgaggaggttgcgcgccccttaggcttcgcgcgttaagacgcgccggcattgttgggcgggagaaaaaactctctataaactttttttccccggagctttcggcttgtggaggaggaagttaacatccctaatatgaggggtctcgttacttgtggcaacctggggtttttttgc

SEQ ID NO: 505916 - DNA, 188 bp, Homo sapiens
tagtcgatgcactgggggcatgggaaggggatagggaaggaggctaaagagcagccgttgtgggtgtctaaacaggaaaggcaggagtcctccaccctttcacagataaggactagagaagctatgtgattctcacagtgaggaaatagcacagccaccttgagaactcaaggtggcatcgataaaca

SEQ ID NO: 505917 - DNA, 579 bp, Homo sapiens
tgccagaggtcccattgatagcggatacggtggtgtgcagcactgttcgatataaatctgatctaaatcttcctgattattcatacgttctcccaagagtggataaatggtttgcggtctctcccactgtgaagccacagcgaaacagcaaagcagcacagactgatcctctccatggctgtggctgcaggaggcctgtggatgaggtacacgtgctccatgtactccgtgatcctgtgcaagaagctcagaggctcgttgaaggcgattgggatcgtgatcttggacagctccaggccaacactcttcttcaggatggtccacacgctgaagtcgcttctgctgaacatgggagtcggcagcgatgtcctgtgtttctgaattccgttctcttgagagggcctctccccagttttcccaatcctaatatttttgctggtgtctaagtcaatcattcccgtgactttctgatttgcctctgaaaatatcccagatgagttatcagaatcaaaggctgtgacgggatcaaagaattcttcctctccgttcatccttcagcaggcagcctccactgtcctc

SEQ ID NO: 505918 - DNA, 886 bp, Homo sapiens
gggtacggagggtgtaggaaaggtctttgcatcatttgtaaattatgtcgtttgcaaatgacataatttttttcttaagaaaaaaattatgtcatatatgcaaaccacctaattatcttcttacgacaaacgagcacatctaatttgcaaagttctcgcaactatctagaaatatctagtgattggttatcgcatatctacaattaactctaggtgaaatgcagtgcgagagcacgactgatcgtcacgttgttactaccccattggtgacaaaccacatgtgtgcgatgttactggtttcgactgctgatagttcctagctataaggatacgaccaaattttggtggcaaccccattacgtggtagacacttcaacatacacaacaccggaaacaaagttaattcaaaaccccccaccttttcgggtactacacaatatcacattaggcagctctagggacttcgtccaccgccatgctggcccgccacacacacaccccattacccacaaacaggaggcataaacaccgtagctcgaagtaacccggatccggccaaccacagtcccataggtgacagatactacaaaaaaggaaaatagtgaccaacgataatcggcacaaatgagtcatccacgaaggacaacgctcccactgcttacgaactacgagcccatcctaaacactgccaacaccattatagagaacccacaggcaggcctactgccgcagcctacagaccggcccaaaggagacttaacatgaataccttaaccaagagtttcacatttaacctttaaagtatcaaacactattagccgcacatcacaggcaaaggtcacaacgatcatcatccaaaccatatgtacactttacacatctttac

SEQ ID NO: 505919 - DNA, 864 bp, Homo sapiens
gattatgggttacacttcaatttacagggcataaacaatgattatctattactctgaactttatgattacatgtcttcagattacatgggatggtagtgggagttaccatgtaacccaaacataattaacatgtaattagtttacagatggtagggcatcacttcaattcaccaagcatgtagttctagcgcactagcatggcgccagccaggtacttacaatgtagttacagagtattacattggtgatttggcacaggtacaaataaggtgtctggatatatttcctatgtaaaggaacccctctcctttccctttctgttccctgcgctgtggtataaatatatatatttctccatacaagatctctgagagtgaaaaataaacttgtgcggtgaatgatttaggcattttatgagagtgctgtgggaaaggactggataattcaccctttgggtctgggaagagtggaattcttctgtacagggtgattcaaaattggatgtgatgactgtgtggcaagttaactttccagttcatgtggcattactttatttcaaactttgtgaaaggatctgtggaggtaaattctgggtttgaaagttgcgacctttacacactgtccttttctaagtggtaagaagtaatcctctttgtggggggttctaaagaaaaggattcagaatcatttttacctaatggaatttgggattttttcaaatgggaaacaaggtgtgggcatgggattataattaacgcgggtggtagcttgagagaatcggccatagttacgggggtttatttacaaaacagaataggtttcccaccggtttttgggaaaagggggggggaacaccgggataa

SEQ ID NO: 505920 - DNA, 141 bp, Homo sapiens
gcgtcactctgaggatccctagagaccgtgttgcattggtccagggtatccatgcatcctcagcacattttatcaacacttgatgtggtgacacaccacagaacacaggaagtgtaggagaataagaatgacctgggcttt

SEQ ID NO: 505921 - DNA, 124 bp, Homo sapiens
  misc_feature (16)..(16): n is a, c, g, or t
agcggcggcctttttnttcacaccactttatacaaaagtaaacatggacagaacacactgcatttctgggacgagtcgagctgatacacaatactattaatcggggctcactgtgtggaatatc

SEQ ID NO: 505922 - DNA, 758 bp, Homo sapiens
agcgggtttcactgcaaggccggtggcacggagaggttgtggtgctagtgtctctacgccatccagtgccatcctcgctcgctgcagcgagacacgctctcgcacgaccagcacactgaacctgagcatgatgacccttatcggtgtgcacccgtcaatggggcctactaatcgtgtcttggagataagcccagtgatcgccgtatctaactcccgcagctgtcctcgggagactggatccgtcttccggccgtcgtcgatgattaaaggagcgcagtcaagttccattgttgtgaacacatcgttggacgcaggcggagtagatgatcgcatagcgtagtggcaagttccgacaagactgtgcctcatgtgagagggtcgcatctcacacttatgtgctagtgatgctgcgttatctcctcaagagtgcgtcacgcttatgcgcctctcagggctcctcgggagtaaggtaacccgtgcgctctctggtgatcgtcacatacgggtcatcgcaaccacgagtgcgatgttgtggggccgatatcgcacatggactgttgctgtagttgtggccttgctccatcgtggaccaactcggactgacttggtcatcttggaatcttgcgagcatgaagactatcaaagctgatggaataccctggcgtgtgtgctggaatacgacgtgtctcaggatgaggagccacttcagagtggggtgtcttgatgtccggttctcggcctaactagcagctaatccg

SEQ ID NO: 505923 - DNA, 362 bp, Homo sapiens
tactcgcataatttttgtaattttttagtagagacgggggtttcaccatgttggtcaggctggtctcaaattcccgaccgcaggtgatccacctgcctcagcctcccaaagtgctgggattacaggcgtgagccactgcgtctggcctgtatttccattttcagttttctttcttctttcttcctcctttcattccctctcctttctttcacctcttctattttctttccccgtcttgccatattttgtaatgtaattctcatatgttcatcaaaatctcttaaattggaagacaggaaagtctctggccagtatcaaccttaaacaagtttaattaatttggaaagtttcttatctcgtgc

SEQ ID NO: 505924 - DNA, 1139 bp, Homo sapiens
tcccttcctcacatacaaaatcttctccacataccaaatttcttgcagctataaagtcacttgatgtgttgtggccgggttcccatttatatctcccttaaaacctcgtgtttgacattcaaaattatgacaggtgtgttattatctccattaaaatatttacattagccagcggcattatttagcgctttagaacatcttgggcaatttaaacccactataaaagagagaggacacaagaacccccattccttacagtgtttgtggaaattcagggtgttctcagccgggtctcccttatctgtgggcgaactgtgatacacgtggttctcaagagggccaagcagagaggcacaagaggcgaggtatacttctcagaaggcaccacgtgcaccccttattgaatctgtggaacccccgttttgtgcatgtttacccccaaagtgttcattgttaccaacacacacctttctcctccagagggtggctcctccataatctctttaaaatgtgagaaggctcccagctttgttataccaaatatgtgaaagcacgaagaaaaacacgaaccatttatactctccgtgtgtgggaagaatattctcctataactttcatatactattatgtgcccacgtgtgtctgtggtggatcttgtgagcaccatattaagcgtgcgtctccccccaaaaaaagatcttttgtttccaacgagatttctatctccccggagaaaacatttttataaagggggttgggggagtagaactcacaactacaaatttctgttgtgccccccctacacaacttgggttatacccttttccttttctcccccacagttgtgttgtgcttataacggaacacccaaacagggttttggaccctttgaaaccaggcataccccacaagtgcgctggataaggattacccccaaaagtgtggccagcatttttttccccccaataatttagtggggccaacacatacttttcacagggccctacaacaatagtcccattatagtggaggcgaattaacactgtggcgcacactttgggggaatatatcgtcacaccatctctttgtgtcaacccacagaaactataatccctgggaacacccacccttcacagagt

SEQ ID NO: 505925 - DNA, 236 bp, Homo sapiens
aagcttttaccgctccaattaagattataaaaaagtaatggagcttaatagtcaacaaacattttctaaaggtaattttggcacctgtaatcccacaactttgggaggccgagatgggagaatcatttggagccaggagttcgagatcagcctgaccaatatggcaaaaccccatctctactaaaaatacaaaaattagctgggcgcaatgtcacacgcatgtgcggtaaaagctt

SEQ ID NO: 505926 - DNA, 231 bp, Homo sapiens
aggagctttgtaggcaggtaggcgctcacagcttatgaaggtggcgcagggcagggcaggagagggctagcggaggaggggacacggtgcacagtgccgtggggactgccatgcactctggctggtgtaacatgcccacagcaaggctcggtgacgagagcaccggagcccaatgaggtggggttgtcgtggctctgccccaggactctgagctccattggtcaaagcccg

SEQ ID NO: 505927 - DNA, 115 bp, Homo sapiens
tggaggtgcacacgcatgtggtcagatgaatggacattttagtattgccccgctcttcagtttatataatccatatgcaacaagggctgcaaaacccgctattccaacgggtacg

SEQ ID NO: 505928 - DNA, 233 bp, Homo sapiens
gaagaaacattgcaactgctctgtgctttcaaaacaaagtgttcccccccaccccaaatttgtctaagcactggcccgtctgttgtgggccttgttttctacaaccaaattctgggtttttatcttctttctttaaacatagaggtacaccacaagggatagctactctctcgcagctcttgaaagcatctgtttgagggaaaggctctgggcaagccagtggttatatggat

SEQ ID NO: 505929 - DNA, 390 bp, Homo sapiens
tcgagctcgctacctgtaacattcgtgtccaatgccccgcctaaatataacgtatggccagccataattacccccatactccttacactatttcctcatcacccatctgaataatattatacagaatgtaccacctacctccctcaccaaagcccataaaaataataaattatcacaaagcctgagaaccagaatgagcgagaatctgttcgcttcattcattgcccccacaatcctaggcctacccgccgcagttctgatcattctatttccccctctatggatccccacctccaaatacctcatcagcaaccgactaatcaccaaccaacaatgactaatcaaactaagctcaaaacagatgataaccatacacaacactaaaggacg

SEQ ID NO: 505930 - DNA, 358 bp, Homo sapiens
  misc_feature (194)..(194): n is a, c, g, or t
  misc_feature (201)..(201): n is a, c, g, or t
  misc_feature (238)..(238): n is a, c, g, or t
  misc_feature (297)..(297): n is a, c, g, or t
gaagtcaagcgcgcagtattcacaatagcaaagaataaataacccagatgccatcaatggtgtcagggataaggaaaatgtggcacatatacaccatgaaccatgaaatactacacagccataaaaaagaatgaaatcatgtccgtttgcagacaacagtggtctcacatcgtaagtagggagctaaacattgnaagacanaatatacataacagatgagaacacacagacactgggngactactatgagggggagagtaacaggaggaggttatgtgctgaaaaactacctattgngtactatgctcactatctgggtgatgggaccatctatgctattgaaacttctaaaactagg

SEQ ID NO: 505931 - DNA, 420 bp, Homo sapiens
ttcatagaagctaagctacttatccaaggccacacaggtccgacagaacataaacccagtccctgtatctttacatgaggttacatccccagtggagagagacatctgtcatatattaaaatgggggtcatctggagtatgagcacaatgatgaaggaacacagagaagttagtggggcaacaaacgagaagtctaagaaaagctcacagacgaactgacatgtaacagggctttaaagtatttgcccagccagagaagataaaagaagcattccagatcaggggaaagaagggagagtaatttttttccaggtaataccataaggcaaagaggttttgcagtacagatgactcactttatagaatgatggggaagaagttacctctagaagtcaataaattgatgcctccctcgaccct

SEQ ID NO: 505932 - DNA, 129 bp, Homo sapiens
  misc_feature (10)..(10): n is a, c, g, or t
agagtggctnctgctctgcacacgctgatgctcaggcgctgcactgctcacttctcttctgccctgaaagcctctgtctttttcatttggggtcagctaggcgagtctgatactgaagagggagcagca

SEQ ID NO: 505933 - DNA, 714 bp, Homo sapiens
  misc_feature (322)..(322): n is a, c, g, or t
ctattatttcgccaatgctttccagtttgggtaaaagattaaaccttatctctcaaataaaaatatgtagtcgggccttggtgattacatctgtattccaagcactttggaagtacaagggtgtagaattgcttgagctcagaagtcagattccagcttggttaacatggtaaagccccctctctccaaaagaaatgtaaaagttatcaaggagtgttggcatgtgcttgtagtgccagcacttggagcctggcctagacgtctgcttagcctgggagatagaggctgcagtgagctatgactgtgccgctacacccgagcntggtcaagagtgtacgactccgtctcaataaaatgaatgaatgaatgaatgaatgtgcgaatgaatgaatagacataaaagataggagcattagagagaatgatcatagtgtagactgggcgggcgcggtggctcacgcctgtaatcccagcactttgggaggccgagataggtggatcacttgaggtcaggagttcaagaccagcctggccaacatggtggatccccatctccactataaatacaaaaattggccaggcttggtggcgcatgcttgtaatctcagccactggggaggctgaggcatgagaatcatttgaacccaggaagtggaggttgcagtgagctgagatcccgccactgcactttagcctgggtgacagagcaagact

SEQ ID NO: 505934 - DNA, 151 bp, Homo sapiens
gtggtttgggcttgcattcccactgcctgagaggctcaaggatacatcttgcgccctactcggttccagtggacggacggcaaagcagctttttcggggttttgaatggtgtagcatcggattcatacatattagggctggactgtgtgca

SEQ ID NO: 505935 - DNA, 207 bp, Homo sapiens
cccccgttatggtcttgtgctgggtggcgtagcacttagggggaacctgctctatgctgttctccccgggactgatggcagatggagtctgtggcagcggcagatgtctcagtgtgatggcccagtgcccactcatggggtttttgggtggaactatatcatatgtggtacatattgctgctcgagtaggctatgtcctggcactca

SEQ ID NO: 505936 - DNA, 114 bp, Homo sapiens
  misc_feature (3)..(3): n is a, c, g, or t
  misc_feature (67)..(67): n is a, c, g, or t
  misc_feature (98)..(98): n is a, c, g, or t
cgncctggcctgccgttgccctgggctgcagcctcggccccagggtcctgctcccagtcaccgccgnccaggaaggacgccgccctggggggctgggngctgcttttgtttctt

SEQ ID NO: 505937 - DNA, 597 bp, Homo sapiens
tgggcaagatcagaatagccacgacaatatggaaagaaagaacaaagtcagaagactgacacacccaacttcaacacttactataaagctacagtaagtcaagaagtgtggtgttgatgaaagaatagaacaataggactatttagttctattgttcaaaatagacccataaaaatatagtcaactgatcttcgacaaaggagcagaggcaatacaattaggaaagatagtctccaacaaagagtgcaggaataatgaatatccacatgccaaaaaaatgaatctagacccaaaccatatacccttcacaaaaattaagtcaaaatggattacagacctaaacataaaatgcaaaactagaaaactcctagaaaataacacaggagaaaatctaggtgaccttggggatgttgatggctttttagatacagcagcacaaaaggcatggtcaatgaaagaaagaactgataagcgaaacttaaaaaaactgctgctatgtgaaagatactgtcaagagaacgagaagacaagccacagatgggaaaaactattagcaaaagcaggatctgaaaaaggactattatccaaaatatgcta

SEQ ID NO: 505938 - DNA, 1399 bp, Homo sapiens
tgggctataaaataatttattacagaatagcctataatctccggtaacaagggcccttattaataattctaacaccagcaaagaagtgctgggttccgtgggtagcagggtaagggccagtacatcgggggacaaggtcgagctcctcaggaagctccaggaggcgtgcatacagaggaaactccaaaaaccagtgttcacaatcttcttcaaacaaagctctggggaaagttccaatcgtgacctcctctgaacacagattgggtcctgtgaaccctcccgaggaaaggtggtgggaggggccccatatccattccaagccgtggtaccaggaggggcatccagaagataccgaggcttcccttctaatgagcgggtggcaatacatcccgacagggggaaatacagcaaagatgaaccccgcgagagtgagagaacaaggagagaggagaacccaaagcggtctacaaaatctcatatccgctgagcaaagcgcggagaggcgcagcgtgtctcagaccagagggccacgtggggacccacccgagaattgcaaacccgcggcaactttaaccatacagacacggggggtcttcccaccaacccactataacacaggggcgctaagggggaccacacggggccgcccacccgaccaaagcaaagcacacatcacctcccggtagagaattccataacccaaacacacaagagcccccctcaccagcgataagcaccacactaggtcaaaacaaaacgagctcttggtcaacaccgtcgcgcaagacaaagcactcaccatctaccccccgtgcctccaaacagagaacgtctgcaggcgagtgagcaacacctccccagaggccaagggtagagcccccccataggggcccccgtggcgggaccccacacagggaaagaaacaatccatcacacacgggggccttctggacacacaccccgcgttagcacccggcgacgtgctaccaccttccagacagcaaacaaccgccgggggcaaaaaccgggactcacgacaaccagcaccaagtcaccccagaacagacaacaagtagaagacgactccacaacacgcgccgatgaaccaagcgagaacccccacagcaccaaccgaagggcaaaactacaccagaggagacaggcccactaactcccaccacgggaaaccaccacccaccggccaaacctcacccccacagaccccggaccaccaccacgggcgacaaaacacacccactacacaggccaacaacacaacgtcaacacagtagcaaaacaagcaacaacatgctaaccaaccacccgcgacaaacaccagagcgagaccagaaaagacacacagagacacacaacagccactaacaccccacgcacacac

SEQ ID NO: 505939 - DNA, 295 bp, Homo sapiens
  misc_feature (247)..(247): n is a, c, g, or t
tacaggtgctgacagcccagaagtcacaagagaagagtggaagggcaagaattcaacagaatgttcatacaatgtggcaactcttttgcatagttgcgtaggatcctgttttgtatgctatcataaatatctgtagtttctatttttttctctcccaactgaggctattacacttttaatgggattcagtcttgtctctgtgtcctagaaagaccttaatctggtatgacgcatgagcctgttgtanaatattatcctattaaatgctgggtaaataagttgtcgcagttattcc

SEQ ID NO: 505940 - DNA, 393 bp, Homo sapiens
atccccgctattgagcagtgcacacgtattattcaacaaagcaagaactattttacagtgtctgttaactaaaagttctctatcagatagaggaaactacatgtatcctgaagctatttcctccaacgagctagttgagtagatggacctttgggcccatcttatttttccttctttttgttctccagtaaggttcctgtgcccttatgcacatcctatcccatcatctttccttggtttgcgatgatcttgaaacgctagcgtctgtatttttccgtgagatcactggtggcaagggatctctggatcgtgctggctgttcatggttaattcatttctggtgggaagtttccatttgcttccagagttccagtcccaaatccgcactttttc

SEQ ID NO: 505941 - DNA, 1024 bp, Homo sapiens
cagaggcgcttgtttatctgctgaccttccctccactattgtcccatgaccctgccaaatccccctctgtgagaaacacccaagaattatcaataaaaaaataaaaaaaaaataaaaaaatgcagttctctaaattttgggggagactgaatttcaggtaataaaactctagtcttccaaaaaaaaaaaaaacaaccttcttttcaaaccttttctaatctatttaagggttttttttttatactccctcctcgccagaacctctccaacagtgtgttcgggcgtggtccgcggaaaactccgggccccattatttgtgccggctcttccggtgatttgcgcggggccccgtggcccaaaagcgaacggtgggttgttgtgctccctcgttcccagggtgtgtaggcgcgttctcccagagacgggcgccaccggcagcagactttagggcccagtttgtggagggtcctttcatgttaccgtgggctccctgggtgttgcccccgagggtgtcccgggacccttgagcgtcagaacccgcagtcttttttttcccgaatgggctcaatcctcccgctttctctacctctcgtgaagccggcagacatctccttctccggtgggtgagccccccaattgcgacttcatgcggccatcaccctcggacattcgggcccagaggccccgttcaactcctgccccccaatttctcactgaactcccagcaaaaaccggcgcatctcaacgacgggtcgctcgatttacacatgttccatccctattaagtttggttattaacccggtcctcaacctttcccgatctttttgtgccccttaatgcccgacgttaccgtgaccttttctccacctcgtccctctcgagttcacttatccgtgcaacacccggcataacgacgcgctgcaccgcaaatcccgccgcagacgagagggacccctctccttggacagcgtcgcatggccgccaaccagagcgctgcctctacacgtcacgcgtcaaccgaac

SEQ ID NO: 505942 - DNA, 511 bp, Homo sapiens
  misc_feature (176)..(176): n is a, c, g, or t
  misc_feature (239)..(239): n is a, c, g, or t
  misc_feature (273)..(273): n is a, c, g, or t
  misc_feature (302)..(302): n is a, c, g, or t
  misc_feature (334)..(334): n is a, c, g, or t
  misc_feature (362)..(362): n is a, c, g, or t
  misc_feature (381)..(381): n is a, c, g, or t
  misc_feature (388)..(388): n is a, c, g, or t
  misc_feature (443)..(443): n is a, c, g, or t
  misc_feature (469)..(469): n is a, c, g, or t
acccagtccacagggttcaagcaattctcctgcctcagccttcggagtagctgggattacaggtgtgcgccaccatgcccggctaatttttgtatttttagtagagacggggtttcaccatgttggccaggctggtctcgaactcctgacctcaggtgatctgccactttggcctnccaaagtgctgggattacaggcatgagccatcgccagcccagaagctaattttttaatattgnatatgggcttatttatcttgaagttttgtgaacngcgcttaacaggataggactaaaatttcnattctcctacactctgcagaagcctagaactnactaaactgggctgcctttccaaatggnggtgctgacagagttgganaagaatngctcaattttcccaatattggtatgtagcattggacagccctttgggcagctttnaggatacatctatcctgtagattaantgtttctacctggcttaggccaaccagtcccgcatggcacgg

SEQ ID NO: 505943 - DNA, 141 bp, Homo sapiens
gtgggtctgcgaccgggacaatgactgtgtgtatggcagtgatgagcccgccaactgcacccagatgacctgtggtgtgtacaagctccgctacaaggattcgatccgctgcgtcccacgccgttgaaagtgcgactgaca

SEQ ID NO: 505944 - DNA, 1144 bp, Homo sapiens
ctcttcccaacatcgtatatactggctgtgcaaacatgtggattggacactagaaacagatgagaacaggatctacaaacaatgttgtgtagctggcttgccagtttactagtgaagaagaactatattataggccagcgttaatgactgccattgatggcaagacagtgactgtttgtatccggtgtagcaatcaaagcctgactagagaagattcttctcaacatgttctgcagactgccgtcaaccagagtgatcagttccttccatcagagcatccacctagtgggcatggttcgtggccagaccctagttccactaccttgcttgagcagatcagcgcatgaacctaagtgtattacacagattcagatgccgttctagggtgctcacgactgaaacacatgctatccatatactaacaacgatttcgtcacctcctggaatcttattatcgctgacacttgctagaagcatggcagccacatgcccggtcatctgcaggaccagaggaagaaattcgcaggcatattcaacgggcaacgacagtacctgaacactgactttcgtctttccgaacataaactgaccctgaccacgcggaatatcccaggctccggacttccctgactcgacacgtactacttccaacaacagaagcaataggcacctcacgcatactcatccaactctacagccaccatcttagcaacctaagcaaaaattccctgcttgaaggctcttacacgacagcatccgtcatcacgtccaccaccgagcttaccatatcccattatcgtcctgggacccacattgaatctaaccagtccaacggcaactaaggataaacgcaaactccccgtggccaaatcaaaacgggccaagcgcccaagtcggtacaacctgaccaacaagaccccccggccatacacacttcccacaggcgaataggatccataaacacaacatgcgcgcgaaccccccaaccgacaaaagaccaatgcccccacaccaaacactgaccgccaagacaacaagcagatatccacataactcaaaacaaacccgtcaaacataagaaccacagccatgagaaaaagtaaactacacaactaacagaagaaccgagagcaccacacgcacg

SEQ ID NO: 505945 - DNA, 1802 bp, Homo sapiens
  misc_feature (568)..(568): n is a, c, g, or t
  misc_feature (626)..(626): n is a, c, g, or t
  misc_feature (654)..(654): n is a, c, g, or t
  misc_feature (721)..(721): n is a, c, g, or t
  misc_feature (1324)..(1324): n is a, c, g, or t
cggtacgctctgtctccgttgcaacgccggtcggaatcgctggtcgcggccgaagctgggtcttgctaagtgacggaacgcatgtgcggaggtaagccttgagcgcggcactgagagtaccgatgcgaaatgaagactgagtctatggtgagggcttggcacaatctgattgtgaaggagtgtactctatcgcccacactaatattgcataggaggataggtctcaatgagtgaactgcatatgactatggtcgcatatagtcacaccgcgaatgctatacattgtaccgcaatagccgcgcgatatcgtacatctggaattcgtaccttcgtcctttccatgcgtcgggcgggccgcgagctcgtgcgtgcatcttgaactgtgttcacgcaagtgcgggtcaaccgcacgtccttgcctagcgcaacaaccatgcacacccaggaatttggcggctgcatcaaaggtctctgtatctcccgaagggcagaaacccagtgtgcctcttgtttcgccaaggcactgttccctgtatctctgtggtgcgtcttcgtgcccctatcattncctcctgtatggaatcattctctccgtacctactgccacctgaatccatttctgtcantttcgcatatgttatgccccacctctgnccctctcttgttccaatccctgaaaggctctctttcccaattgggtgccctctggattctgacgacnttgcgagttaccaacggtgtgtagcacgcacccgcgatcacgccacgcgggatgtcgctccctatgtggggagggagggccccgtgcactggcgcgcggtctcggatcaccgaggggggcaacgggagacctggagcaggcggttcacgttcccattatattagggccatatgagtatatccatgcgtgttgtctttccacgctcgggtccattttaacttcttatgtgaggctttagcttgtgtggtgtttgcgccctcggtgcctgggccaccactccttgtcccttgagagaatgtcattggattgcgggcgcgggggggaccattgaatggcaccttttttctcccccaaggggtccttagaagtaaaacgagggttggcccccggttgtctccacgccgggtatgggccatctggtcgaaaagactaagcccacccgtgtttgttaatttcgccaggctggtatacccagcccaatctccccagagtggtagtcccacctgtggatggttgtggcccccccgagggttggcgccaacacacataggagagcgggccaccttgccagcgacactgggataacgggccacactagtgtcnaagagtgttaggggatacatccgcaacagccgagaaatgcgaaccagggggacatcaccaccacagcggcatggaaaacggtgggggagcccaagaggtgtgcaacgcccaacaggagctaaacacatagaggaacagagatacagagagcaaagcgtgggttcagccaaaaaaagggatctagcgcagacccaaccgaggagagggagagtaccccccaaggaagagccacgctgggacagtagagagaaaagcaggcaacaatataagaacaggagggggggaggcagagaagagttagtcgcagcactcgacaacatacaaaagaggacaccacgaagtaagaaccaacgcgagcacacaaagaggaggatacacaacaacgggaatgcacacacacacaacacggagcgcgcagcagaaacacaaccaaagcaaagaacgaccagacaaaaaaaaggcagtgatgcaaaaaaga

SEQ ID NO: 505946 - DNA, 171 bp, Homo sapiens
cccacgcaaccgctgaatcaagccttgagcctgaatcaaagcaaaccaataccattgataagaaggaggataaaaacaaaatattttggagatgtttttccaacttaaagtatgaagacatactcagttcttggagcctagattaaacccttttttatgcctttcataaga

SEQ ID NO: 505947 - DNA, 1100 bp, Homo sapiens
  misc_feature (205)..(205): n is a, c, g, or t
cattgagagttgttgttggaactggatttcttttaaattctctgctatagaccaagatatgttatgattacattgattgacagttgttgttgggatggattttttaaattctctgccatagacccagatgtgtagacatttgggcatgttctgtccaaccctactttctgtaacctctcttcgttccgttgcctgtagatgtggnatagagtagaatggactgtgtgtttctgatccactgggaagaaatcagttgtccttttcttgcactggtggagaggctttgggaggcgggagcagtttgcagaggagagagctcactgtgacttctgccgtgttcaccgtgggagacaacgtggtttcaggcagcgatgaccgcacggtgaaagtctgggacttgaaaaatatgagatcccccattgcaactattcgcacggactctgccattaacaggatcaatgtatgtgtcggccaaaaaatcatagccctcccccatgacaaccgacaagtgagactgtttgatatgtcaggagtgcgcctggcgcggcttccccggagcagccgacagggccacaggagaatggtatgctgctcggcatggagtgaagaccaccccgtgtgcaatctgttcacctgtgggtttgaccggcaagccattggttggaacatcaacatccctgcattgctacaagaaaaataaggacaccggcagcccttagtttcactgtttgccagcacagacctttgatgggtgcaggcttttctgcgtattaatcagccatttttgtgagagtttgaccctggaaagggtgctttgtatatgttcttttcacatagtgcccagcttgcatgaaatgtacagagaaatgtgtggtcgtattttttacttttgtcttgtatatgtatgtatattgggtcctctgggcagtagaggcaaagctcacctcccatgtagcacatgaaatgcttgtgagttgttgacattggacaggtgaacagtagggcattacatttgtgtgaattaaatgtgaacttctgtattacgttgcgcgtcgcagtcctgcgtttcctgtagtgcttggatagctgctgtatgttgg

SEQ ID NO: 505948 - DNA, 174 bp, Homo sapiens
gtgcctctcacacagaagttaggcatgcacttgtctcagataggttgggaggagactggacagatcaggcgcaggggcaggggcaggaggctgggctagtgctgtggcccagatattgggcagaggtacagtgcggatctcagacagggagagatgactgagttagataagact

SEQ ID NO: 505949 - DNA, 349 bp, Homo sapiens
cacgaggccagccgctgcctgaccggcccgccagggcgcttctggcataatcgcaaccaccgtttctcccccgacgccgcgcgcccgcgcggcgttcgcctgcctggaaatcccgcaatgacccacaccatcaccgtgatccgcggcgacggcatcggcccggaaatcatggacgccaccctgcacgtgctcgatgcgatgcagctcggcctgtcctacgaattcgtcgatgccggcctggtcgcgctcgagaaacacggcgagctgctgccggcggccacgctggaatcgatccgccgcaaccggatcgcgctcaagagcccgctcaccacgccggtcggcgaaggct

SEQ ID NO: 505950 - DNA, 245 bp, Homo sapiens
ccaagaaggagttttgctctgtcacccaggctggagtgcagtggggtgatcccagctatattggaaaagacagcattataaaacaaggccataattttatgaaaaaggaggcatttgcaaacgaaaacaatttttacgaggttatatgtgattgttaacatttttaaaaaaaggtgcacacaaaaatccaaataaaatgtgattacctttgtgcatttgtataaaaaaatatgtgtgtaattata

SEQ ID NO: 505951 - DNA, 297 bp, Homo sapiens
ttttggggggggggggaacccccccccccttggggccctggggcccccggttcccaaagaaaggggggttcccccccccccttttttttttgtcccaaaggggggggggggggggttcccccttttttttccccttttgggggggggggggggcccttttttttccccccccggaaaaaaaaatttggaattaatttttttttttcccattttttttttggggggggggggggttttttttttaggccccttcccggggttttgggggggcaataaagcccccggccccccccccca

SEQ ID NO: 505952 - DNA, 176 bp, Homo sapiens
ggaaggactgagcccagccagaggcgggcaggtcagactgactggacggacgacggacaggcggatgtgtcccccccagcctgctccccataagttggggcctgtgcacaatccaatggaggttccgcatccctggatcgtggctgaaagcgagctgcatacagaggacagaataa

SEQ ID NO: 505953 - DNA, 418 bp, Homo sapiens
  misc_feature (233)..(233): n is a, c, g, or t
  misc_feature (240)..(240): n is a, c, g, or t
  misc_feature (255)..(255): n is a, c, g, or t
  misc_feature (265)..(265): n is a, c, g, or t
  misc_feature (308)..(308): n is a, c, g, or t
  misc_feature (322)..(322): n is a, c, g, or t
  misc_feature (398)..(398): n is a, c, g, or t
tttaacctgcagcagaaagatgtaagctgcagagaagctagaaactcctaaccttctactgaaaccttaacactccacgtggctgtattggaaacagagctcttgaaatggtcaagattaaaccatcatagggctagcctaataccagaggacttggtgtcttataagggagagacaataaagatgcaaaaccaccggggaaagccatgcaaaagaagacagttatccgaaancaagganaaagagtgcaggagnaacccgaatntctctaacacccctcatcttggacttctaatcctctaaggacntgtgagggaatatnactttcctggttggttggaaagccattccagggatgtccttgggtctttccccataccttccttattcattaaatncctcaatattattaatggca

SEQ ID NO: 505954 - DNA, 132 bp, Homo sapiens
tgttatagcgtttagtcctctcggatgacctgattcccgtaccgtgtcacatggtatgcacgggatacatcgaagtgataggcagagtcgaatggtcgtcgcgcacgggggcgtgcgatcggccattcgaag

SEQ ID NO: 505955 - DNA, 549 bp, Homo sapiens
ggaagtcccgacccgtgtcaatggatgccagaattcaggtagcccaggagaatcgcttgaacccaggaggcagaggttgcagtaagccaaggtcacaccactgcactccagcctaggtgacagggcgagactctgtctctcaaaaaaaaaaaaaaaaaaatttctttgaaacggggtctctaattttgtggcccaagctgatctcaaactcggggctcaacggattctcccgtttcaaccttgattagctgggacgacagatacattgctattggcggcccagctagggttaagggttctggtatactctggtctttctaaaggcaattccctgggaaattttctcaacggtgggttataactggaatggctgggaaagggaggggcagccctttcaacgggaaagggggactggcccaaatcttaaatggcacagtcgagattctctgggagctagcaaggggtcctcaggttagtgagcatttagctggcctggtggcagaatttggacccagatggggggtggttccaggtctctcacaattgagc

SEQ ID NO: 505956 - DNA, 132 bp, Homo sapiens
gatgatctacgcgcttaccgggtctgggtaatgccgggtagtagctatcttgtataatcttgaactacaggttgttttgtatttagtgatatggcaaaaaagagattttgtgacacataaagtgatatgaaa

SEQ ID NO: 505957 - DNA, 172 bp, Homo sapiens
tagtcagctcggacccggtatgagcggtctggtatgttgatactaaattaaaggaggatttattggatgtattggacaattggatgaaaagaattcttaccagcaatcttctcatggccaccattctcatcaggttcctgagtaaatatccactgctcaggcttgatttggg

SEQ ID NO: 505958 - DNA, 165 bp, Homo sapiens
atggaatcggagttgtcagtgccgtcgattaccaggtcataagcgccgaccagctccaacgcattgtcggcgttgagagcggtgtcgtgggcattgatctggatattgctgttgaggtcttgcagccgccgcttggccgactcgaccttgggcatgcccaaggtg

SEQ ID NO: 505959 - DNA, 1634 bp, Homo sapiens
aacgtttcattctcgttaataaaggcattatcctaattaaaaaaaaaaaaaaaaaaaaaaaaaaaaaaaaaaaaaaaaaaaaaaaaaaaaaaaaaaaaaaaaaaaaaaaaaagataaaaaaaaaaaaaaaataataataaaaaaaaaaaaaaaataaaaaaaaaaaaaaaaaaaaaaagaaaaaagaagagagcaagtaggctatataatagttaaattggagaatgtggtatttttggaatgatataagagaaaatcagagagacggagcgaacacacaaagctgggaacagccagaccaacactaaagacgaaagtaaggaagacaacgacataagggcgacaaacgtacacacaaacccccaagccactaagaaacaaaaaaggaatgagaagaaaacacagaagactacacaacagctatgcgcccaagcagaatgcactaaaccagacacactaacgcaacacatcaaccgaaaacaaaagagagaaatagcggacagaaagagagagatcaatatcagaacagcccaacgcaaagagctagatgatgcaaccaaacctagacacgaacaatcagtgagtgatgaaaaacatcacaacaacacgagcactgaaaccgacataatcaaaaacaaacgaaacaacacgactaatacaggacggaacacctagacgcacgacgacaacaaacactcaacacgaaacaccagcacccaacagatgcacagaaatgacaacaaaccagaccggagacaagaaatcataatactagaaaaagaaaaacacataaacttatcacacaaatcacctacacataaaacataacgacaaatacaaaatactaaataaaaaaataatctacaacacacaataaaaccaataaaacaacaatcacacacacatctagaccatatacacattatacaaacacaatatatatctatatcaaatcaagacaaaaacacatacaaattacaaaatacaacactaaagaagactataacatcaatataatatatcaataacgaaatcaacagtaacaccagttaaacaatacatatcacaagaaacacaactacgaaagcagagaagacgataggagagagagaagagagagatgaacgagagcgacgagaaacaggacgagaggccgaaattagatggcagaggcgcgaacgctgcagaagcggaagggagagcagagaaaatagagtgggcgggatgacagaggtaggcaacagaggaggatgagcgaggaagaagcgaagtcgagacggcacgaaacgcaggatgcagtaacgactgacacacgaggaggcagaccagacagatgagcagcgcgagagcgaacgaccagcactcagatgcgacccagacggagaaagcgacgaagggcagagcgagacgagcgagcgagagcgcgatcgcaaacctacagatcatctcgtcgagcacaacacgacgaaggcgcgatcgagatgcatagacgcgactgcgagcacaacggcccggagaaccggagcgcacaagcgaggtcggatgagagcaacagaattgagcttggaggatagagtgagaaaaagaaagaacgaacaaaccgacatcccagcacaacaacacaccaaaaaaca

SEQ ID NO: 505960 - DNA, 177 bp, Homo sapiens
tggaaaatgtttgaattagaagttattcaagggccccctcttttttaaaaaaaagcccatggctataaggccaaaaaagtttggcggcatgggggattttttgctcttggaaaagctttttgacccagctttttgataaagcctgaatggaaaaaataaagctgtttttttttgcca

SEQ ID NO: 505961 - DNA, 362 bp, Homo sapiens
aaaaaaaaaaaaacccccttttttttcgtggggttgggctggtttttttggggccccaaaaacaacccgttttacccccgggaccccaggggttggtttttcccccccaagggggccctttattttgccgggggttcccccgatttgggtggccccccagggaaacttaaccccccaaaagggttttggtttttttaaagccggccctttttaagggcccccttccccaccaaaggatttttacctttttccgggggttacccttgtttccgggacccggccgggtggtttcccggcccaaggtttttttttttttttggggttttttaaattgcctgttttaattaattcccccaaaggga

SEQ ID NO: 505962 - DNA, 297 bp, Homo sapiens
  misc_feature (207)..(207): n is a, c, g, or t
acagcacgcgctaacaatactgaaggccaggtctcaaggtgtcacttttgtattcttggatgactgttgaatgtgtggtctcgacgaatggctttgtggagcagctttctccagagacttgcatgtgcttggattaacaaacttgcgatccagggatgctaagcaggtgccttctgtgaccaagctcagtattgagggcgctgctgnccttgaggcagccaagtgttcttgtatacagctgtgttgtgtagcaggttaagtgctgcctctctcctgttgcttgttagcgcgtgctgt

SEQ ID NO: 505963 - DNA, 226 bp, Homo sapiens
gctgaatagtgtcctacggcatagatagggcagtgcccatgtcttcagcaaagaaaggcaaaatagacataccatacgatccagtaatcccacttcttggtatataccgaattgaaagctaggactcaaacagacatttgtatacctatgttcacagccacaatactcacaagacacaagccaaaggtgggagcgatctatctcatttgatagagttgtatacaca

SEQ ID NO: 505964 - DNA, 406 bp, Homo sapiens
tgatagctacagaatagtcctggtgatattgtagaaatggcggtggtgacaaagtcggtgtgatataaggttaacttccatcaaatctaccacactaagagttgaccagtcaattctcacaggtgaatctgtctctgtcatcaagcacactgatcccgtccctgacccacgagctgtcaagcaagatcagaagaacatgcggtattcttggtacagacatagctgttgggaaagctatgggagtggtggtagcaactggagttgacaccgaacgtggtaagatccgggatgaaatggtggcaagagaacaggatagaacaccccttcagcaaaaagtagatgaatttggggaacagctttccaaagtcatctcccttagttgcacatactggtcgagattcgggtc

SEQ ID NO: 505965 - DNA, 1095 bp, Homo sapiens
  misc_feature (855)..(855): n is a, c, g, or t
actctatctttcatcctgggtctctttttttctttcttgcctccaacatattaacacactgtgtacctactatcctacttttccccacccgttttgacacacttgagttttcccttttttacagtttttcaacattttttgtgacctctttttgacacctccgacttggtgcctgcccccccgggttgctacacatatgggtcacacgccggctttcccagccatttatatctgacctcggaaccggctgtgaccatggcacggtttcccgcggcacttgcgttcatgcccgccttgcccccctgaccaacccgggcaaccaacagtaccgggcgcttgacccgtgcccgagctcacccagcagatgtttgatgcccaggacatggatggctgcctgcgacccccgccacatggcccgctacctgtaccggttgccccccgtgttcaggggcccgcatgtcccatgaaggaggttggatgacgccaatagctttaatagtccccaaaccaaattaccgccagcttatttttgttgagatggattcccccgcacacaatagttggaaaccggctgttctgtggacaatacgcccacctccgggggctataaaaatgtcccgccacccctgtcaattggcacatcaagcaccggccacatccacaggagagcctggttcacaagcggcaatctccgaggcacgtgtcaccggccacatgttcccggcgcacaaggcccttctcctgcaactggtaacaccgggcgaagggcacatggaacgaagatggagttcacaccgaagggccgagagcacaacactgagatgacctcggtgtccgaggtaaccacgcacgtancccggaatgccaccacagccgaaggaaggaagggcgagttcgaggaggaggctcgaggaaggaaggtggcctagaggccctcacgtcacctggggaaaagcacgggaaagcacgtgtgaactctttaattcaactcccacgcctgtcctgtggcctgtccccctgtgtgcacacttgctgttttccctgtccacatccatgctgtacagacaccacccatttaagcattttcatagtgga

SEQ ID NO: 505966 - DNA, 342 bp, Homo sapiens
aaatgcttttcctttatcttgttagcttccttctctttgattcaaagaatgtcttttttgtgtactggtgtctctgtaaaattatgattttctttatggtttaaaaaggcaagagagcccttgctttcttacctaatccaagtttgtgtagtgaatttaaaaagaaaaaaaattgttataagtttggagcaagggagtatgtgtttcaaaggattccttcctttttgtgtgtttttccttttgtccaatggggaacctaaatctgttttaattgccaacacatggcaaaaagtcattttgtattgccaagtgtggaccttcctttgttttttgcataaagtt

SEQ ID NO: 505967 - DNA, 1564 bp, Homo sapiens
  misc_feature (848)..(849): n is a, c, g, or t
  misc_feature (871)..(871): n is a, c, g, or t
  misc_feature (873)..(873): n is a, c, g, or t
  misc_feature (899)..(899): n is a, c, g, or t
  misc_feature (924)..(924): n is a, c, g, or t
  misc_feature (949)..(949): n is a, c, g, or t
  misc_feature (1065)..(1065): n is a, c, g, or t
  misc_feature (1490)..(1490): n is a, c, g, or t
gattttgaataagtattatctgttgttcgttttgttgcttgtttattttttgagttgttgtggtggtgatatgtgtttgttgtgtttgtgtgttgctttgttgtttttgtgatagtgtttgttgctgtgatttttgttattgatttgtgtattggtgctgttgtagtgtattttgttattgtttatggtgtttgagggttgtgattgattgatgttttgtggttgattatggtgtgacttgtattttggaagtatttgtgttggtattttattggttttgtgagttttagttgtgtagttatgtggtattgtgatatagatttgtgtatgagtatgttattgttgacttaggtttatttgtggttgtgttgtctgttttctgcttggtgtttttttggtggtgctggctatgtggtgtgtggttgcggtgcttccgttgttgtttctgctttttgttgttccgtttttgttctctctgtttttgtgttttgttggtgttgtgttcttgtttgtttgtggtggtgttctgttgtggtttttgtgctgttgtgttgtgggtgttggtggttatttgttttgtttttttcccgccgcgcccgcgatggtgttagaaacggcgtacaccaggttgaatagcacagtagaccgtttatttggtatttcgaaacgccgcaaataccgagattttataggtgcaccacgctatttaggaaccctctgaaaaggagtccccccacaaaggtgtgtgggcaccacaaaaaagccccgcgtctttgtataaaaaacggaccgcgcccaccgtaaactatttataccgggtgtcctaaaggttattacccgagaggccnnttgggtgtgccgaaaattttcngngcaccgagagggcgccccacaaccantggggccggccgtttctcgcacccncacaacccccggtgagaagagaagnggcgcgcccccgcgggttcacatcacatatgagaaaaagtgatcttatacacagcgcgcgccctctggggcacacacagagactttccaacacacacggaccacacaggcgcgctntgtgtgcgcgagaggagagagttccccactctatgtccccccgccccacaaaaagctctctccgccaacacacacagagatatccaccagggttaatgtcaccgcgcacatcttgagatgagaagcgcgagaattctacagagagagaggcgccaccgtataagagagggtgatatctttcccctcacacagctcgcacaggagaggagaggagagaagagagagaaagagagagaagaccacacattaatgttcctcgagaggttctcacgcccctggaatacacaggagagaattatattgaaagtatagagtcccgaccacactaaaggagaaatgctgaaagcttttggagacttcggccagtctgtccacaaccttcacaggtcacactcagcctaccggttgggatgaatttccaaacncctcggggacctgtttgaatatttttctgtagtgctgtattattttccaataaattctgggaccaccacgccca

SEQ ID NO: 505968 - DNA, 331 bp, Homo sapiens
  misc_feature (74)..(74): n is a, c, g, or t
  misc_feature (112)..(112): n is a, c, g, or t
  misc_feature (115)..(115): n is a, c, g, or t
  misc_feature (120)..(120): n is a, c, g, or t
  misc_feature (138)..(138): n is a, c, g, or t
  misc_feature (145)..(145): n is a, c, g, or t
  misc_feature (147)..(147): n is a, c, g, or t
  misc_feature (157)..(157): n is a, c, g, or t
  misc_feature (168)..(168): n is a, c, g, or t
  misc_feature (171)..(171): n is a, c, g, or t
  misc_feature (185)..(185): n is a, c, g, or t
  misc_feature (190)..(190): n is a, c, g, or t
  misc_feature (219)..(219): n is a, c, g, or t
  misc_feature (222)..(223): n is a, c, g, or t
  misc_feature (238)..(238): n is a, c, g, or t
  misc_feature (253)..(253): n is a, c, g, or t
  misc_feature (261)..(261): n is a, c, g, or t
  misc_feature (267)..(267): n is a, c, g, or t
  misc_feature (269)..(270): n is a, c, g, or t
  misc_feature (279)..(279): n is a, c, g, or t
  misc_feature (281)..(281): n is a, c, g, or t
  misc_feature (288)..(288): n is a, c, g, or t
  misc_feature (296)..(296): n is a, c, g, or t
  misc_feature (317)..(319): n is a, c, g, or t
  misc_feature (326)..(326): n is a, c, g, or t
gtcgcgcggaggcggaggcttggggtgcgttcaagattcaacttcacccggtaacccaccgccatggccgatgnaggcattgctgctggaggtgtaatggacgataatactnctntacanagaggctctgaagactcnccctcantncacgatggcnctagcacgtgnganttcgcgaagtcgcncaaangctcttagacagagcgtcaagccatgctntgnngtgctgtgcatccanctgtggatgagcctnattgtatntcaagntnngtgggaggncnttttttnttgaacancaaatcagcctgaattaaggnnngatgganaacaa

SEQ ID NO: 505969 - DNA, 802 bp, Homo sapiens
ggcatctgcaggatgtgactctgaaagaaggccagatttgtaccatgacatgccaactttactgtaccaaatgtaaaatctgaatggttcagaaatggctagaatccttaaatcccagagggttgagacataacagactagaatgtggagacacatagagtgccatcaaatatgactcatatgctagactgttcgatgacagaatgagccaggatcagtacatctgcgattatgaagaccttgaaacttcaatgcagaacttcgagaattcgaacgctgagactcaattcatgtttacaaaggcgcatactgaacatcgtggtgagtgagcagtcagtcctgccactctttgagtgtgaagtgtctctttgatgattgccatttgtaactctggtacaataggaccaagcaagatactgacagaagagtcctagaaagatagaaacttcagggaaatgagtggccgctgtcattagtatgatccatccataaatgtgaccccagaccgatgaaggtggtctactcggtcatcgctcggtggatactcactgaggtgaaagccggaagcacggagagcctgtaagctatacggagaacagacctcatactttgagcttgaagacctctctgaatattcctgatccaggagttcaagtccaatcatgtctatctagagctggtgcgacagaagaaaattccttccgtggatggtccatctaatcccctttggttccataaccgaagaaaaaaaccccacaaagttttggcgtccaaaagggtggacaaaaagcccagtgtgcaa

SEQ ID NO: 505970 - DNA, 305 bp, Homo sapiens
tttcccccccggggggaaaaaaaaaatgcaagtttgggccaaaggcggggtcccctccagggggggctcccccttttttcccccccgggtccgcccttaattttttggggccaccccccttaaattggggggggggccctttttttttccccggggccggtttttgcccaaaaactttaaccccggggggggattttttccccttttggggggcccctttgggggggggggccctttttccccttttcccaggggggttttttttttttttttttttttttttaaatggttgggcccttgcccca

SEQ ID NO: 505971 - DNA, 740 bp, Homo sapiens
  misc_feature (740)..(740): n is a, c, g, or t
cgcggtggctcacgcctgtaatcagagcactttgggacggctggatgcgggtggatcactgaagtcaggacatgtataccagtcggctggctagaccagcggtgaaaaccccgcgctgtctagctaaaacaatatgaacactaacaattaatagattaagccagcggacgtggatggctatggtgcctagtaagtcccagactacttcggggagagcttgagtgccaggagatatgggcactgaatcctgtggaggactggacggttgcatgtgagattgaggatcacagccattacatccctccagcacttgtggcagacaaagtgatgatcgtccaatctcaaaggaagaagaacgaatggtttgaagaatagtttcttgggagaagtatccaataagtcacggcactccaagacaagtgtctatattattaagcctcactttcagaggacacgcgcgcgggggactcacacctttgtttaacaagtattttgacctgggggctgcacaggtagcgatatggccaaaagagaggacaaccgcacagttggcgaaaagatacctggagcgtgggggagagttatccacggaatctttaaggaccagacagtagtggctaaggcaaggaaaggaaataggtaatattctacgtggataagtaaaagcgaagtggcagaagacggttggacaaaggctgggggaaaatctggcagactttgtataaaggattgactggagn

SEQ ID NO: 505972 - DNA, 718 bp, Homo sapiens
aggatctccactgagcgtacagtcaccaagcgcctatcactaccagctgacatccggccgtgcctgagggctacctggagaagctgaccctcaatagccccatctttgacgaagcccctcagccgccgtcgtccgctcgtgtcaggcctatctggatgattggctttgtggaacagctggagcacctacattcatagctggacacaacactggtgccgaggcgctacctatgccacccgtctacaagagtgcaagaacgctacagctcacagacaaccttgtggcactcatggagcatccgactggagacattgtacacgagggggcacccgtgcactcgccagtgcccggcgcaaggtgtccctgctcacgggacctccatatcacgccaacattcgttaacgctacattgacctacttatccatcactggcaggaagtccctcacccttgctctgttgacctacctggcacgaggacctgaagcagtaccgtggatgactgtgggaacatcatcaacatgcactaacgtgaaactgttccctgttccagctgcctccggtggcctgcgcctactgccaccggctggcaaggctgctacaccgatgtaccctcaagcccccagaatctgctctatccaggcccaggggcagagctcaaagctggctgactttggcctgtcccgagtcacgtatcccactgggacatgctccatgggg

SEQ ID NO: 505973 - DNA, 299 bp, Homo sapiens
tagcttgtagttaatgccggtaagaatacattgactacatactctcccttactactttttattagcattcatatacaatcttatttcaaatcaaggttacagcttcatgtcatttgtagagtcagataatcctagaaaggcttgtaagaaagaagtgccaacatccttcccctaatcatgtttcctcccctgcagagtatctacttcagccttagtagatttccttgatctttgcctccaactctaaagagcatatttgcttgacgtctgtatttgcgtcccctacccctgtgtcatgt

SEQ ID NO: 505974 - DNA, 468 bp, Homo sapiens
  misc_feature (28)..(28): n is a, c, g, or t
  misc_feature (70)..(70): n is a, c, g, or t
  misc_feature (150)..(150): n is a, c, g, or t
  misc_feature (174)..(174): n is a, c, g, or t
  misc_feature (181)..(181): n is a, c, g, or t
  misc_feature (244)..(244): n is a, c, g, or t
aagctctacctgctgggagatggagccncctgaagtgtctagtccctagttcctgccgggaaatggaacngccatcttgaactgtctatcctagttcctgccgggaagatggagccgccatctgaacgtgtctagtcctagttcctgccngaagatggagccgccatcttgaantgtctantcgttagttcctcccggaagatggagcgcccatcttgaacgtgtctagtccctaggtcctccngacattcaccctacaagctcccagctggcttgtgtatgtctgcagctcgacttgacaggctgttcattgttagaaaatgacttggggctgcttttcgttaaggagaaaagctgccgggcgcagtggctcacacctgtcatcccagcacttttggaggctgaggcgggtggatcattaggtcaggggttcgagacgagcctgaccagtgaaaccgcgtctctact

SEQ ID NO: 505975 - DNA, 247 bp, Homo sapiens
  misc_feature (175)..(175): n is a, c, g, or t
  misc_feature (236)..(236): n is a, c, g, or t
  misc_feature (243)..(243): n is a, c, g, or t
tttaatattaaaaatactgatttttaatattgaaaataaaaggcatttaatatgctcttaaagggcatccacatgctgctttatccctagtcggaagagtgagggggcttcacacgtgtcactcacactgtggtagtagagttggatttcccagtacccctgtagggtcacctgntcagggttcatccccattggtgtctgcttgaggctactggggactgtggtcacttgacgtngcttgancaag

SEQ ID NO: 505976 - DNA, 291 bp, Homo sapiens
  misc_feature (30)..(30): n is a, c, g, or t
  misc_feature (74)..(74): n is a, c, g, or t
  misc_feature (107)..(107): n is a, c, g, or t
ctgcagacagtctggcaaggacagcgcgtnacgacacagctctcgctggccacttaaatcttccagtgtctctntctttataaacaaccctctggtgacctcctttntgctattttttttccttctttgggtaaattctcagcagggggattttggagtgagagtataatcttttttggaactttcaagggacctggctggcttgtcctctctgcgtggcaaacacatatgcccaggttagcccggcagccaccctggtctacccagggagcccctccgtgggctttcagg

SEQ ID NO: 505977 - DNA, 449 bp, Homo sapiens
tgcactcatagcacccacagggctaatcatactggccttacaaccttatacctcttcatttggtctcctcacttacctgcagaaacccagtttattttggtcctcccttaaccacaccagccttgtaactgtaacgaatgaccctcaatctcactggaatctgaatcactcaggaatccaagcaaactggatgtcttaaccactgtacagctttcttatggaatgacagcacacttgtaaagatacacacaccagttggcaggaagaaaggaagagaatggacacatcggctactggaaaatactagttacacaatatgtttggttggtctagctctctgaaataacactttatcctataaacatttctgcaagaactcagccattaggactgttaagttctcaattctaagaggcacataaaatgtctaaggaggatattatttgccc

SEQ ID NO: 505978 - DNA, 233 bp, Homo sapiens
ctctagagtatccccgcacagcttctatgtggggtaaggcgaggttagcgaggcttgctagaagtcatcacgaacgctattagctgggagtacagtttgaacgtccttgtacgagaggattatcgatgcgaactgtgagttgcgttcgctacttcgcagtttgctacggcagaactagtatttgagcgatgtaatgtccgtgggcgacttattcacaactgactgggtaccga

SEQ ID NO: 505979 - DNA, 234 bp, Homo sapiens
ggggaaaaagaaaaaaaaggggggggggggggggggggttttttttttttaccccccgtagggggggggggggggtttttttttgaccccccaaaaagagggggggggggtttttttttgaccccctaaataaaaagggggggggggggggggtttttttttgacccccctttcagggcccggggctgatttttttgggtttgaaataaaagaggcggggccttctttttttta

SEQ ID NO: 505980 - DNA, 1302 bp, Homo sapiens
ggctgaatcgcctgagcccggaacccgggcgcggtcacggcggtgcctgcccatcctggtgccgggtcactgaactgcttcgtgccatgcagctagcacactcgctgctctggtcgctctcgcgtgcgcgcagcatgctcctgcctctctcgttatgtcctgttcggctgtcctggaatcccgccgtgtcgcctaggtcccttggagtctcgcgcttgccaggccactcgagtacttgttggtctgctccacgtaggcggacctgagccatcctgtggtcgatgctcgttgcctgccggttggacgcgagctgagggcacgtctgtgtagtgctggccacgtcctagagggacggagagtcaatccgtcgcgtctctgtcctgtgctgctctcggtggctccgtgtcctgtacagctctgttccggatgcgttttgcctgggggcccggcccgaggcgtgatccggcgtgatcgggttctggggctgatgagcctgcggggtcttgggtatgcatgcatgtgtacgtggtgtcaagatcagagtcccaaggaaccgttgcagctgatcagcagtcgttgcttcgtcgcttgcaacccatgctagcgggccaactcgggcggcccccttcgcatcacgccgaaagctttaacggcacacggacgcccggcctgtgaactttgcacgatttgcgaattgaagcacgcaaggggcaaatcacgggatagcccttcatccaggaaacccatgagagtggttgaatggtcggtgcccccccttaaacgactcaaacgcgaagaggtgcctccaggccccgttgggccttgtccaaccattccagctagtaaggggggcttcccatagaactaccccccaattagagacttcccgtatccagttgcgcattcgttttttgttgcttggttcttcccggccgatccaagcacccagagttggcccttcaaacccgttcagattttcccagaagcgcggggaaaccaaccagcccgggcccttggagagggtcggggtccccaaggtacagtggagcccatggttccccccccagattgggcaaagccccccttgagaatcctttgaaggtgaaggcccaggaactcgagattggacaggggggggggcccagggtcccattggcgcctttcaacacaaaagaattcggccaaaagccaatgggtgtctcaacttgcgcatcttatccccaggggagaggggaaatttagggcaaaaccaggttcccgggccccttcttttcggggttgtcttcctttaattgagagccc

SEQ ID NO: 505981 - DNA, 223 bp, Homo sapiens
atacacgggagggggcagaggactgctcggatcgcttcgtcaaacactgtatagagagcctcgctgtgtgagcgccgagcactccaggtattatacagcaccaatctccttagccatggactagaccctgcggactaggtgatgagagagtcagcattcttctccttacagtttcatcgcatcgtgtctattatcatacccataagactcaacgtttacgttc

SEQ ID NO: 505982 - DNA, 1018 bp, Homo sapiens
gtccttacacgaagatcatttagctcagtctaaagtataggtcgatagacctagaaaacaggagcctaatagatcatagtatcgcagtcagggactacatgatcatttatcatctactgatatctcatagtcacatggtactgacacctcctatcaccttctgcataatgaatttaaataaataataaactattgtcaaggagagccaagagctaagaaacccgcgatagaacataattcgatgctacgctaatgaatcacgtatatcaccatgcagtcagacccgctcataatgcttagcacaatatcagttgaggatagatatgaatagagggtatccaaggcagacaatcctattcgaatcatgagtgaatagggtgcattcgtcctgaggatagaatcttagaagctaaactctgaaattttggccgcgacatgaaatcctcttcctaatacttctcacccttggtatacactccctcaatctagtttcacgttccaaaaacgaggagacacgtgtctattggcaattagcatagtgagaaaacaatccgtatggtaggaagatgagttaaaagaatttcacaaccatagtaggacctaaaaatcagacaacaatttaggaaagcgtacaaaagctcacaccacatcactgactctaaaaaaaatgcaccaaacatactaagatgatctacctcaaaaccaattggaccgatctatcaaccctataggatgaactaggtgctttgctcctgacacatctgtggagcaaaccacagctttcatgccccggtcggcgctagaattagattaccctagaagagcgtcgaaaatagggcacgcatttaccctatagacacccggtctaccccctgttagaggcaaaaaaaaagaggagaggggccggagaaacaacgcctggcacgggcaacacgggacggggggcctctgagaaagaacccaacacaccgacggggagaacacaaaccgggcatacaaggggttcaaggcgggacaa

SEQ ID NO: 505983 - DNA, 241 bp, Homo sapiens
  misc_feature (13)..(13): n is a, c, g, or t
  misc_feature (60)..(60): n is a, c, g, or t
  misc_feature (159)..(159): n is a, c, g, or t
  misc_feature (168)..(168): n is a, c, g, or t
  misc_feature (197)..(197): n is a, c, g, or t
  misc_feature (235)..(235): n is a, c, g, or t
tggcagaaaatcnaaaagggcttaagaagtaacatgttcttatgtgactggaccctgganactgttggccttgtttgtaagcatcccgagtcataaaaatgacctgaaaatggccaatcataaaatcacagcgatttctttgttactcaggaagttatnttgaggtantaagttttaattcatccatcagaatgaanttcaactgtaagttagtttttattactcctacctcccngaaatc

SEQ ID NO: 505984 - DNA, 289 bp, Homo sapiens
tctcatctctacagctgctggggcctacctcccatgccgagaccagcaggggaaacgctccaggacgcattgcaggctctgttctgcgcggctgctggattgctctcctggtggctcttcagcggacagcttcctcacccacccggcactctgctttgctctgtctcctgaggtggtgctgagcaacctccccttctctgcctcagtccctgggctccagggttcagctccacagtcctctgcctagcacgctggttttccctgtccagccccagctgcggggggatcc

SEQ ID NO: 505985 - DNA, 219 bp, Homo sapiens
atgacctcataacgatctcaaaccaactgtgggggtcctcgctcaacctcttcttccctaggtcacagcactatcatctgattgcgttagggatcggtctgattggcaggaaaataatcagctcccaatggagctcaacgtaactaagtagggtccccaagaaataaaacgggagctatttcacagagctgaggttctgccaaatttcattcctcaaac

SEQ ID NO: 505986 - DNA, 373 bp, Homo sapiens
cccccccccccccccaaaaaaaaaaggaaaaaggaaaaccgttctcttgcttttaacgggaaatggctgccaataagagtaatatttctatccccctttttcaaaaaaaatttggacacaaacttccccggccacctgggggaagagtgaaaaaaaccccgttccctgtgcgcttgtgcccagccgggtgccccgcccccagtgccatccagaagaaactcccctggcggaaagtccagcctcgtcttgggttagctctgactgtcctgaacgctgtcgttctgtctgtttcccccatgcttgtgaactgcacaacttgagcctgactgtacatctcttggatttgtttcattaaaaagaagcactttatgta

SEQ ID NO: 505987 - DNA, 609 bp, Homo sapiens
tctcttacatatcttgtagtagggggctccggaaaccaggcgctgcgtgaagtggctgcggggccctctatatttccctcagccacaattccccataaccctgtgtgttcagtggacctgtgcagggcgggtgctgccgcgcgaagactctatacccagttcgagttttaaaaaccgtggctgtgaaggtggtatgtgtcttagagggagtttacaagagaacccccagccgtggctcacgaggagagccccccccgaggccgtggatatataagagtctctctatatacagcgtgagttatgtgccgagagactatgtgtgtgtgtttactacaagagcgtggagcacaatatatcagtaatctccccgccatgatgttgagacacaagccgatgtaaagatggagcgactatactacctctcctccgagaagaagtggagaagaagagctgtggtgcaaagaagtagttgtggagtattcctcagaaaaaaactactccgcggtgtggaccaaaagtacccaaatatctataaactatgctgtgatgtttccacacaaaaccaccgtagttgggcacacacaacccctttttaaaaagttctcccaa

SEQ ID NO: 505988 - DNA, 186 bp, Homo sapiens
tctagagttatccccagtaaatctggatatcggagttgtcccgtgagcagaagcagcagcagcagcagcagccctcgccgtacgcggaggcgcagcgcagagccggccatggtcgttgtcgatgccgctgacatgggctagaaggaggaggacaaatgagcccctacatcgaggctcttcgtacac

SEQ ID NO: 505989 - DNA, 563 bp, Homo sapiens
  misc_feature (3)..(3): n is a, c, g, or t
  misc_feature (25)..(25): n is a, c, g, or t
  misc_feature (94)..(94): n is a, c, g, or t
  misc_feature (186)..(186): n is a, c, g, or t
  misc_feature (259)..(259): n is a, c, g, or t
  misc_feature (262)..(262): n is a, c, g, or t
agnagctctgactaggctttggaangggaactttgcactgtcctctttctgaagcgttgctttgtgggagtcctgtcacggggagcagtcatgnaaagaggaccggcccctcttcccaggtacaagcacagctcctgtgcactccgactcgctgttcccctcatctggcctccccagagcccaagnactgcctgctaaccccagaccttctgtggtccacttaggactcttgcccacccattggtccttccggccggcnccnccaggctgggctttctcagggggactccagctgcccttctgccccatgaggagacactagctcccttggcctcattcccttactggcaactgagggtctggttcttagagtcccttatgtgtaaacatgtaaagcttgtggctgtgaggtgtgtttggtaagaacagtccacagctttcaccagattctcaggagtgtcagtggccccttcccggtcaataagttgaagagccggggtcagtctggctgccactgagggccaggctgcctccttgtgtgcttgggtggcctgactgcaagg

SEQ ID NO: 505990 - DNA, 264 bp, Homo sapiens
agaccccccggtctattattgttacacaccaccctcacccttgcctttttaaaggggctcgggacttggctggagctttatttcattaatgcaaagacaaatattagttatgcctttaaatacaccctacaagggctaaggacaatgctccagcactaacaataacaatgcattccttttcattccctgcagagctccaaaggtgacttgattaacgtggatgagatcacaatgctctttgccaccataacttcacttttggag

SEQ ID NO: 505991 - DNA, 198 bp, Homo sapiens
cttatggcgactgcaggaggatgtgtatgttattttgtgtctgtgtctttctgtgtgtgtctgtgtatgtaatggtgtgtctctgtggcagggaggggctgtgtgtgtctttctgtgtatgtgtgtgtaacggtgtgtctctatggccgggagggggtatctgtgattgtgtgtctgtgtgtgtctgtgatatgtaat

SEQ ID NO: 505992 - DNA, 358 bp, Homo sapiens
ccactgcactccagcctgagccacagagggagactgtctccaaagaaaaaaaataaaaacctggaaattttattgaaaaatgaaaccttcaaaatgtgccttgactacttctttagctcctcttccttagtgccttaggtctaaatcaaatgttacgctcaaccagtcctggtgcatgcgcctgtaatcccatctactggggaggctgaggcaggaggatcatttgagctcgggagttggaggttgcagtgaactgagactgcccacggcactccagcctgggcgacagagcaagactctgtctcaataaataaataattaattaaaataaaaaacagcttaaagagaaaaaaaaaaa

SEQ ID NO: 505993 - DNA, 906 bp, Homo sapiens
ataatcatggaggaaggtgaaaggcacgtctcacacagcagcaggcaagagaagagagcttgtgtaggaaaactcccgtttttaaaaccatcagatcttgtgatggcctatcatacacctaatcatcactatcatgagaacagcgtaggaaagaccctgaccctccaatggctctcaactcaccgtgtccacaacggattgctcccatgtgaatgtggtgggaaattgatgggaacttacaaagttcatgggtgaagttggtgctgggcgatacaagtctaaccatatcatattactatagtatgctttgcttgaatttactgttataattagtgtaggcaaactttggtgtttcttcgtgatatctttgagaaatatgaacttagatgttgggaaatattacctagtatatctgtataatttgtttaatatgttttaaaattattgtaattagtgtatcaattatttcaggctcaatatatcttatagataagttgatatgtagcatcagttgggtatttgcacttaataagcattaggtagaattggatatcactggctgagtgactgtgatcgtttaaaggcgtataatgggttagttgccgagtttaactgttagaaggtggttaacgagttaagagtcccattatgccagatttggaaattatgggatcacggattaggtgtgcacctcattcacttaattgtcctcacaggatacccaggttcacggtggacaagctgataatcaccttacattggaattcgggtgaggcgtaggattcttccacacatccatttagccgtttgtcctaaacaacaagcctgaggagaagaaagtcaatagggagagagaaggggcaaacgaaactgatcgggggacatagaaaacgggcagaagaaggg

SEQ ID NO: 505994 - DNA, 110 bp, Homo sapiens
tacgattacggtctcgcaaggtgtaaacaacggatatttcaggtcttgggcagaaacaaaagaagaccctgaaggcagccccctgagtgggtgcacagaggggtgtgtat

SEQ ID NO: 505995 - DNA, 470 bp, Homo sapiens
atcatctcgcatcggtaatccctagccgtcaatatatccagacgaacacatgagtcatccaatatagcacatacaccacaagaactagtgcataccacaatatattaagtgaaaagatgctcaacctcaataatagttttataacaaggtaccaacatgcacacttccacacacagtaaaaatgagttacccatttacggactaccagatttgaaaaaaaaaaaagacgacccgatgatatcaagttatggcaagagtagtaggcaaatgccttcatatactagtagtaaagaatgtaaactggggaccagatgtggtgactcatgcctgtaatcccagcaatatgggaggctgagagcgggcggatgacgagatcaggagatcacgaccatcttggccaacatggtgaaaccccaactctaataaagatacaaaaaaattagctgggcatgtaggaacatgcttaggct

SEQ ID NO: 505996 - DNA, 134 bp, Homo sapiens
cacgagggttatcaatgtttcgaacaagttgagaaatagagttgagctcactcggttcctgttgagtcaaaaataataactacatgaaaacatgattccatgttgattgaatgttgtacgaattactgggttac

SEQ ID NO: 505997 - DNA, 193 bp, Homo sapiens
  misc_feature (82)..(82): n is a, c, g, or t
ggggggtttttttccccccgcccccttaaaaaaattttttttttttgggggggggtgtggggggggccccctgtgtgtgggnacaaaaagggggccccttttttttttgttttggggggggccgtgggggggggggggggggtttttccccccccccttttttttttttttttttttttttttttgcccccca

SEQ ID NO: 505998 - DNA, 227 bp, Homo sapiens
aaaaatttttgccccccccggggggggggggggccttttttttccccccccccccccggggtgggggggggaattttttttgcccccgggtttttggtttttgggggcctagcggggcccttttataacccccccccctttttttgggggggatttttggccccccccccttcccaaaaaaaaaaattttccttttttttttgggcccccggattttttatttttta

SEQ ID NO: 505999 - DNA, 208 bp, Homo sapiens
gcgccaggtggatgagtggcacatcatggtcactgcagctcctggatcaagccatccccttaccacctatgcctccccggcagtaggaccacagacacgcagcagcacatccagctaatttttttaatttttttatttttggtagagaccagagtttcagtatgtagcctaagctggccttgaactcctgagctcaaaggatccacac

SEQ ID NO: 506000 - DNA, 100 bp, Homo sapiens
gctctgaggatccccgcatttcctaattaccatactaatcttagttacctgctaacaacctattccaactgttcatcggctgatgtggagcaagactgcg

SEQ ID NO: 506001 - DNA, 907 bp, Homo sapiens
  misc_feature (610)..(610): n is a, c, g, or t
  misc_feature (685)..(685): n is a, c, g, or t
acatggcagaaccccgtctctactaaaaatacaaaaaattagctaggcatggtggcaggagcctgtaatctcagctatttgggaggctgaggcaggagaatcacttgaacccgggaggctgaggttgcagtgagctgagatcgccccattgcactctagcctgggcaacaagagcgaaactccctctcaagaaaaaaaaaaaccatcctggccgacatggtgaaaccccgtctctactaagaatacaaaaattagctgggcgtggtggcaggctcgggaggttgaggcaggagaatcacttgggcccgggaggcggaggttgcagtgagccgagattgtgccactgcactccagccttgagacagagggagactccatctcagaaaaaaaaaaaaaaaggggtcaatcttagaatgcaaagttaggtaagcaatacagtttgagaaaggtgtatttaaaaataacttttctatgtagtcatggtgatattatggttttcaacctggtccacagtgggatttaagttatgggatatagtaggtatgggtactatgctgggaatttagaaaatccttagcaaatgctatgtgtctctttcgtctgtaaattnggtgggctgtggtgggtaacacctgttatttcttagcaagtggggaaagccgagacaaaggctttgctttgggcncccgagttggcacatcaaagtggcgcaccatagttgaaatcctgtctctaacctccagctggtccgtggtgggtttgctctgtgtcccgactactcagaaggtggggcgaatggtccactgaggcgacaattgaactgctggctgtcatgcctgtttcactggaagacatctgtccaaaaaaggggcggcaaatactcgggcttcgacccttgtaaggccaa

SEQ ID NO: 506002 - DNA, 266 bp, Homo sapiens
tgctcgtgcttgaccttaattccagcacttctgacttttgcccacggcttcaggaacggtcgctccgtgaagggtcactcatgtagatgatgccaacaaagcacatcattatctgatagggaacacttcaaatcgtcacgtcgtcaaactggaacccttcaggacactgttcatctggcagatagaggtgtcagaaacctaggactcgttctccgaggcgcgccagttccaaataggcgttatgaaaggcgtctcccagtctccgt

SEQ ID NO: 506003 - DNA, 81 bp, Homo sapiens
cttccttaagaggtgtttcctgaacctaattctcataattaaagtaatgtttttgcaggatcaaaatgaaacaaattttcc

SEQ ID NO: 506004 - DNA, 101 bp, Homo sapiens
acaggatcccccggaggcgttgtatggccggggttggtgtaaaactaggtcagttagtgtgtgaatagctggttagtgtgtgaactgggtcatgttgctgt

SEQ ID NO: 506005 - DNA, 405 bp, Homo sapiens
actaaataaaaagtatatattcacagtaaaaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactattgtccccggttcggccaaagtctttttaaccccgaaaattttttttttgggggccttatttaggtttttttgggcaaattcccctttggggggctcttttaaaaatttttggcggcgtttttaaacagttccagcaggggaaaacccgggggttcccccttttttagccttttggaagaaatcccctttcacaccggtggggttaaagggaaaggccccgcaacggtccggttttt

SEQ ID NO: 506006 - DNA, 337 bp, Homo sapiens
aggatcccccgacaattatcgttggtggccgcagaatctccaatctgtataagcagagcttgcttgtgttaattgtcgtgagggatatatcactacgttgctgggtgcgtcagccttccagtcctctctacgcacgtgcgatatgcattatattttcggtggtggccatcagtcaagcggctactggcggaacggaagagaccatcatagtttcgtctccgacacctctcactgactcatgccccgtcacagcgtacttcaattttagttcggggtttgtcgaacttcaaacgattacgcatcttttcgctgtctggcctcttcctacgctctctct

SEQ ID NO: 506007 - DNA, 249 bp, Homo sapiens
gggattttgaatagtgctgcaatgaacatgggagtgtagacatctctttgacatactgttttcgaatcttttgggtaaatacctagaagtgggattgctgggtatttatttattagtttaaaaaaaaaatcctaggctgggcgtggtggctcatacctgtaatcccagcactttgggaagccaaggcaagtggattgtctgagttcaggagtttgagaccagcctgggcaatgtggcaaaacctcctct

SEQ ID NO: 506008 - DNA, 699 bp, Homo sapiens
  misc_feature (204)..(204): n is a, c, g, or t
  misc_feature (264)..(264): n is a, c, g, or t
  misc_feature (276)..(276): n is a, c, g, or t
  misc_feature (278)..(278): n is a, c, g, or t
aaatgaaaacattataatttatgaacttacttaagagtttcatttattcaagtaagctttgctgaaccagtgtgtcttgaggaaatctgttaatccataataaaatatagcagcccttgaggaattagtgaaattatatctaaagcatgaataataaagccaagaagccttttgttttatttatgctattcccctgctttcagncttttctgttttgaaagcgtacagctaagttgagattcccaacttttaatgtccatgatnccttatttaggncngcatattattactttgactgtaaactgaaattactggatgaggaataatttgtcatgttgtcattacttaaggagaagatagtatttaaatattgactttttcatacaggaacatgtgttctcattctctaggcatgtgactactcccccccacttcctcccttttttcttttctttttttctcttatcacatggaacttttgggctcaggagtgattctgtctcatgcagcttagggatctgaaatttacataaggactttaatagaagcttatgacacatgatatgaccaggcttttcactatgttttgccatttatttggcttaaaatcaatggaacaaactgaacttggcattactatttctgttcaaaaagaagaacaatatatattttactgttttatgtttggtcttggcactg

SEQ ID NO: 506009 - DNA, 538 bp, Homo sapiens
tcagtactgtttaagtagccttggctggggtccgatctcctcatgaggtggatatgtcccagggctgggtcttgcgatatctctatctacattctttcctaggatgagggatccagtcctttgaactgaaatatgatttatacaaagtgggtaattctcaactttctctctctggctctctctctccctcagattccaaactctttggtacaattacctgcccggatgtcagatgggtctatccaacataataaatctaaaatagagctctgaattgtgctgtgccgaacccctcaagctctactctacaaactggctatgctccagtttaccccatctggactcatgatcccgattaccaatcccaattattcagataaacaccagggtctcctccatggtatctgtcccttaatccttttattcaatcatcggcaaggcagttgatcggatcagtcccaaatttcatcacttcagctatcttcagtgctacgagcctaagctacgacatctccttagatgggtgtagtatttcata

SEQ ID NO: 506010 - DNA, 1120 bp, Homo sapiens
aggcagaaagtggtccgatgtcccttttattcagatgtgttactccattgcactccttcttttaccttgctattatattgtctattcctccattgctggatggtctcctcttgtagtcgatcttgtatgtcagcatcttcttggggtgtatcccaagtcgtgtggccggaattctgtcctgccatgactctctgtggtcttttccttcactgtctccccttgtttgcatcatttcctgtgttcgcatcaaagtgtcatcttccttctggctttgattgtctctacttagactccataatttagcacgcctttgtaatttcaatggtgcaacaggtatgaccatgtggaaccgaattatccctcaagtaccggtcataactcttgttggaatataaagtcctttctatcacaggttctcatgtgtcggatccattagattcattttacatccgctagctactaccaggtatacctggcttgatttcacagttgcagaattcacatgaattttacctggggataatgtccaagaattccacaagctactcatttaggtgcaaaacatacagtatcgaccatgtctcatgatatgtcgataatcaaaaaatctggcttgtcttatctcgccaaagaactgtatgtagtgatcactttagatagccgatattatagcatccatctgtggtggttaattatttcatatagggaagagttctgatctgtacctatggttcgtttacttgagaaacaacatttcggactgtgcatcttctgtgatgttctatgaatacactttctactttatatttgaaacatgtatgccagacctcggaaatactgtatacacttgtattacattctctaaagatgtataacagaactgcgtctagtattgagacagcagagtcatcttcccgaagattctaagagcagcagcagtatgttgttgcttgtataacagcctagcgataattttttagactgactctccatggtgccctgttggcactagcactaccattgtacctgctgtagaataaactatcttagacatttatcaacttgttgatacaaatgttagtccctaaccacttttttttacatcttttaaatgtatctt

SEQ ID NO: 506011 - DNA, 312 bp, Homo sapiens
actggcatagaatataatctgtctaacatgtatctgcacaaaatttgatatgtggttatctcatcgttaagcattctcatttcctgtgatgcgtcttgatccatgagtattaaaagtgaatatttcatttccaaatatctagagatttccagatatctttctaatattaatcgtcatattcactcagcctccattcagttgtagttagatagcatactctgaattattttaatcactttaaatctatttaaactcattttatggttcagcatatgatcattttggtgaatgtttcctgtgaaaatgaaaata

SEQ ID NO: 506012 - DNA, 601 bp, Homo sapiens
aattagcaaaggcaaaaaagcaacatggggtgaagtcagggaaactaagtgcaatgcttccaagaatcctctgcgagtggaatcacagaggatgagcttaattctcccagcaaccagttgtaacagcacttgtgaaacactgtcaatcagaaaagcttgttagagactgagtgcctggggtttttactgggagctggtcacaaaggtcagtctctgcctggcacataccaaaattccagactcctagaaggaaagcaggtgttcagtcgaaactatattgttttacagtttagctatagtaagctcactttgatcagttctgggaatggtggaagccccctgaactccaagttcccagatgccaatcaagggccaaccttgtcccgcaggtctctaaggttcagtagtcaggtcgggttcattaccacttttttctgcacagcaattatatctcaaccgttatttcttcaatgccccataaatactcagtttcttgaatcgtactttgaaccaggtttactatctggtggttcctcattaatgagtcgcaatacgtcttcgacacatggcatctcataccatgtattatatgagtcatgtg

SEQ ID NO: 506013 - DNA, 1421 bp, Homo sapiens
ggtagccgccgaacaacgtggagtccagcgtcgcttcgatgaacagtgagtggtcggagatagaagccattactgttctgcctttaaggatcgaacatagcgcaggagccccagggctccacatgtagactgtcattagatccagccaactaagaggaatatgtagatcgagtggatccttgacgacttctcacaatcgcaacgaggcatcatgggctatcgcggtgtaccttgcttggcatgcaagcctcacatctactttgcatcgctcatcggttgccagtgttggtgctccgaccatcacttcctgttagcggtacaagcacttgagctgcattgcccacgtccaattccctaggagactagtgggcaacggtccactagctgactcgagggcccaaaggatacgcattgggataggcccaaggacaagggagatactccacgtatctagcgagcatcctcttgaatacggctatgtataagaagtctcatggtacaagagccgagaacgaagagatagtagcacggaaccctaggatactatgttgacccacatcacaggtggtagcatgggcctttctcccagggagtcccagccctcatggcatgataaatggaccctgccttctcttaccaaaaggatcaccaactggtgcctaagctgatcgagagtgactgtgtcctggctgttgtctctgtctctggcatggggtcctctgtcccgactctgacagtgaaagggcatgccatggacaggtgctcctggacaaggcaaagagaaaacgatgtcttaccccgcactggtttcaggtgtgctatgggggtggaacctcccccgggggcccccaggcaaaattcgctgttggcctggccctccgagtgacctgggcccctccaagggaacgccttgtacaaagagggccatgacagaacgcaataggtggtcgccaaaaagccaagccttctaggtagacgtggggtacccagaagagtgggctgtacaccagaggcactgagcaaggagacacccacgtggtttgtgccaccaaatagccggcgaattcgttgcgatcgtaaggcaaagcgggcacccatcatccggtattcgcgggcacactttccaattaaacccacacaaggttaaaataaagaaggccgtgtcccgtcagatgaaggagggctttcgagtttagcacaaaccccacttggaaggccagaaggaacccctctcgcgggggcccttttttgtttgcccggcggaatggctccaacagaccacaggggaggctcccagttagagaaaggggaggtattggcgcggcacaacgaaaaccggtataactccaagagacccccccagcccttttccccttggacccaagagaccgggagacacactaccggcccggacttccaca

SEQ ID NO: 506014 - DNA, 113 bp, Homo sapiens
ggaaggatgagcaacggagagaaagagaagtgtccaggaggagagatcctcgacggcggcgttcgcggaagtccgccggaagattacacggtttacgcaagattggcacttag

SEQ ID NO: 506015 - DNA, 406 bp, Homo sapiens
gtgatcctcccatctcagccttcatttggcaagacgtcttatattcacggatcactggtatatcttcttaacatacatttaaggtgttataatgctactccaaaccatgtccatctcctttccaaaaaatacttcaacttgaaaagctcccacttaccttaacatactgtactgataaccatatattgccacatccatatatctgataaaaccccgaattgacgtgtttctgttcacctctccaagctgacaggtcacatccaacgctgctgtacttgcaggcccatctgtatcgccaaattctacccagtttatttccgaggctcttcgtccgtcaaaagcacgccataagcttttagctatacctcatgaacacttaacctcatccacctccttgatggggatc

SEQ ID NO: 506016 - DNA, 347 bp, Homo sapiens
ggaccaatcgacagaccgccggtgctgggcctcgcgccggctcggcgagctctcccgacacccgagccggggaggaatagcagcgactcctcgctcgcatacacgatagccgcactccagactggaccggtagtgaggggctcacgagcagatcccgaggcaggctttgctgaacctccgacgagggctgggcctttggaaggcgccttcaacagccggaccagacaggccaacatgaccgagaatttcacgttcgaccctgcggacaagcccaagcgggccaaggcctccaagaagtgcacagacgcaccccgcattcagacatgatcgtggctgtcatcccgccg

SEQ ID NO: 506017 - DNA, 123 bp, Homo sapiens
ccgtaggcttaagctcagtctggtgcctccaagaaggctttcctatttcagcccgcttctccttcctgtattgttatttttctgtcactacctccccgggtcgggagttggataatgtgatag

SEQ ID NO: 506018 - DNA, 265 bp, Homo sapiens
gactagaggatccgcggcggagtgcatggctgggcgcgggggctcaagctgtaatcccagcgctttgggaggcgaggcgggtggatcacctgaggtcaggagttcgaaaccagcctgggcaacatggtgaaaccctgtctctactaaaattacaaaaattagccgggcatggtggcaggtgcctgtaatcccagctacttgggaggctgaggcaggagaatcgcttgagcccgggaggcaaatggtacactgatctgagatcgag

SEQ ID NO: 506019 - DNA, 607 bp, Homo sapiens
gggcttgaagagcaggcatctgagagcagcccagacaccacagccatggacactggcaccaaggaagctggaaaggatggccgggagaataccacactcctgcacagccctgggaccttgcatgccgcagccaagaccttctctccccgggtccgaagagccacaacctcaaggacagagaggatatggcctggaggagtcatcccctacgtcattggagggaacttcactgggagccagagggccatttttaagcaggccatgagacactgggagaagcacacctgtgtgaccttcataaaaaggacggatgaggaaagctttattgtattcaatttacagaaccctgtggggaaagtaaacgaaagccgggccacctttgcagaatacagtcggatggctcatgattgttgaatttctttctgtatacctagatatttcccaagaagctgtttattaaagggagccagggattgctagaaacattctggccttggggatattacaacccagtgggcatgctgatgggcatagaggaaatttccgggaaccccatgaaacccgtgggtctggcactagataacaacataaggaccggtggtggttc

SEQ ID NO: 506020 - DNA, 392 bp, Homo sapiens
cgtgtgcgatttccctcctcccccgcccttatattcacggccaccatggcgtattaggggcagcagtgcctgcggaagaattggcctttgcagcggcggcagcagcaccaggctctggagcgggaaaccccaagcggcttaaagcatggggctttttacgggattcaagaagcaggcgttgctgtaaccgacaaagacaccttttgaattaagcacaattccttgattccaggcaaagaccggaacatgaccgaaatgagcttcctgagcagcgaggtgttgggtgggggacttggatgtcccccttcgaaccgtcgggtttggggggctggaagaaaagcctaggtctcttagaaggataacctgggggggggcaaagcacttcaaaacct

SEQ ID NO: 506021 - DNA, 196 bp, Homo sapiens
tgttcatatgggttatcccgcgcctgccggcgttgggtatggcgctcgctgtgcctgtctgtgttgcgcgcgtgctgccccggacatcttagggcatctctgacctgttattgctcaatctcgggtggctgtacgcctcttgtccctctaagatgttgggggacgccgaccgctcgggggtcgcgttacttgtttg

SEQ ID NO: 506022 - DNA, 896 bp, Homo sapiens
  misc_feature (1)..(1): n is a, c, g, or t
ncctttcctcttgcgactccaccacgtcctcttgtagagatgtctgtttttttgtctgtgtggtagagggatgctcccctcccttccgccgtgggccccccgtcttgtgctgttggtgacatactcctcccgcgcccacgtctttctcggtcctatatatttgtttgaactcgcccccctactcctctcgtctgctgtggtgtgccccacatcacagtcggtcgtggtgtgagcgtgtctctcgtcggagtcctctcttctcaccacgcaccggccgcgcgtgtgtcttctcgcagatgtccacacccctctctctgtgtggttgtttgtctcatacacacacacgccagcttttggagtaagtaactctctcgctgcgtgtgggggtctcacacccgcgctgatgtgttttctccgcccctgcgcgcgcgtggttgctagtttatgttatctctcgcctcccccccctcctcgcgcgcgggggcgggagttgtggtttctccctcactgtgattagaagagagacgctcatagtactcccactcctcgcgggggacccaccccagcgtgctgtcccccgcgcttgtagtatgagggtgttctttttcctcctcgcgagctgccaccccctgtgaggaggcgtcttgtatgtgacccccctcgaactaagagtggtggcacgaccagcctcctcctggcgggaataagtcagcacccccacttctccgcgcagctcctcgttcttttaggtagtaatagataggaccgcgggagcttttttttgttaccatcctaactcatcttccctctacaccccccccccccctcccccccctttcccaaataaagggcaaaggtttttagagggggttccccaaagagttttggggacccca

SEQ ID NO: 506023 - DNA, 308 bp, Homo sapiens
agttaaatacaggcttttttttataatatgcaattgattcacattagattttaagatgacactgtttacatgatgtcaccacaaagccgatttacatacaacctttaattgcggaaaaacaaagtttctttttgatccaaacacaccgaaaaacttctttgggtttttttttaatgatcttttccttgttcataaaaaaaagtcaaaaatgcactattttaaaagggtaaagcttgtgagtttacagaagagcaaatgacctaaacactctactcaaaaacgtccttgttttttttaaaaaaaaggta

SEQ ID NO: 506024 - DNA, 193 bp, Homo sapiens
gtgctcaacgccattaaactcttctgggccccataaacatctccattttaattcaataattgcccagaggaaagaagaaatatttgtgtaagacatgtagtttccctttagagacattttttaatccagcaaattgcaaagccaggccaggcgcggtggctgacacctgtaatcccagcacgttgagaagctt

SEQ ID NO: 506025 - DNA, 81 bp, Homo sapiens
tatctctgtgccagcagcttagtgggacaggggcggaatgagcagttcttcgggccagggacacggctcaccgtgctagag

SEQ ID NO: 506026 - DNA, 775 bp, Homo sapiens
actatcgtgacggaggttgaatagagtcttaaatggcctgcttgccccaatgagtcatatatgacaagagtacattggcctagacagaggtcctagtgatcctaactatgataggatgtacaaaaagattctgtgtaagctctaacattgtcaatagtatactagaaaagaaggatatcaatatgtgatactcaaataatagatagcatgattagaaaatgattcggtttgaggagcgaaaatacgagaagtcatgtaaggcataaggttctagtagtctgtataatgtataggagcttaagccaatgagagattcgaagagaagatattactctagtgcggaggttagttagatgagtagtgggaagaaacataagtatgatctggtactggcataaaaagaagacgagtaattacattcttagaagacttttcattggccaatcaccggtgtaaggaatctacggaattgtaggttatataccgaagtcacaagcatgagtaggtgctcgtaacttatcaagaaaaggtcgcgctaggtacaatatctcgcatataggaaagtacttgatcacttgaatctgagtagctgaacggacttctcggcatggttattcgaatgcgtcgcgcgatctctaatagctacttccattctatcattatcgctgcccccattgtttgcggaaaaacggagtcgttatgacccatcaataagcggtaccctttattttaccaccggtaccagcgaaaactaacgtcagaaagcccattattg

SEQ ID NO: 506027 - DNA, 1027 bp, Homo sapiens
tgctgcaaactggcgcgcggccgtaatgtgcatggagtagcagcctgatcacatcatcaaaggcatagtcttccaagatggttatcagacatcacttgctctgcctgtaaacatccgaggtgcccaaagacaaattgctgctgctacacaagtctgcaacggacaccttaaaccacaaggtgctaacagaccaacgacaccagatgacgaaacaaagagaatgcacgctagacacacactaatcaggcaatagcccctcatatggacaggcgaaacccttgacggactggcatgtcccactcaaaaacagcggcttattcccgagtacagacattctgcacggccgggagaaacaagcttggtcacgtttacgttaaggataattttctacaacttcttcgacttttgatagttccaaacagccaaaaggagctcaggtctccttggattgtgacactgcgatctgcgctcatggcaccagtgacaatcttcaactgtgggtcccactgtcacccagttgctaccttacctttgtcaatacacctattcgggttacctgaaatccattcccgttcgcatgacattccccgcatcacatgcctccggcagggtccacacaacttcgtcgccacgtacctttggctcgtgcatctcgtttcacagtccttagacctccactcgggacaacgacgtcgggccgaccgacgcaaacccagccgcaaaccacgacacgcaagcagacacacaagtacaataaatggccagcaggtacacaaccgaggcgcagacaaccgccttagcacacatcccaaggcttcttggacatgccattgggtcggcaaactcgaaagcgacgcacatatcgagcacgggcataccgctccgacgccaagcacaggagcgacggtgcacagttgccacatgagcatgcacggaaggaggggacaggtacagaacagtcgcgcgacccgccagagcacacggcagcggtccaccacgctaccaccacaggcgtcacacccgaaga

SEQ ID NO: 506028 - DNA, 629 bp, Homo sapiens
  misc_feature (573)..(573): n is a, c, g, or t
gcctggtgtgattccgtcctgcgcggttgttctctggagcagcgttcttttgatctcctggtccgccattctctcctacctaggtgcgtgccgccagcctgatggaagatttgatggacatggacatgagccccctgaggccccagaactatcttttcggttagtgaactataacggccgagctagaagtattgatcgactcttatacggtgggcactaagtcgagtgacaacactgacgcaccagatgatcttcaagaacggtcagtttaggggctggtgcccacggatgagtgcacattgttgcagcagaggcaatgatttacctgaaggcagtccaattactagtaacactggcaactttgtatagacatgtctgtacaggcactagacggtttgtcccttggtgggcctttgaaataacagctcaccgagtggtcttaaggttgaagtgtggttcagggccagtgcatattagtggacaggacttagtagctgtggaggaagatgcagagtcagaacgatgaagaggaggaggatgtgaaactcttaagtatatctggaaagcggtctngccctggaggtggtagcaaggttccacagagacaaagtaaacttgctgctgatgaa

SEQ ID NO: 506029 - DNA, 188 bp, Homo sapiens
  misc_feature (9)..(9): n is a, c, g, or t
cttggggcnggctcatgcctgtaatctcagcatcttgggagccgaggcgggcagataccaggtcaagagattgagaccatcctggtcaacacggcgaaaccccatctccaccaaaaatacaaaaaaaaaaaacaaagtattttttttaaccctggaaaattttttggttaacaacacaaacaaacacc

SEQ ID NO: 506030 - DNA, 539 bp, Homo sapiens
  misc_feature (520)..(520): n is a, c, g, or t
ttagaggacccccgcgcttgtttcctgcacttccatgctgttatataataggcaaaaagaggtttcctcactatgcaagggtccgccatcattaatgcctctttaataaaaactcttctcaaggccactttacttccaaaggaagctggagtcattcactgcaaaggccatcaaaaggtgtcagatcccatcgctcaaggcaacgctcatgctgataaggtagctaaagaagcagctagcattccaatttctgtccctcactgccagtttttctccttctcatcggtcacttccacctactcccccactgactaacttctacctatcaatctcttcccacacaagacaaatggttcttagaccaaggaaaattatctgcttccagcctcacaggcccattctattctgtcatcatttcataacctcttccatataggttataagccgctagcccatctcttagaacctctcgtttcctttccaccgtggaaatctatcctcaaggaaatcacttctcagngttccatctgctattctac

SEQ ID NO: 506031 - DNA, 112 bp, Homo sapiens
ggcaaccagccagaacgcctgaccgaggcacatacttcctattctcacaccctagtaggctcccttcccctcctaatcgacactaatttcacactcacaacaccatgggctc

SEQ ID NO: 506032 - DNA, 355 bp, Homo sapiens
tggttgggatgaatgaacagaaccctgtaaggaatcgtagggagtaatgcgtagggggtaactcagagtatatgtggtagaatgtaaatgggaccccagaaatatgcatcccagaccatggtttttcactttggtaccccaccgcccttagaatggagcccaaatggggctccatacagggtaggggctgcgtacagggtgtaggaggggtcctggccaaccatgggctagtgtggggtaagtgggtagaggctagatctgggctgggtcaagggtagatcctgatgccctttggccttgtggaatggggggtaagagggggaaattggtaaccctagaattgggggggggggat

SEQ ID NO: 506033 - DNA, 547 bp, Homo sapiens
  misc_feature (79)..(79): n is a, c, g, or t
  misc_feature (93)..(93): n is a, c, g, or t
  misc_feature (100)..(101): n is a, c, g, or t
  misc_feature (113)..(113): n is a, c, g, or t
  misc_feature (132)..(132): n is a, c, g, or t
  misc_feature (140)..(140): n is a, c, g, or t
  misc_feature (148)..(148): n is a, c, g, or t
  misc_feature (151)..(151): n is a, c, g, or t
  misc_feature (198)..(198): n is a, c, g, or t
cagtgatgacgtttcaacaggacttcttctggaccgaccccatgccctccgactcacgggcatgctctccacccacctnacgtccatgttcgngtacttnncaccaccgcgcnggaagggcagccagatcanccagcagnccaccaancanagatcgcaatcccgccaccaccaaccagacggagatagagcgcgtcntctgagggccggcgcttgccagtagggctcttgtgttttttttcttctgctatgtgacttgcatcgtgaagacagggcatttgagtttatatctctcatgcatatttaatttaatccccagcctgggctctgggagcagcccgctgagtggactggagtgaagcattggctgaaagaccaggagggcactggagctgtcttgtccttgctggttatctggatggttcccagagggtttccgtgaggtaggagcactcctacccccgttcatactattatactcatctccacaaaagtctgaacctcatctcatcttctatgcttcccctaatttcctaacttatctact

SEQ ID NO: 506034 - DNA, 173 bp, Homo sapiens
agcgcctcgatcatatcgcctgctcgaggagcacgactttcgcgagtataggtcgcagtgaaggccagcgacgtgttccttgccgtcgccgcttaccaggaactggcgagccaggtggattgtccgctgcatctcggaattaccgaggcgggcggtctcatcggcggcacggt

SEQ ID NO: 506035 - DNA, 175 bp, Homo sapiens
gcgcactgaagggatatggagaatgaggcatcagtggccccgacaagtagctttgttttgcttattaaatgtgtgcacactcagtacacctatcaaaacattccaagcaatcaaagtgactgccacatctccagctgagcctggctcaagtaaacagatgtcggctgccattggg

SEQ ID NO: 506036 - DNA, 131 bp, Homo sapiens
ttatgtcaccacgtactcttctccttcctgtcagttatgtcaccagtatctcttctccttcctgtcagttatgtcaccagtactcttctccttcccgtcagtgatgtcaccagtactctcctccttcctgc

SEQ ID NO: 506037 - DNA, 445 bp, Homo sapiens
  misc_feature (110)..(110): n is a, c, g, or t
acaggagagcttgtagtttctaaagccattggtgtcaagctgctaagatgtgcagtctgaaggttctgggagccggagaacagatttgtcttagagggtggcaggccgcnccgctcagtcaccaagccccctcgtgtcatggcagtcaggggtcactggggggcttccagccaggagctgcctgacgtgggctcaggagggaacccagagaagggggcccacctgcaagtccactctagggttccagcagctccaatgaaagccccctctgacctccccgcaagccccttcccctcaccagcaccccactgtcattgcagacatgacaatgtcacattgtccctaacagggtttgattctactttgagtgcctgtatcctgactgcaaatgaaaaggctcctatttcttatttatttatttttcccataaatagaaggaaacagt

SEQ ID NO: 506038 - DNA, 1420 bp, Homo sapiens
agcggtaactaccccggctgcgcacagctcggagctctcttcgcctgcatcccatcatcacatcctggcctctagccctgcagccggcagttagaagatgtgtgaaagaaaccagactatacgtacgagtgtaattgaggggtcaacacccaattgctacctcaggagcgacattgaaaaatggcttatcacgtgacaacttgtggccttgacaagtaaccatcgctgattaaggagacccacatgatgcaaggacgcagcacatgtttcaacacaggattgtcctccacagccttaccgaaatggttcgtcttcttgaattgccatatcaggccaaacgagcgggtcgcaatctcaatcattgaacgaacaggcgcagcgcaagaacctcaagaggccgacatttacacacacgcagcggttgcgcaaccccaagtggttggagccgagggttattgtggggttttcaccgccctattgggcacctattctttttgcggcatcactgcgtatctctcttgcgcggcagcgcgactggtggcacgctgcacacgggcgattgccgagcggatggcgtggcaaaagggcgaacgcacgggctaccagcacacattggtcgggtaccacttccaagggcctccctccaacggtgaaaaccccctttatgcacaacgaaccgtttcactcagtacacttggggttggccacattaacacgaaacgaaacccttgagccctttcctggcccaactacacgaacacttggtcccactgtcgcggttgaccccaaaagtttgtttgacaacgtcgttacgaacgccgtacgcgtctaacgcataacctgcgcacggcagacccttacgaacggcttgccctttggttcccccaaaataatggccctgaagggctaacctttagggacaagttcgctgaaccatttacaccgacatcttccactatcactgcaattcacgacgacacgccttggggaaacactcgggggtattccaaacgcgcgaacagttccgcacggtcccttggctaggttgaccgcttgttgcactggttcgcccacattcgtcctcattgggcgagagcgaatgccgggcaatccacagggtccccttaataacggcaacttcgccctctcgttccaccaagccttggtccaaccggtacaaagggcacacggacatacggtctccggaagatggcaaggcgaaaacactcgtacggcacagcctgcccaccctcgggacacaacagggcgctgaacaagaccctcgggccccgcagccattacccccccccccgaggcgcgcaggaaagaacccacgaacaccagcgcaaccaagagccccgcgggcacatccaacccagacggcgctacaaccacacagagacccgagcggcgatacaac

SEQ ID NO: 506039 - DNA, 233 bp, Homo sapiens
cgtgtgagcatcgcacgtcgtactatggttcagcgtttataccaggagccgttctttacatgggcatattagacaaatacattagaccatgggtcattgaactcaaccttcagcccctctcttcccagaggttggtaggtatgggtggggctgaaattcccaactgtctaattcggtcttggtatttctagtgaccaacccctcttcctgaagctacgcaggggcccatcaca

SEQ ID NO: 506040 - DNA, 582 bp, Homo sapiens
ttggaagggcctgctagctgacccggcaccaacgtctagtgcatcggctggagcggcgccataaagtgcagcactttgtggcaagatgttcaagaagaagtctcacgtgcgtaaccacctgcgcacacatcacaggggagcggcccttcccctgccctgactgctccaagcccttcaactcacctgccaacctggcccggcaccggttcacagcacactaggagagcggccctacctggtgtggggactgtggcaaggctttcacgcaaagctccacagctgaggcagcgaccgcttggtgcatgcccagcagcttccccgtaccgctgccaggaactgtggggtgcggtttcaccgtccttaccgtcgctgctcatgcaccggataccatcatcacaggtgaatacccctacaaagtgtcgcgagtgccccgcgcgtccgttcgtttggcttgcctctcagggcttggctgggagggttgcagccagcctccgtgggtccatgccggtgcgccagcctccaccgctggccatcctgtggggcgtgcttcccctccgtcactgcggctccgggagcaccgct

SEQ ID NO: 506041 - DNA, 419 bp, Homo sapiens
gggtatgtcttacaaatgcgaaattggccgtgcatatgccggcgccgttctcaacgccgtgggtgtgtccacttcgctcgttcctactctgcttggcatggtcttcacagttccgtcagctgctcagtgactacggggcaccgtccctatgctacacccaagggaactggaaacatgccaggtgccccaaagtgaaatacgcttaaactgttggatatcatagcaacatgcttggggatggaaatcaaagccacgtacgcttcaagcactattgccatgtagaggctgaagcgcgaaatccttcatgtctcataagactggttcggtagtgcttggcccaaacggaacgaaatgtcagatcctatgtgtctagtaggtcttgaagtattgccttcttaaaactagatgacaagttaccg

SEQ ID NO: 506042 - DNA, 206 bp, Homo sapiens
gatccccacgctctcctcgtgcacatccgcattctccagccgggtgctagtgtacgcgtgtgtgtgctgtgtgtgcctatgtgtgctgtgtctttgtgtgtgtgctgtgtgctagtgtgtgtgctgtgtgtgcatatgtgtgcgtgtgcgtgtgcgtatgagtgctgtgtgctcgtgtgtatactgtgtgttctttgggtaccgag

SEQ ID NO: 506043 - DNA, 986 bp, Homo sapiens
  misc_feature (152)..(152): n is a, c, g, or t
  misc_feature (172)..(172): n is a, c, g, or t
  misc_feature (193)..(193): n is a, c, g, or t
  misc_feature (279)..(279): n is a, c, g, or t
  misc_feature (298)..(299): n is a, c, g, or t
  misc_feature (349)..(349): n is a, c, g, or t
  misc_feature (403)..(403): n is a, c, g, or t
  misc_feature (509)..(509): n is a, c, g, or t
  misc_feature (545)..(545): n is a, c, g, or t
  misc_feature (553)..(553): n is a, c, g, or t
  misc_feature (592)..(592): n is a, c, g, or t
  misc_feature (604)..(604): n is a, c, g, or t
  misc_feature (612)..(612): n is a, c, g, or t
  misc_feature (649)..(649): n is a, c, g, or t
  misc_feature (659)..(659): n is a, c, g, or t
  misc_feature (689)..(689): n is a, c, g, or t
  misc_feature (704)..(704): n is a, c, g, or t
  misc_feature (757)..(757): n is a, c, g, or t
  misc_feature (783)..(783): n is a, c, g, or t
  misc_feature (787)..(787): n is a, c, g, or t
  misc_feature (809)..(809): n is a, c, g, or t
  misc_feature (889)..(889): n is a, c, g, or t
  misc_feature (911)..(911): n is a, c, g, or t
  misc_feature (947)..(947): n is a, c, g, or t
cagtgtgggggatgggggtatgccgcttggcactggtactgggagggatgagggtgaagaaggggagagggttggttagagatacagtgtgggtggtgggggtggtaggaaatgccggttgaagggaattctctggggctttggggaatttngtgcgtgggtgagccaaganaaatactaattcataatagtnagttgttagtgttggttaagttgttgcttggcagtgagaagttgcttagcccctttcccaagtgcttagccctttaagtgccaacngacaaactaacaaacaacnnttgttttgctttgctacccggtggggaagactgacgacgtgttaactganacccggtgccacagagtcacccgttttccgggacccccaggggggggtgtgtgntgccctctcacaggccggggacctgtctttccccgcttcctcctggtggcccagcccgcctgtttcagggggttgttttgtttggggtgtgggtgttatcccgtgncttcgtcacttgacagctgggcgtccggcttgcctncgcgccgntccgcctccttcgctgcccctttgccctttggtggttgntttgccctgtgntggtgtgnttttttctggcgctgggagtcttagaaaagccttgtnaatgcctatnttgtgggctttttacgtattttagggaccnctttagacgagattngatgggctcttctggttttgttcctcatttgtcacaggtgtcttgtgattganaatcatgagcgaagtgaaaaaaaaanaaanttcaaggggattttgtttgttnatcgtgcctttggaacccatctgttgtcttttctgtgtttggtcgatatttattatggcaaattttttgcctatctcgtntcttccaattgtagtctttgtnacaacccaatcaccttttgtggtccctgttaaattnatttttggtagaccgaatccctgttcctttgctcaggtt

SEQ ID NO: 506044 - DNA, 400 bp, Homo sapiens
ccgagagcacttgaatgaacttgaggggatcattcacgtgtgcgaatgacgctggctccagtgcgtaggttgtgcgtggcatagccggtcacctcccacagaatgtgtgtccggtggaatgtgttaagccatttccgggcagctcagggcaacaggccaagtgcccgaaagttcaggtgagagttcaggaccaggggctggccctggctctctcacggggtccatgcaatctcgtccacagacagtcagctcttccttcagacagtacatgggctcagcaggctcaataggactctcagtgtactgtgtgggagagagccagttcccggtgcaatgtcgtcacagttacttacggagcattaggccgcgccttatatcagcacatggggttgaatcagct

SEQ ID NO: 506045 - DNA, 240 bp, Homo sapiens
gccatttcgtagaaggcatttcgttgattctgattctggcaattatgcagaacgctgatctagaacattcatgtacaggcttctgggtgaaaatgaattttcaaataaataagccaaatgcctcggacttctgattgatggaatctatgatctgactatgtttggcttgctgtagaattgtcaaactgccttccaaacttgctgtactggttggtattttcagcattagtgaaagttcct

SEQ ID NO: 506046 - DNA, 131 bp, Homo sapiens
ccacccgctatctagctgcagcactccggggctctggaaattctcaaagctgctccctgaggccactctgtatcaggctctttgcttatgccaggcatgaagcctcatctaaagacccaaatcacagcaca

SEQ ID NO: 506047 - DNA, 321 bp, Homo sapiens
cacgaggtggttgctctgccagtggaaattgactcccgctaccgcgtggacgtgcgcacggtgcagaggacagaggcactgcagggctactcggcccgttttcggatccatgccgcccgtccctccggaaagtgatcaatcgcctggttgctgcgctactggtcgctcgccaagataggtacttcatggcaggacgccgaagggtcttcatcatgctgggtatccaccgctggctgcgcgccggcctgatcttcacgctggcgggcgcactcggcgcctgtagcagccgcgtaccggatgcgccggagccgctggatctgg

SEQ ID NO: 506048 - DNA, 344 bp, Homo sapiens
ctccctgatgaggggtgtctgacccaggagttcccatctctaggaggaaaagacatagagaccaaatctgcattcgagccagagaaacacctgcagcagccttcttgcctttcttctgaggtatgacgacctcttctccactgctatcatcttctatcatcttctgacattacctcatcttcactatcttcttctagctcctttggaggaggagccaatattcttggggtcacccttgcttaatacctgccttcgcgagcttcaccatgatggccggcggactgtgacaagcggacaagtgagcgcagatgagtccagaagaagcccagcgccggcgatgggcg

SEQ ID NO: 506049 - DNA, 349 bp, Homo sapiens
gctctccgtgaactcaggtaaaccacctcaccgatgcgcgtaaagtaaacccggtacccggggccatagtggatgcgcatttccgatacgccatttcctacggtctcgcggtctgatgcaaaaccgcgagagaggaggttagggcgagggcttttggctgtgccagccagatggttcggaagtatttgtaggtagattcgactttgggcggagaagctgaatagttggccgtccggctggttattcgtgcaaacagaaacgtcttacaagtctttgaggttgtccctaggaaggtggaactctagtctgtatacgccgctgcaaactcagcggtcgggagtctcacgga

SEQ ID NO: 506050 - DNA, 118 bp, Homo sapiens
tcagcggtaccggcactctagtccagttatgttggtagtttttgtagagacggagtttcaccatgtcgcccaggctggtaagttcacttttagtaccagtgggtgttttctatttctt

SEQ ID NO: 506051 - DNA, 912 bp, Homo sapiens
  misc_feature (662)..(662): n is a, c, g, or t
  misc_feature (667)..(667): n is a, c, g, or t
  misc_feature (911)..(912): n is a, c, g, or t
ggctaccaccgctggcgtcgccgccgcattagatggcaggaagagtccggtctctgggacagcctggagacagttggtggtgactgaaataactttaccaaaggaaagctattgcgaagctatcttctccagcggagatggccacatgtgcattgtaacagagccagagtggttgccctatgctccgcaggatttgctctttagtttaaaagggttgtgcaagtcccgaaagtcgctttcagactgctgggatcatcgaggttcggatgagtctcatgtggctgctgcacctgccagatatagtgctctcgaacagtgtggcctgatgaaactatgggacccttggacctcaagatcagaggttcagcgttcctgggaacataggttgggattgtcagctctagatgggacatgcttcacagaagagaagcctggttcataaatattttgcctgatgtactagcagaatgtttatcaaggtgaaagacgatgagtttatgatggcccagagtatgtgaatgagtttcagggtaatgatgcacctgttgagcaagaaattaacagtgcagaaagttacttggaaaaggggcagagtagaggtgggcatacaacatgtgccgaaattggtgcgaaagagttgaatccatggttcaggacgttgnctaangggaacgaatggaattcggcggtacaagaaaacaaaggaagtcttgacggtgggggcaacattaaacgccgcgaaagggttgaaaagcaaagacgaaaacgatgggtgcgagagatggcgggatgcaccgggggaaagggcgcaacagtgtggagcaacacgccaatgggagggatgaaaacgacggacatggtgacattgaagaaaggaacagcgagcgaggagttctgtctcgcgcgtcccnn

SEQ ID NO: 506052 - DNA, 336 bp, Homo sapiens
ggtggctaacacctgtaatcccaacactttgggaggctgaggtgggcagatcttgaggtcaggagttcgaaaccagactgaccaacatggtgaaaccctgtctctaatacaaaaatcagtctggcatggtggcgcatctgttaattcccagctacttgggaggctgaggcaggagaattgtgtgaacccaggaggcggaggttgcagtgagccaagatttggcccctccattccagcctgagagacacagcaacactcttgtcttgataaataaataaataaataaataaataactgtccaggtgtggtggtccagccctgtagtcgggctaatca

SEQ ID NO: 506053 - DNA, 400 bp, Homo sapiens
cagatagccttgtgcttctctccagtgcccagcctcctttgctgttaggctggagtcatataattaggtaaggtgaaacagatatatacagaagtgatataagctgcttccatgcttgttctcttaaacactctgcacagtctgctaactctccctccccttgccccttgtgaatgtggaggccacctgctccagatgatagctgtactttgcaagcagcttggatctctgagtcaccccgtggaagagagcatcttcagcaagctacatgactaacgtcagcctgtgacataagcaaaaaatgaatacctgttgtattttttttaattgagagaaacaagtagaggaaaatgatagacctatgaatgtctgcattaaacaataaaggtttaactcttta

SEQ ID NO: 506054 - DNA, 314 bp, Homo sapiens
tgtagcacaacctaggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 506055 - DNA, 1064 bp, Homo sapiens
gaaaatatgttaatctccttatataactttctgtgacgcatgcatctgaacaacgtcagaagcaaactgtgtcatgttttccagccgcccattctgcttcagagtttagcatggtgtctagccttttcagctctatgacaattctaacattcattatgtaatagtcctgcgtttatgggtcgttggtgcgtatatggcgtcactagatcagacctcaaaatctcttaaaattgtctcatccgtcatgaatttcctcgtgtagaggattatcaacgatgagttgattctgtagaagcagaaatagaactcctagagacatattcttactcattttccctgttcggtatatattcgttgcaataaaacgactatactcggtatatagttcgttccacataaataccactatgatgggtatactattgttcaattaacaataattatgtattaacgaagttaaatttgcaagcaaaaaaaaaggagtgacaaagacagaaactagtttggttgagccaggacatcgtcacactggtagagaactcattgtagactcgcccttcgcatggagcgtggctggagtgcccccagggaaagtggggaagccaacgcacagttcgcgctcacaacggcggttgtactcgcacatgagatggcaggagtgaaaactgaataccctcgtgtgccctgtaatccctacaccacgtttttggaaaacagcgtcgcgaggggaataaataccgctggcagtctttttgaacaggaaacattttcccagccattgaggtcccttaccaggggacaaacaccaaggggagatctaagataaccgggggaaatctacgcgaaacgtggaaccgttgcgaggacatacaaagcacggcccccgcgacgctgcggcggaaacaccgggccgtgtataagaagtcagcaacaacagcacaaacgcaacgcacaacaaaaaacagacaaaaacaagactgggcagacggcgcggacggcagcagaaccactatgaacagaacgacacgtggcacgaagggaacgcacaagcggcggcacccacg

SEQ ID NO: 506056 - DNA, 968 bp, Homo sapiens
  misc_feature (968)..(968): n is a, c, g, or t
atgatcccggatgatcaggactgatgcgcgtcttatgaaaggcagaacgcaccatcttccaagaacagatgaagaggcatactgtgtgtgatatgacgtggtacgagaaaatctcccgcgtgactatatgtgcatcggtctggacttgaacgagaccgaaggaggctacttgcagggcacccgtacattgactacactaaatgtcccgcatccagctgggtacactgtgatctccatctctgaaggggcgggatccctactgtggctgtgtctgacgcgaatcgcattgaagaatgcacgaggagccagttagctccgatcctgtcgagacatagtctgcaggtaacaatccggcaaagtccaaaaccgcattcgataaatcgcgcatcaagaagcactgttctgtacagcctgtccccactgcttcgagggacgtccagatcgttgacatcgtcaaccctggatgcattgccggtctttgagccagaacagtgctggttcaacgtgctcaaggtcaccaaggctgccggcaccaagaagcagttccagaagttctgaggctggacatcggcccgtcccccacaatgaaataaagttattcttctcatttcccaaaaaaaaaaaaatacccatgtgccgcgggaccacccaaaaaatttttggagcggcttatgcctgaaaaggtttcaagcccaactgtgtggcggggcgcccactagtaatagaaccgcgcaagagtcgtcctggaacccggcaagcgagggtcgcgacccagaaaaaaacgcgggaagcgcgcgttaaacccacgacgggcgtaggggggcagcggctaacacggccgggcatatcacccgcgggggggtgacgccaacgcacaatattgaccacccgcagcacaccagcagcgtccgacgacccaagcgccgacacccacagcgcgagactacaaggcagtcgtggacacacgn

SEQ ID NO: 506057 - DNA, 665 bp, Homo sapiens
  misc_feature (1)..(1): n is a, c, g, or t
nctggtctcctcctgacctcaggtgatccacctgccacggcctcccaagtgctgggattacaggtgtgagctaccatgctcggcctttgggttttatatttcttggggcctacgtttgttctccgtgggttttgatgtttgtgagtttttttttgcgtgtgtgttgtttgttcgattcttcttctctttttgttggtgtgtttttgctgggtcttctgtgtttggtctcgttgtctctttttccacatacgtctgctgtgcacgacctctcacatcctggagtgttttgtatatattttttatattttttttttttttgtttacctctttttgcgctcttttcttgtttttttttgtttttttgggttgtttgttgtgttggtttttttttcggttttttttttcggctccttgctttcttgttttttctttgtttttttgtgtttctttttttttttttttttttttttctctttttctttgtttttgcgtctttttttcttcttcttttcttcatgtttttgtacttattctgcctctttcgtttttttttttttgattgttttggtctttttttcatttttctctctttggtcgtttcttttttgtctgctctcttagcatcttcctcttcttttcgtctttctcttgtctttctccccctg

SEQ ID NO: 506058 - DNA, 171 bp, Homo sapiens
gggagcagcactggtggtgcctcaggccataggcctcgaccgttcttcctcctcggctctctctcactcacaaaggttctgtaaccctccaatgtcctaattaagcaacccctcgggtgtacactgggcccccagggaaaagagggcccacgatataccctttggggggaa

SEQ ID NO: 506059 - DNA, 489 bp, Homo sapiens
attcggcactgaggtggagccaaacataccacagaagagcatcacatactaagcaggtctaactctgcttacaacagcagtataaaatccaggatacatgagactctatcctgctttcctattcaacagcaaaacgaagacagcactacaattcaaagactttctgagatcagacaagatagcgcatgttcagagttcccgtatggccttagccatcagcccacatctacattcacatcaaccccagtgagtgcaactagagggggctgcatcctgggattgaacctcaacctcccacaactacatcaacaaccacacaatcaagaaaataccattcgcttgaacctgggaggcggagattgcagtgagccgatatcacaccactgcaccccagcctgggtgacagagcgagactctgtctcaaaaaaacaaacggccgggcgcggtggcttacgcctgtaaccccagcactttgggaggctgagacag

SEQ ID NO: 506060 - DNA, 107 bp, Homo sapiens
gaacctctgtagtaggcggcggggagagatgaatttggcctggagtagggtgggaggggtcaaggcagaaaaggtgggttgattctacaaacatttaggtgacaaat

SEQ ID NO: 506061 - DNA, 248 bp, Homo sapiens
ggagccccgtgaggaagcgtctccgttgggtccggccgttttgggactctgaggaaagctcgcaccaggtggacgcggatctttcaacatggtaaaggagaccccacaagccgcgggcaaaatttcctcgtacgctttttcgtgcagactgccgggagagcacagaggaacacccgattttccgtcatttgcggattttcagagtttcgagatgagccattctcaaggagagcgatttagtttgcaaa

SEQ ID NO: 506062 - DNA, 338 bp, Homo sapiens
gtgcaatctaatgaccaaatttgaatggatgaggagttgccttcttgtgaatgagcaaagaaattggtttcttgagatggaatctattcctgctggagatgctgtgaacattgttgaaatgacacaaagaatttagagtattccataaactttgttgataaatcagtggcagggcttgagaggcttcacaccagttttgaaagaaattctactgtgagcaaaatgctatcaaacagcattgcatgttacagagtctttcatgaaaggaggagtcaccagtgggcaaccttcattgttgtttagaatgcacacaacccatcttcagcaaccacatccaa

SEQ ID NO: 506063 - DNA, 520 bp, Homo sapiens
taaatcagctcgtacccctcacggattactcaaacaacaggcacttaaaatacacttaaaaccaaaatcataagcctcccacagaaaaccaccttttccatttaaattaatgaaaccttgacccaatcaactacctaagagaaacccgggagtcatcttagacttgctaccccatctagcactttaacttatcaagtttacttttttttttttttttgagatggagtcttgctctgttgcccaggctggggtgcaatggcgtgatctcggctcactgcaacctccaccctcccgggttcaagcgatgctcctgcctcagcctcccaaatagctggaactacaggcgcatgccaccatgcccggctaattttggtatttttggtagagacaggtttccagcttgttggctaggctggtctcaaactcctgagctcaagcagtctgcccgctttggcctcccaaagtgctggctttacagggtagtcacttgtcttttaatggtggaggtaacccgagaggg

SEQ ID NO: 506064 - DNA, 495 bp, Homo sapiens
taaattagaccaatacattttaaactgacatgaccaaaacaatcttctttaaaagtttttcagaaggtcatacattgttctgatgtgggttataagacaataaggtcagcagaggatcaaaactgtgttttgtgccaaagttacttatgcatcatttatttaagggggttgaactcttgactgagttgatgtgtaataatcaatattgttaaaaaatgcccctcatttctcattcaaaaacactaaaacccctaaaagttgtttgctaattcataagactattattgtttagtgtgtgttaattttttattgttttaggtataccttcatattatgatagacattttgctttttaaaaacacatttttttctctctttttgttctttcttgctttctttctttcactgtaccagaactacattgggtattaattttattaggatttctggagtaagcgtgaccaatgaatgcattttttgtgtataaatttgcca

SEQ ID NO: 506065 - DNA, 350 bp, Homo sapiens
tgggggttttttggaacccgcagtcaattagtactcaatggttttaaaccccttacttttgacagagcggggggtatgctacgactacaacttttatagctgttttggtaatttaaactaattttttcaaataaaattgtggcatccccacttcctcaggcaggtttttttgggctcacaatttgtgaaaactgggaaaaactgcttaaaaaaacacccaaatggagggtgaatttttttttcagcaaaagtagttttgattagaactttgtttcagccccaaagaatcatgtaaacgtaataggatcatgtagcagaaacttaaatttaaccctttagccttttattta

SEQ ID NO: 506066 - DNA, 1188 bp, Homo sapiens
cttcctccgggcgctgagaagatggggagccaggccgagccccggccctaccgccgccgccgccatgtggtcccgcagatcccgaccctgacccggactcccgtagcctgccggtgttcacgtcccgggcctcgtggtccccgggctcctgcgcccatgtctgtacggacgcggtgcatttacatcgtgactctcatcaaagcgccgacatcctgctggccgattcggtgtctctcattcatcgacttctatctgactatgctggcgatcctccagccatctgaccttcactcaacagcaccaatcatgaatgcaaaatacactgaatgagaacacagaacaacaaatcacatacataaagacaagaaatacacaaaatgacaaacaatacaaacagcaacaacagaataagcaaaagaaatcagcaagcacaatcaacacaccaccacacaaaacaaaaaacacacgacacccacacaccaacacaacacaaaacaaaacaccccatcaaaactacatccaacaaacgcacatcatcacaaccaacatccaacacaaaacaacaaatcacaacaaaaaacatcacactctccaccactcaaacaacaacaacatcaacaaaaaaaacacaacacataaccacacaaagcaacaacaccaacctacaacatcaccagcacaaaaaccaaaaataaaaatcaaaacacaatcaaacaacaacaaactacaccatcatacaccatcaaacacacattcaaaatacaacaacaatacaaccaagaaaaacacacaatgaaagcaacaacaacaaaacaaacaccatcaaaaacacacaacaaaacaccgatcatccacacaccttcaatgtaaacacaccaactcaaaaaacacaaccaacaacattacaatctacactacacatacatcaaacacaacaacaaaaaaacacacaaccacaacacacaattcaccacaccacaaccacaaacacacaacacataaccataaaaaaaacataccaaaaaaccaacacacccataacaaaacacacaaacacaaaaccactccaacaaaacacaccaacaaaaagcaagaacaccacacaccacacacaaaaaaacaataatctacaacaacaacaacaaataacaggcccacaattccaaaaaacaacacaatcacaaaaat

SEQ ID NO: 506067 - DNA, 289 bp, Homo sapiens
acttgggctcctgaacttttactgtcgttgcagctgaggaacatgatgtgtggcgaggtttaggcaccgtgatgccactgggaaagctggttcatgctacaggatttctccaaaatgccattgtacacctttgcttgcgggactcggagatcatactccttagtttcttgtcagaccctacacaagtcggggaggaaccccaagtacacataccacaggttacacggcggaatccctctcgtggaggacatcctactaggggacaacctcaatctacttgatattcttt

SEQ ID NO: 506068 - DNA, 716 bp, Homo sapiens
  misc_feature (299)..(299): n is a, c, g, or t
gttccccttaggccccaaatgcgccgcggcgttatggctcccaggggccggttttgttgttcttccccctgtccaactcaaccccccctttgcccgggatggggtttttttttttggccccccggcgggttgtgttgggtctcccttgtgccggggggggttcccccccgtgtgtttttttgcccccccatttcttttcccctttttcccgggggtggcggtggtgggtttctcccgccccccttttgttttcttgcccttccccggggggtttcccctttttaacggggccgcgttcnccccccccgccccccccgggaccttttttttggcccaaaacccgggggtttttttttttgtgggaaccccagggtgggggggcccccccccaaaaacttttttttttttttgccccgggggttgggggggccccccccctttttttggggttttcccccttttttggaccccccttggtttttggccccttttttttaaaccttttaatttttggctggggggggccttttttgaggggttgcctttttttttaagataggggcccgggtttttggttttttggggggggtccctttttttttttccccctttttttttcccttgggggggggcccttaatttcccggggggggggtgggggggtggcggttttccttttttggggttttggttttatttttttttccccccccgga

SEQ ID NO: 506069 - DNA, 817 bp, Homo sapiens
  misc_feature (63)..(63): n is a, c, g, or t
  misc_feature (381)..(381): n is a, c, g, or t
  misc_feature (467)..(467): n is a, c, g, or t
  misc_feature (470)..(470): n is a, c, g, or t
  misc_feature (484)..(484): n is a, c, g, or t
  misc_feature (536)..(536): n is a, c, g, or t
  misc_feature (562)..(562): n is a, c, g, or t
  misc_feature (589)..(589): n is a, c, g, or t
  misc_feature (645)..(645): n is a, c, g, or t
  misc_feature (666)..(666): n is a, c, g, or t
  misc_feature (668)..(668): n is a, c, g, or t
  misc_feature (670)..(670): n is a, c, g, or t
  misc_feature (797)..(797): n is a, c, g, or t
gagagagccccggagccgcgggggagaggaacgcgcagccagccttgggaagcccaggcccgncagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccaggggctacccctggctctctgttgccagtggtcatcatcgcagtgggtgtcttcctcttcctggtggcttttgtgggctgctgcgggggcctggcaaggagaactatgtgtcttatgatcacgttgtgccatctttctgtctcttatcatgttggtggaggtggccgcagccatgtgcntggctatgtgttagagataaggtgatgtcagagtttaataacaacttccggcagcagatggagaattacccgaaaaaaaaccacantgnttcgatcctggacnaggatgcaggcagattttaagtgctgtggggctgtaactacacagattgggnagaaaatcccttccatgtcgaagaanccgagtccccgactcctgcgcattaantgttactggtgggctgtgggattaatttcaacgagaaggcgatccataaggagggntgtgtggagaagattgggggntngntgaggaaaatgtgctggtggtaagctgcagcagcccttggaattgcttttgtcgaggttttgggaattgtctttgcctgctgcctcgtgaagagtatcagaagtgggcacgaggtgatgtaggggtncggtccgcctcagcctcctc

SEQ ID NO: 506070 - DNA, 263 bp, Homo sapiens
tcagcattccgggcggctttgtcagatcttggccaggtaaatttgaccctccagacctcacgttatgttgccggagcccatactcgccgatcagcttcagactcttgtctcgagacgagatttctcgtaagggtctccgcgtgggtcacactaaattttagcgacaatacccagactcctgggccactcggcatgttaggctccgcttaccccgtctagcgcctaagcaagaccacccgtgtcactagagaaagagcaggtgg

SEQ ID NO: 506071 - DNA, 831 bp, Homo sapiens
  misc_feature (395)..(395): n is a, c, g, or t
  misc_feature (481)..(481): n is a, c, g, or t
  misc_feature (484)..(484): n is a, c, g, or t
  misc_feature (498)..(498): n is a, c, g, or t
  misc_feature (550)..(550): n is a, c, g, or t
  misc_feature (576)..(576): n is a, c, g, or t
  misc_feature (603)..(603): n is a, c, g, or t
  misc_feature (659)..(659): n is a, c, g, or t
  misc_feature (680)..(680): n is a, c, g, or t
  misc_feature (682)..(682): n is a, c, g, or t
  misc_feature (684)..(684): n is a, c, g, or t
  misc_feature (811)..(811): n is a, c, g, or t
gagggccggccgggagccggaaaccgaggtcccccttcggccagttttaatccccccgcctcccctctgccaggcccggagcatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccaggggctacccctggctctctgttgccagtggtcatcatcgcagtgggtgtcttcctcttcctggtggcttttgtgggctgctgcgggggcctggcaaggagaactatgtgtcttatgatcacgttgtgccatctttctgtctcttatcatgttggtggaggtggccgcagccatgtgcntggctatgtgttagagataaggtgatgtcagagtttaataacaacttccggcagcagatggagaattacccgaaaaaaaaccacantgnttcgatcctggacnaggatgcaggcagattttaagtgctgtggggctgtaactacacagattgggnagaaaatcccttccatgtcgaagaanccgagtccccgactcctgcgcattaantgttactggtgggctgtgggattaatttcaacgagaaggcgatccataaggagggntgtgtggagaagattgggggntngntgaggaaaatgtgctggtggtaagctgcagcagcccttggaattgcttttgtcgaggttttgggaattgtctttgcctgctgcctcgtgaagagtatcagaagtgggcacgaggtgatgtaggggtncggtccgcctcagcctcctc

SEQ ID NO: 506072 - DNA, 184 bp, Homo sapiens
  misc_feature (26)..(26): n is a, c, g, or t
  misc_feature (40)..(40): n is a, c, g, or t
  misc_feature (75)..(75): n is a, c, g, or t
tatagcaactgggtacttataaactnagaccgggtaattnatgaagaaaagaggtttaattggctggtggttctncaggctgtacaggaagcatggtgccaccgtctgcttggcttttgggaaggtctcagggagcttttactcatggtggaaggcatagcggggcagccatttcacatggggg

SEQ ID NO: 506073 - DNA, 696 bp, Homo sapiens
tgggttcttaaaaaatctgaaacttgtgaggccaaaaaaagaaaggccggggctgggggaatggggtggggttcaggggggcccggttctgccaatctcagttcttttgtgtgcaaaagcggggtgtgctttgttgggggccattttcctgtggcaagtggcaagttgagttcgtggagcagagaggggagaggggcgtggggtgggtccccagccgtcaggtgtgggtgggtggcgccctcttgtgtggccccttcgcagtggcccaggcagttcctgtggacaagggcaacatgtggggctttgggcctgtgagattgtgggagaggcctttagaaggggacctctcagacgcaaagagaaagaagacctgtgggtgtggtggtgtgaggcattccccagggccatgtggaaaggagaccgggttgtggtgcgtggtggagaaatatccattggggccctctctcgttggtgtaaacaagacggcaacaacactattctatcactattattatcacccagaaaccagaaagctgtctgcgtgccccagatgttctcccacaacctggtgttctgtggaggccgccaggtcctcttggcggggcggggggagagaaactcgcttgggactctcgggggcgggcctcaggagcggcaatggccttttaccctgtactcactggtggaggcagcctg

SEQ ID NO: 506074 - DNA, 618 bp, Homo sapiens
taaggtgttcttgcgggactaaatattactacaaagagtacctatgcccagagataggctcgctgtctattcattggcaaaggtgtcagtggctaaaacaaattcgtgatgaagtgataaggatacgcatcatgcatagaatgagccttttaggacacggtattccgtcgagtccggatccatcacccatttacaggagactctaggagacagtatacctgaaatgcaatgagataagtcctgcgagcaagatactagaagtaaagcgagcattcctggacgatattccccctagagaatctaggtgaagacctttgaaagcgagtccatggaattccaatattaacgccacatacgccgaagatcgttcgcgaaaaaagaagggccaacgaattggccctttgggtgacaaacgagctgtctctgacattttcgatgcgtttcgccttgacaccctctggccgtgtaccccaactacctagtacgtaagacagttggatacccagtaaaccaaaagaggctaagcaacgagcgaaccgtagcattggaagaactcaagccactgcaagctggggcatgaatagaaatacgagacggtgagcatctcctatgatgaga

SEQ ID NO: 506075 - DNA, 880 bp, Homo sapiens
agtgggcgggcccacacataatacacaccattggggggggcacacacgaggagacgtttcacaccgcaggaggacggtatctcgccgagcgcggtgttgcccccccccgcactgttgttgccgtgggcgcacaaaaggcaaaagcccgtgttgccccgcgtcgtgagctgcggacacgcactgtgtgttaggacccccctgtggcagcgactctccaacagtaagagcccgccgtgaaacaatctcctgggccccccaacaaccccctctttgtggtacaaccgctcccccagcacctctgatgatttcgctgccgctgggtcccagctatgggcagcacgcccctctctttgttcgggaggatttggataattccgcctgccgagagagtttccccaccaatagcccgccgccagctcttgggtcctacgggcgcttcccgacaacagaggacttcccgcgagccacctgccgccctttagagcggcgagaagagctggtggcacctcccactcacccgcgggctccccctaacagcggtccccccgccctctctctttatggggtgtggcatctagatgcttgggtgacccgcgctatgggggttgatccttccgcccgtgtatcatttcaccccctccaccctcacgtcgttgtggtcccgacccctgttccgcgaagtgaggcgtctcacgaaccctttccagaattatacccgggttcttgccactaccggctcccccttttcccggggcccccccgtcgtggtcgacttcttgggtgcgacgcgccaccccgtctttccccgccgcgcgttcccccctccaccggcccgctccaccgctgcacccccatttttctctcgggcaaacaaaacaca

SEQ ID NO: 506076 - DNA, 107 bp, Homo sapiens
gtaatgacagtgtaattataaccttccacctgaacctcacacatgaatttctgcctgttttttgttccccacatgctctaatttcatagtgatgggccctaccttgt

SEQ ID NO: 506077 - DNA, 205 bp, Homo sapiens
ctccggtctatctagagactccctacgagaccgtgttgcatgtgtgtttaacggcaacgacgccagacagatccgtgtccacccatgtaccattaagacaatgggcaacgttaccaaatttgcatgagaaaaatgggcctatttaatgcttttggaaaagggccttaataagttaagtaacagttaagaaatgtcatgttcttgg

SEQ ID NO: 506078 - DNA, 211 bp, Homo sapiens
tactcacgtgaaccaggtatgaagctattgggaaaacttttggcctttttagctaaaaagaccaatcagaacagggctatttgaagaattattttatacacagattctgccttgatatcatagtatgagggttgaagacggaacacaatctaagggtctctcattaatttaattttgttttgttcagtataggtttatttttttttggccc

SEQ ID NO: 506079 - DNA, 331 bp, Homo sapiens
tcagccggtaccgcggtggagcatcatgttctcccacctctcagtgggggagcaaactggacagactagaaatgccagggctagctgagaaccttacagaatgagcaactgcggaagccacaggtaacaccgagatgtagatcagctgacagggacaagacaaagaatgttttctaaagtaaatcctcttaccagtatgttattgaaatcagtccttattggcatcgaagagggtgaaagtgctatttgcctgttgcctacagagactggaggaatgacaaatgtttaaattattttaattcaacaagtagaggaatacctgctatgtgaa

SEQ ID NO: 506080 - DNA, 629 bp, Homo sapiens
gtctcgtttgcatagcctaagtagaaattagacttttatgataggttagaataattagttggcctacacataaaaatatataaatatcagatgtaatatttgtttaaataaacaaatcaatatttcgacaaatatcgttaatttaattagcctaaatcattcattctcagttgctacaaataccaactgttcaaatgacatgttctaacaaaacatggatgaggttacatcgagatgatccaaaatatcgagatggtgtggaagctttcctcaattttgcggaattttcaatcaaaagagacaaaatgtcaggcccttgtatgaagtgtgaaaatctatatatcgaggatagaacaatcatgcaaacacatttcattgtgttcggtataagacccgattatgatttatggtactttcatggggagaagagacctagaagtaatgacattaatgatgatactgatgatgctgataatgatactgataatgatgatatcgcgaaacatgatgatgttctacaacaagatgatgaaatcgagaaccactaattgtccacaaccagattatgtaccacaacatgatgacaaagtaatggtggagaccagtaaggctcagtatattgacgacat

SEQ ID NO: 506081 - DNA, 278 bp, Homo sapiens
gtcgactgtttccactttgtggctagggactgattgcttatagcaagttacagaactggagcagaaaaagtaccaaactcagaatcagatggccagtagtcgaatccacttgcaccagttagtgaccgtatgactgagcacagtaggcacagaataactccttgttgcattagtaaatgaactgaccctcacaacaaccttgggaggtgggcacaaaaagcatcatcaataccctttacaggtgaagaaactgggacccagagaggttaggtcgacgc

SEQ ID NO: 506082 - DNA, 754 bp, Homo sapiens
tggtaatttcgatgacggggcggggttttagacctaggtagttacttggtccggtcgctcttacaactgaccatgcagcacatgcgggctcgcccatacccgtgacaggggctgacaagggactagtgagtcagcaccttggcccaggagctctgcgccaggcagagctgagggccctgtggagtccagctctactacctacgtttgcaccgcctgccctcccgcaccttcctcctccccggctctcgtcatcatggtccatcgaatattatctgtggagttcctgcatccgatggactgcagtcggcatgccaggacccagaccagcacccgactcccacctagatgccccagactagagctactccaggccaggtagggaacggcctgatagtggactagtctattattccatttcattctttctctctaggaagacccctaccatcccccggctagggcctacctatacttaccacttctccaagaaataggcaagcctgaactcgaggccttgtgtgtcacggccctcatgccatagcactcccatggccattgcaccgatacgatagtgctagaagacatgtttcaagaaccgcattatcgcgcgaagggcatgcacggggcatgcacacggatggtcactctgccctctgctgctgccccggggtggggtgcactcgcccatttcctcacgtgcaggacagctcttgacttcgggtggaaaacacggttgctaaaagccaccagccta

SEQ ID NO: 506083 - DNA, 268 bp, Homo sapiens
ggcaagagaaggaagaaaatgttaggccaggcacagctgacacgcatataatttcaacactttgagaggctgagatggacggatcacttgagcccaggagttaaagaccagactgggcaacatggtgaaatgctgcctctaagataaaatttaaaaagtaagctggacatggtggcatgcacctgttattcagtaggataaggtggaaggatagatatgacctgaaggctgcagtaagccataattgtgccactatacaccagcctga

SEQ ID NO: 506084 - DNA, 412 bp, Homo sapiens
atagcgacaccgtacacagtgctgcatcaacctcaagatcagctcaaccctgctctaccggctgatcaaggacgtacgaaatcgactatcccaagcttaagcctgcgttccgatgaagaaaagagttcagcaacgcaaacgtcaaacctggctcgcactgccggccagcggaatagaagaggtaggccatggccgaggaagagcagcagccgacggcggaagccttgaagcagcgccgcaaacgcgagaaggcagcagcgaaggacgctgcattgggcgtggagaagtttacggttgaagtggccggcattttcaagggcgatcttcgcaaggtgatgaaggcccacggcatcaacaaccagcaggacattcaccagcggctgatcattaatctgatcgccgcagacttcga

SEQ ID NO: 506085 - DNA, 973 bp, Homo sapiens
cggtatagcggggactggctgagaagccgtcgcgtcctgatatgtggactggtgtgaaatacgcatcttgtcccgacgctgagcctagcaaacctcaatgctaacggaagaactgctatagcaatcgagagtcctaacatatttatcagaatccaggaaggctactcatgatctccgctctcagaaactgttataaggtacaaaaaggaaggcttactaagaaatgctagcgctggttcttacagacaagatgataccagtcaaagagtaagtgtctatgcatagccagcggtctcctgattagagatgggatggacctctgtgcactgtctgtatgaagactgctatagtgatgttgcctatgcttgtcctgcacatggggtcctaccatgtgtggagctaaatgccgatgtgaccgtaagtggctgtatgagctacattcgccagtcgtaaggcgtgcgacataattcatacatatgacactgctggataatctgcggttccctactatggagccttagatcggtctttatctctaatgtatctgttactctaagcatacatttaggcttggttatcatatgacaaagatctcaaaccatcttagcggtgccctaatacatcattctttgagctgctataaagaatcccttattagagtattacgctcgcaaggacatatgtcagataggtcagcgtacaccctggccgtggcatacgtttcacacacgtatggtgtcaagcggcctgtattggtgtcttcccagggacacgagtttcagagaccagacattgatgaaccgcggtcccatcctggcatggaaactggatgaacgttgcgcaaaactttcactattagcctgcgcagggaacaaagcaaaccttgtgtgccacgaacactcaagactagagcgacacattataaccagagacctagataacacacacgacgcatacacttaaccgaaggtcc

SEQ ID NO: 506086 - DNA, 801 bp, Homo sapiens
gggcgccatggctcggggtcgcaatgaagcatctgaagcgggtggcagctccaaagcatggatgctggataaattgaccggtgtgttggctcctcggtccatccaccggtccccacacgtggacagagtgtctccccctcatcattttgcctgaggaagagacttaagtatgccctgacgcacggacgacggaacggaagacgaagacttggcagtgtcgcgcgggtgtgcacttaaagattgctgaccgtggcaaacggtcctcggatacctggactagtaagcgctacgcctgcgtggacttcatgggattcgtcactcacgccattggagctaggagagcgggagacgacatttccggtctgagtctatgatagccaggggggtcggtgttgctgtacagtcgtgattaacgacgctgagagaggccaacgtagcaagttgtgcaaaatggtgacgaaagatctttgtggtgcacaaaaatggaatcccgtcactctggtgactcagtgatgcccgcaccatccgcgtagcccgatccccgtcatcaaggtgaatgactagccattcagacttgactttaggagactggccaagattactgcatttcattccacaggttccgaacctcgtggttaaccctgtgttatggtgaacgggtagggtgcgtgaccgtaggaagaagtggtgtgaatcgggcaacagagagagggaccctggattcttttgacgggggttccacgtgagcagacggcaatggcatgcgcttggccactcggatttgcaacatttgttgatcgc

SEQ ID NO: 506087 - DNA, 397 bp, Homo sapiens
tatttgggctgtgagaagtacctaacagagcaatctggtggcagggctcaggaaaggttggcatggcccctaggaatgggggctctgcaagatcctggactttagaggctgtgagagggaacaggtgtccatccccaagtaagtggacacggtctttgaggaaatcccagtgccagggcctgaagggcactgtcaggaacacaggctgtttccagtctgttgaggattcaccgggggcgcttgttcactgtgagcacggactcctcagggccaatgtggcagaagagcccaccttttgaaagcgagcgggtggggggtggcgggctggtgctggtgctgtgcttctgcacaagcccacctggttaggattgctgtcggggttaccggagctcgaatt

SEQ ID NO: 506088 - DNA, 145 bp, Homo sapiens
ctcccaagcatgagaactgcaaagctaagaataaagaactattaatattcactgagtaactggttctgaactccagggtatcggaggataacaccacagtactatttataaaatgggaggttctaatcaattcctcatccttggg

SEQ ID NO: 506089 - DNA, 688 bp, Homo sapiens
tatctttaaaaggggattaattaatgtttacatcagggtagcaaatgttacataagtggtttccttaaaaacatttatttggtgacaatcacattggttatcaagcaagacttatgggaaaatctccggggtccacaacactgaacttggaaactaactggtgagcatcctctttcccaagtttacaacatgacttgggggcactgaagaagtatggttcgcatggcccacgtggtcactatgtgacaacctggacaccaagcgagaacgcctttggatgaacgaaattgtgtttactctttaggtaggagttacaaaagggtacttccatggtcgtgtagatatatcaaacccatcatttttttacagtatcatttctggctacaactaacccataacaccagttaaaactaacgcagtatagcaactgtaatcgaccaactatctagtcacggtcatatcccttatattaccagaggttgctaacgctcgactaatgggacctggcttcatatacttacccaccactctggatacttaaatatatacacttgggggcaactacccaacctgtcacagaaccactcgctccgggtacaactacaacgaacgccaacaagaatttcccctcgaaacaatggattgccttgtttcaaaaattaccacaaacttaggttacttcttaagg

SEQ ID NO: 506090 - DNA, 398 bp, Homo sapiens
agcacgtgggtcttccctattaggcacattcggtcctctcgcgcattctttcttcccaccttgtgtgctcacaaaaatgctcccaacttccctagccctttgtgcttcaagtcttccttggcccccattggttctcccacaccaggtctctcagctgccagcctaccaaccaaatgttccaccacccagccttaaaggaaggacttgggaaacaagagaaaggaagcttgccaattataacctttgaatgtgggtatgcctcttgtgtccatcactccatctgatgccacacgctctccttaggctcacactctgtggctagcttgagagggagccatatgctcgaggcacatgtctcctcttctctgtctctgggtatgagatttccccgcgtgccg

SEQ ID NO: 506091 - DNA, 320 bp, Homo sapiens
gaacccaattattggaaaacgcggctcacagagctaaaaaccattccgggcagtccggaattgatctcctgacttggtacggggggcccacctcagccttgcaaagtgctgtgattacagacatgagccaccatgctgcaactatatttacgtgaataacagtggttgacacggggctagcacgggcagaaataccagtcaggaaatgtaacaaaataattattctctctacagcccttacatcagcaaactctgaatatcctgggatactgtgattaagttgaatatggagataaaaacaaatattgggagaagttatg

SEQ ID NO: 506092 - DNA, 258 bp, Homo sapiens
gatgatctacgagctatattagtcgggtgggttagagagatggtatatgaggaacgttgggaaatttggaagagtcttttaactggattctgatggggtcatggtgagcagctacggaagggttaatgagagaggcaggaagtgggtactggggcaaaggggtcaggggccggactagcggagaggagcaggaggggactctggttgaagggggcaagaaaaggtgatagaagctccgactttggctacacaggtctc

SEQ ID NO: 506093 - DNA, 448 bp, Homo sapiens
  misc_feature (9)..(9): n is a, c, g, or t
  misc_feature (73)..(73): n is a, c, g, or t
  misc_feature (105)..(105): n is a, c, g, or t
  misc_feature (176)..(176): n is a, c, g, or t
aaaaatggntgtggtggggcctactggaaaaccgggcaatgggggccatctgaaaacaccactttgccagtgnatgcaaaactgcctcccttaacttgcctgtgnccctatccaggcaaagttactttgccctctctgagccctcagtttctttattcattaaattcaaatatgancccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcaga

SEQ ID NO: 506094 - DNA, 452 bp, Homo sapiens
  misc_feature (26)..(26): n is a, c, g, or t
  misc_feature (57)..(57): n is a, c, g, or t
  misc_feature (74)..(74): n is a, c, g, or t
tgcagataattccaagaatgcatatntgggctgggtatggaggttcactggtaatcncagcactttgggaggcncaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgaggcaggggaatcgcttaaacccaggaggcggagattgcagtgagccaaggttccaccactgcactccagcctggcgacagagcaaggctccactcaaaaaaaagatttaaaggggaaaaaatgtgaaattttcctcgtg

SEQ ID NO: 506095 - DNA, 273 bp, Homo sapiens
aggcactgaatgcctgacaacaaagcaatgactctgtctcaaagcaaaaaaaaaaaaaaaaaaggtgcccaatgtggttggaattggccaaagatttggttgtaaagggaggtaaaagggctctggattaaaaaaactttccccacagaggagattcagtgatttgcaaaattcctaggatcttctgagaccttaaactgcaggcttcagtgcctgaccaggcttcagtgcctgaccagtgctcagtgcctgaccagggctcagtgcctgacc

SEQ ID NO: 506096 - DNA, 419 bp, Homo sapiens
gctgtgcgagaacggcacgcgggggtgtctcccaacgcgtgtcacactctgtgctgtgcgcgtcacacagtggctctggacactctgcacgctgtgcgcgcgcgcgagacacagcgacagggcccggctctgcaaagaatagtgagagtgtggcactctggggccggagccacttaacttgggtgagagagggccaagggaggtttcctttcttaagagccctttgtggccctataggacacctggctgtgggtggcttccttattccagagcgcaagtcaaggtgggcccagagacactagaatcacaggccgtggctgtctctggctttggcctttctctaagggccagacacgggtctggtgtggcttttaccctcttctgagctctgtcgcctgggccggtgtgtgttccggccc

SEQ ID NO: 506097 - DNA, 181 bp, Homo sapiens
ccccaaatatagcataaatgaaattgttaaattatttcattgtagttaattccccctataggaatgttttatcaaagtgaagttttttttgaaaaaaaacggaactccttgaggcttttttttgggatgtatatgaggggggacatattattttatgtgtttataatataatattttccca

SEQ ID NO: 506098 - DNA, 324 bp, Homo sapiens
ccggactgtggttagcacaataaggaagggtccccaggttggggagagccccaagagaacaataatgaacaattatagtatgaacaactgttagaaacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 506099 - DNA, 413 bp, Homo sapiens
cgtacctggcatttccctgaattaggacaaattatttcagatcattataacatactcgctacagtgtttaccgtaaacgttggcgattggaagaactatgcctctgccaagctttctgagttgctgtcagaagaagcttgaagcagaagtgaaagcagctgcagagatatcaatgggaacaggggtttcagaagaagatgtttgcaatattctgcatctttgctccctggtcattgcacaatctctgaatatcgaaccccagctctatgaatatctactagatcgaatgatggccattgcacccaatgttacagtcatggatggggaatccgtgagagctcggtttattgctcatgccggttctcttttaaatttggccacgcatgccgcttctaccgttcagattcttggag

SEQ ID NO: 506100 - DNA, 478 bp, Homo sapiens
cttttcgtataccctgcacagtgagcagtcctttatgctcagccgggctctttcacaggtcttcttggacagcccctagccctctgatagtgaaacaggtttatgtttcaacattattcctgacaggtaggatattcgtcataatatggctacacggggagggattagtaatcatcacattctacttatgatgtgtcaagtactttcatgtctattattattattatttttattttaattcactgtacaattcattttcttcctccagtgtcaaacatgtctgttatgttaccttacatctcccaataaccctgtactgaggtcgctattattcgcacccgtattatcagacaaagggcacacagaccggtgtttcccttagtctatgaaaatacatccagagactgggatatgtaaccataaagtctcacaaaagaccatcacacgatcctacccatgacatgtaagcaatcagtaa

SEQ ID NO: 506101 - DNA, 318 bp, Homo sapiens
aatttaatttttttggattataagggaggttctgttgaaattcatatatccctgagaggagaaacccagctttaaccccctttattccccggtttgaatttatccatttgatttgatttttttgtggaataaacctgctggttgattggcagtttgggccttctaaagtccctttattttacggttggtttttatctccctaacttttgatacttcaaaaaaattccttttttggatttattaagccgctcttttcttttttcttgaaataatggttgggtttttaaaactcccccataaatttttcttcctgtccca

SEQ ID NO: 506102 - DNA, 343 bp, Homo sapiens
ctatgtgggaatgagcaggaacccggaaaagatgtctgttgcgcaccctccatgcccaatagtgagttcttgtctggtggcctgcacgaaccgacgtgctctccctgctccagcttgaggaccatgccaccgcgtcgtgacctggaaagtgctgtcggcatagtcacagaaggtgaccaccttctgtgcacgctcccggccacgcatgaggttcacgcacaggttccctcgagagctggcgtggtaggtgaagtagtagagaccgggcaccttgcaggtgaacttgccactgcggggctcataattgttgttcatgttggtgatcacatagttcagcgtctga

SEQ ID NO: 506103 - DNA, 157 bp, Homo sapiens
agatcatatcttattgcaaagaacaaagactaatagtccatatatatttaagtatctctaatctactctctccatgatataaaatacccaagaattctttactagtccctatctgatccccaacaactaggatctcattccttgataacatgatact

SEQ ID NO: 506104 - DNA, 1105 bp, Homo sapiens
tgtttgaagccattgattgatattcttgtttcagtgtctggttccctataagtaatatatatttcctctttaagctctgtgcctcaatatgcaatcactttgataataagtataaatatgaagacataccaaactgcaaataggattatttttcaaaactatatggtgaaacatatggtgatatgatagacttatggtttttctgtttgctgggattgggtctgctttttgcctatgtgtaaggcattttaatcattgtgaatataatagattccttaaaataagaaaattaaaaatcagaaacttcccttggagtagagacatttcagttgcaagcataaagatttttaaatatataacactaggttatataattcatatatgtgtggttttgtattaataatcaaattaataaaaacatttcattttctaccattgtatgaacgtaattttattttttaataaccacactcatagatggttttgattgttccagttgagtgattgtgtatgtacgcataggaatgttttgttcagttgtactttgtatttccaataatcagaaatcttacctttatgtataaaaacccattatgtaatgtaaaatgtataatattgtacataatattcagaatacaattattttggtaaattagcttgtatttttaatgtcccagttgcagtatttaattatttgaaccatactgaaagttggtaatagtcaataaagctaaaaaaaaaaagtggcaaatcttaaaaaaaaaaaaaaaaaaaaaaaaaaaaaaaaaaaaaaaaaaaaaaaaaaaagaaaaagaaaaaaaaaaaaaaagggggggggaaattctggggggggaaacgtggaccacccaataggtgtttagacacgtactaatatgtctacacaagtagaatctaattaataaatttatgatagtacgcggacacaacattaaaacgagatgattgtgttatacaacgataaaaatatctagagggacaacatctcaatgcgtgtctagaatatttgaaggacaagacataaaacacatgcgaaaatttaacaacagtatagtgagaacaaacttattggattagatcaatatag

SEQ ID NO: 506105 - DNA, 239 bp, Homo sapiens
ggttccccccccaaaaaaggggggggttttcgtttgggggccctaaaggggggcttaaggaagggccccctcccccctgggtttttaggttccctatccgtggtttaccacaggcccctttccttccccccgaaattttggttggggcccctatattgggtttttttttttttttttggggggggtttgaaccggggccgggcccaagtggggggccccttaaatcttttttttttgta

SEQ ID NO: 506106 - DNA, 581 bp, Homo sapiens
  misc_feature (280)..(280): n is a, c, g, or t
taaattaaagtgaaagcttttaaaaaaaggggcaggtattccttggaaattaggtaaaaaaagcctccccatttgtgttcccctccctttttggaggggagcagccccttatgtggagaactgcgtattgtggtacccgcagaaaacatttcaggcaagagcacaccattatagccttccgcgtgaaccccttcttcccccggatttttcccacagagacaggctataggagattagaagcggcaaacatatattctcgctctcacacaggggctcatgnttgagactcttagagagggctccctttcaaggggggtagagctctcacaaggggctctctttttcaacattccacaagatatactctcaatgtcgcgcgcgcacatctccacatgtgcgccaggtgtgtgtgtgcgagagaaacctcgtggcgagaaagcaacctttgtgcgccctttgtgcgcgcgcccggcgtgtgagggccacccgggaagagatctctgtgggcgtgtgaacgcgcggtgttctccttgtgggtgccaacggcgggaggtctttataggggcgcccgtggcgccact

SEQ ID NO: 506107 - DNA, 135 bp, Homo sapiens
cttgcggatcctgcgcgatggggacagctatgagtgtaatgtaggacatgtgctctgaaaaggatctgagtgcagcgcttgtggctgggagtggtggtcagaggaggggtcacatctgcgtgactggttatgatg

SEQ ID NO: 506108 - DNA, 991 bp, Homo sapiens
attaatcccctggcccaacccgtcatctactctaccatctttgcaggcacactcatcacagcgcatgatgctcgcactgattttttacctgaggtaggccgtagaaataacacatgcggagcttgtgtattcccagttctgaaccgaagagaaacataagacccttcgttccaccaagaagctgggcatcaaagtattttccctccacgccaagcaaacggtatccataaatcctttctaataagctaatccttcttcaaacaaatattatctctccgagacaaattgaacccaataaacaaatatttaacaaattcaatactcattcattcaatacatcattaagtggcttataagcaagtaaaaacttaggacatagccccccctttcactttcctgaggtccccagaggttatcccaaggcaccccttctgaggatccgggacgtgcttctttctcagcatgacgaaaaactaagccccacatcgtcaatcattataccaaatctctccactcaagttaaacgtaaggcttctcctcactctctcaatcttatccatcatagcaggcagttgaggtggattaaaccaaagccaggtagcaaaatcttagcatactcctcaattacccacataggatgaataatagcagttctaacgtacaaccctaacataacattcttaatttaactatttatgattatctaatactaccggatttcttatattcaaattaaaactccagcaaccaagaccttaatatatctcgcactgaaacaagttacatgactaaaacccttaattccattcaacctccttttccctaaggagggactggccacgcgttagcggggttttggccaaaatggggcctatatcgaaggaattcccaaaaacacataagcgtcaataattcccacaataatagcacaataaactatgttaaacataattttaaacaaggctataataatcaacataattacataatc

SEQ ID NO: 506109 - DNA, 259 bp, Homo sapiens
tctagacggatccctatatttttttttttaagaacagagtctgcctcgtattgcccaggtggagtgcagtggtgccatctcggctcactagaacccttctgccttctgggtacaggcagttctcctgtataagcctcccaagtagcaggaagtacaggctcataacaccacgcctggctaaattttggtattttaagtaaagacggggtttctcaaatattggtcaggctggttttgaccgttttgacctcaggttgag

SEQ ID NO: 506110 - DNA, 904 bp, Homo sapiens
  misc_feature (301)..(301): n is a, c, g, or t
ggcggactccttggctagtctgtctagtgggagatccttttatgccgtcccttcgcctccttcagcgccgtgagaccccttcaagttctactcttgcgtgagtgccatctccatccacgttggtcaggctggtgtccagattgggaatcgcctgctgggagctctagtgcctggaacacggctatccatgccctgattggccagactgcctaagatgacgagactcattggtgggaggaccattgatctccggtacatagcattgcttttcttcatgatgaaactgggttgctggcaacangacatgatgcccccagggccgtggataactgctagcacttgtgaatcccactagtctattctgaatgaaacttcgctgcttggcgacttttaccgaacagtgtcttccatccactgaagcaactcatcgcaggcaaggaaccctattgctggccacattaacctatgtcctcgaagtgtgccagctatctaccattttgcgtgataggcagtatcattgaagcctcgctgatatgcctagccggacatatcggacgaagcctggcatgaacctagttggccctccgcgtcgttccacccgggctgtcctttgggttttgaccattagggcgtttctcgagtggcgggcgcgaaacctggtgttctcatcggagtattcacgcctcaggcgttaagtctcgattcgcgggacaacggtcttcctacgaagttatgcaatttgcaatgggccttacacgatacgttcccacacggcctggcaggttacctccccattttgtaacccccggggcgcccccccgaagggttttgtcccaaccaagccgtggtcacgtttttgaaggccccttaaccaacttcccaattcccttcaacccaacccacg

SEQ ID NO: 506111 - DNA, 218 bp, Homo sapiens
tcgtgaaaactacagacctgctagacagactagcgacaaaagctggggcttaagaatcccagagaggttctcctgagagagtagccagtaggattttgtatgcagagatttggttggggaggaggtgacgacgtaaggagcagaggggcaaacctgtcgggaatcctgccttgagggcacgggatgtgtgatcgtggggttgtaagggtaccgagctc

SEQ ID NO: 506112 - DNA, 375 bp, Homo sapiens
caggacaataacatatatgtttgctttcccagcagcacgtattgtcactggtaaagatttgcccagttagtcttgagtcatgagtcgaaatagaatacaggaaagcccatctaaaggtgtcatacgctgtgtctccgttgtaggggtttcgaccagccttcacacagatgtatccttctggacactggcctgcatctgagccatttccacagagtaaagggtctttttgcccatccaaaacataaaagtgactgtcatctccaatgtaatccttccagttaaatgtgctcattgttacattaacaaatgtcccatttgaatccattgtgccattaaagtaggaagtggtgttggtttcaagaagcaggaactggg

SEQ ID NO: 506113 - DNA, 81 bp, Homo sapiens
acataataaccagtgttttttaaagacttttttgtcagggtgcagtaaaattctccaattacttttattcaaaaaaaaaaa

SEQ ID NO: 506114 - DNA, 508 bp, Homo sapiens
  misc_feature (10)..(10): n is a, c, g, or t
ccgcttgctngctttacgaaaattaaaaaataaaaaattagccaggtgtggtggtgggtgctgtaatctcagctactcaggaggctaaggcatgagaattgcttaaacccaggaggtggaggctgtagtgaggccagatggcgccaccgcactccagcctggggcgatggagtgagactccatctcaaaaagaaaaaaaaaaaaaggtaggcagagtagaggcaggcacctttccccagcagaagaaatatgtgtgaaatgtggagaatgtcggggagagtcctgtaggatggtatggatcagaaggcctaaactgagaccttgagatacaaagtatggcgaagaaggggagatacctgggactctgtcactcaaggccccctctgtatttcaaaccccattctcaacaaccttcccaagggcgacaggcactccctgatcaaaaatctgtggactcctgagtccaagtccctgtccaatgaatgaaccccttaagcatgaagtgtcc

SEQ ID NO: 506115 - DNA, 627 bp, Homo sapiens
tactggcctgtacattactcccgtttggaccacagcctctgttctaagatcttgtataggctgttattgtgatgaataaacgttcaaccctcggctgcagccagagtagccaggccgcgcaccccaaaaaaaaaaaaaaaaaaattaaaaacaaacaaaaacaacaacaaacaaaaacaaacaacgtggtgtgcgggccgcccgcgcggccccctgagaaagaagtttttataacacaacacttgtgcgtgggggcggcgcgcggggccacagagtggggaaagcgagagaagcggggggccaaaacacgggtggttccacaagagggggagagcaccgcgggggacacaaagagaaaacaagggggggggaggaggttcctttcacaccacatatataaaaaaaacagacgccggggggggggagcaacacccagagaggcgttgcttgcagagagaaaaaacctccccgagacgagggggagagggcacaccgaagaggggggaacaatataacagagggggggagacttatatacacaaagacggggagagcgcgcaaaagcacaggagcgcggagaataaccacaaaattaagccccccaggcggcggggggggggggggcga

SEQ ID NO: 506116 - DNA, 1703 bp, Homo sapiens
ggggagtggcgtgctgggcgtgcgcggtgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttatcg

SEQ ID NO: 506117 - DNA, 264 bp, Homo sapiens
  misc_feature (2)..(2): n is a, c, g, or t
cnggaggatcatgacggatgctcccatggttttgctagagagattactgctgtggaaaacatgcttgtggatggggcttcatgataggatgatgcatattcctttgaatatatacccgatgcaatagctgagccgaacagtaatactgtttaaaggtctatcagaaactgccaagctgcttctcacaatggctgaactaatttacattcccatcagcagtggatatgcattcctttttattacaacatcgccagcataagttat

SEQ ID NO: 506118 - DNA, 1807 bp, Homo sapiens
  misc_feature (256)..(256): n is a, c, g, or t
  misc_feature (290)..(290): n is a, c, g, or t
  misc_feature (306)..(306): n is a, c, g, or t
  misc_feature (318)..(318): n is a, c, g, or t
ggggagtggcgtgctgggcgtgcgcggtgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgntctgctgagaaagatgaacaaatttcttggtccnaaaacaatgtatttcnaaacgtgcccgntcgggcctttcccgtattgctcacttggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttatcg

SEQ ID NO: 506119 - DNA, 597 bp, Homo sapiens
  misc_feature (468)..(468): n is a, c, g, or t
  misc_feature (479)..(479): n is a, c, g, or t
  misc_feature (484)..(485): n is a, c, g, or t
  misc_feature (571)..(571): n is a, c, g, or t
ggggagtggcgtgctgggcgtgcgcggtgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagttccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaacctgaatttacncagtttgcttnattgnnttttcaaacaaatgaaaaaaaaacttatttaggaaggattttttttaaaaaaccacactaatatatccctcctccaacatcccggnccccctcccgcccacacccttatccc

SEQ ID NO: 506120 - DNA, 992 bp, Homo sapiens
gggagatggacgaccacggggggaaacatgggccaacaaggagttaacaaccggcagtgctagcccgaaagtataaccatgggagcctccgaaaccacgtcccgggggcagaacgcctacaacgtgggaaggagcctggcatacgcccagggcagaccgcgtcacacagggagaagcacccggcggaacacccactttgggggcgggaccaccccagattttcctcctaagattcccctgaggaaatgagtgtgtgggaaacactctgtggccacgtcaaattccacggggagccccccatccaaaatgagctttctttttgagaattgtgcccggaaccccaaaccgcgagtgtttcccagaaaacttcggggattattctcgggcccccgtaatgcccttgtggagacaccaccctttcccccgtgggggcctcacaaagaaactgtgtgtgttgtgtttgctccgccgaccacaccacgcaactgcgcaacacaggggcttgtgtcaaacagttggccacagaagaggttgacctgggatttattttagccctgctattttattggtagaattcaacagctctttccccactcaggtcttttcctggatggtctggcttccccctccacgattggccactcgaggagtttgccgacaacgctgctcccccccccggggaacactgattacactgagccccacgggttcccagtgtgttggaacctgtggtgcccccacgttccccaagcccacttccttcgcactttgattatgttcttgagttttctccctcgtctacgttgtggaccaccacccgactgaattttaaaatgggttttttggaaaaaccaatttggccaaagttatttttttgggaggaaggaggacccagcttttgtgggactgggtagggtatagatatcactcctgagttccactgtttttgaattttacccagacaattgaaccttgtttttaaggtgccacca

SEQ ID NO: 506121 - DNA, 301 bp, Homo sapiens
  misc_feature (53)..(53): n is a, c, g, or t
  misc_feature (273)..(273): n is a, c, g, or t
  misc_feature (279)..(279): n is a, c, g, or t
tagagacagggtttcaccatattggccaggctggtctcgaactctggcctcanagtcctgacctcaagtgatccacccgcctcggccgtcccaaagtgctgggattacaggcataagcaccccgcccggcccaggcctatgttcttaaacacagagtttgccttaatgaagaaatggttatgaaggatctttattaggtaataaagaaatgacctaaacatcctattcagtatcttcctgcgctggttgcttttttctcacccatttttaaantatggnaaaataccatgtaaccatgaaa

SEQ ID NO: 506122 - DNA, 108 bp, Homo sapiens
tcctccaggaaacagactatactactctgattaaagccaccaactttattggtggtttgcaatatctctacattgagactatacgtctgctgccatatcattgtattt

SEQ ID NO: 506123 - DNA, 651 bp, Homo sapiens
  misc_feature (522)..(522): n is a, c, g, or t
  misc_feature (533)..(533): n is a, c, g, or t
  misc_feature (538)..(539): n is a, c, g, or t
  misc_feature (625)..(625): n is a, c, g, or t
ggggagtggcgtgctgggcgtgcgcggtgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaacctgaatttacncagtttgcttnattgnnttttcaaacaaatgaaaaaaaaacttatttaggaaggattttttttaaaaaaccacactaatatatccctcctccaacatcccggnccccctcccgcccacacccttatccc

SEQ ID NO: 506124 - DNA, 315 bp, Homo sapiens
  misc_feature (254)..(254): n is a, c, g, or t
gtggtgtctagaggactagtatgtatacagctcgcatagtatcagtggcacagatctgaacatgtacagatccctggatctgatggctgagcagctgtgagcagtactgctgacatcatgtgatgaggcagcttctggtacaggatctaagctctatgtttctatacattatcatctgtactttgcactcactttacacaagaggaaactatgcaaagttagctggatcgctcaaggtcactttaggtaagttnggcaagtccatgcttcccactcagctcctcaggtcagcaagtctacttctctgcctatttt

SEQ ID NO: 506125 - DNA, 682 bp, Homo sapiens
  misc_feature (1)..(1): n is a, c, g, or t
  misc_feature (553)..(553): n is a, c, g, or t
  misc_feature (564)..(564): n is a, c, g, or t
  misc_feature (569)..(570): n is a, c, g, or t
  misc_feature (656)..(656): n is a, c, g, or t
ntctttttgggcatcagcgccccctgggtgggccaacgaattcggccttatggccgggggctgttctgcttgttggtggcagaggcccagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagtgaggaatgtgtttactgtgtacatggtttactagaaatgtttattgattatatttccagctttaattttcttgagtaatttaacctgaatttacncagtttgcttnattgnnttttcaaacaaatgaaaaaaaaacttatttaggaaggattttttttaaaaaaccacactaatatatccctcctccaacatcccggnccccctcccgcccacacccttatccc

SEQ ID NO: 506126 - DNA, 322 bp, Homo sapiens
ttgaggatcccgatcacgtgcattgtgcacattcaaagctgacagtgtctcagagaacgaaggaactttatcttggagcctttcaagccgccagatggtccttgtcattcagggccccacacacacacttggttcttatcgtagctgctgatttcagcccagcaggcttctttctactgaggcttccgctgtaagctttctcatacctactcctcttcattatccgaaagctaagaaaggaactggaggccaaatttttctcttcttgggccggggatatccgtccagccgggtgagaccctggctttttaccaatcggatt

SEQ ID NO: 506127 - DNA, 850 bp, Homo sapiens
gacgggatctgagcgttgagaggcctcatgatggggcacccatggtatgcattatgccccaaatgggaatgcaccctatgggtcagagagcgaatatgcctcctgatagctcatgtgaattgatgccgtcagaatgatgcctcccttatggtgaagggctcaaacaatgggatcaacattgtccatggcaatgattgtcgctcaagttagatgctctgtgaatgtatgactcgtcctctgatatagtctacaggcgttcccatgccagcctagctcagttcatcagcccagcgcagtcaacattagtcatgcgatgtcagccagctaggtacaagctatcatggtgctcaaaatcgcaatgtggacattgcaactcatcaaatcaaccttgattggccataggcacttgactattgacaacactagaagaccaaattatgtctagctcgggcagaaaccagcatgatctttaaaacgacctagcttgcagccacactcttacatctaaaatattgcccctggctacagggaatcaccaacatcaagattgcttggtaaaagccttactaattattaatttctcaagatcaacaagaacactcggctgggtccaaaacctacagaacttgaggactctttgaaggattaccagaattaccagttgttgctggaagtccttacttcagcaacaacttcaaagccctggctatgcagatgacttcaaaagtctgtacgaacactgcagtaacgcaagaaaagaagtgcaccaaaacagtcaacgaggtcccagatcccttaaaaacagaacattcccgagcaacaatgaagcacatggctggtgccggaagca

SEQ ID NO: 506128 - DNA, 350 bp, Homo sapiens
cgactgctcttgtgagttgaaagcaaccattggcagcttgcaggtgtgtgtgtgtttgtatgtttgtgtgtgtgtgtgtgtgactatgtttccacagtcctctcctgtaagtcattcccctgcttattctcctttgccacactagtcgacacatgttaccattccagcagttgagtgctgcacaatctagagtctgcatcacattaaggcagggtcactgaagtggccctcacaatcatctcagagatttgcagcaacaggaagtgtaattgacctaggttcccagctgctgttctgaaatccaaaacccatttcttcaggctgcctcaaaccagagactatgtcgacgc

SEQ ID NO: 506129 - DNA, 1753 bp, Homo sapiens
  misc_feature (256)..(256): n is a, c, g, or t
  misc_feature (290)..(290): n is a, c, g, or t
  misc_feature (306)..(306): n is a, c, g, or t
  misc_feature (318)..(318): n is a, c, g, or t
ggggagtggcgtgctgggcgtgcgcggtgcggtacggcgtgttggtcccagcggttcagctgaggtagggacgtgctgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttagttattcagaggctgntctgctgagaaagatgaacaaatttcttggtccnaaaacaatgtatttcnaaacgtgcccgntcgggcctttcccgtattgctcacttggtgctgggaagacaacacttctgaactatattttgacagagcaacatagttccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattagcagaccctggtgcagtggcttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatgccattctcattaataaaacagacctggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacgtttccaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacagttatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttatcg

SEQ ID NO: 506130 - DNA, 441 bp, Homo sapiens
aatagcagtggtgagagagcgcatacctggtcttgtgcccattttcatagggaatgcttccagttatagcccattcagtgtgatactggctgtcgtgttcgtcatctgcttgctcctgtgataaagagatacgtcccatcgatacctaatatattgagagtccgagcgtgaagtgttgtcgtatgtcgtcctagctcctgtctgaatctaatgagataatcatgtggttttggtctttggttctgtttatacgctggattacatttactgattagcgtatattgaaccacccttgcatcccagggatgaagcccacttgatcatggtgggtaagcttttcgatgtgctgctggattcggtttggcagtattttattgaggatttttgcatcaatgttcatcaaggatattggtctaaaattctctttaaaggtagtgtctc

SEQ ID NO: 506131 - DNA, 210 bp, Homo sapiens
ctttttttaaaagttaaaaggtttgggtaaagaaatttttaaggtaaagatgatgattttgaaaaattttatatattcctaaaaggcaggggctttttcttatcccaaatatttaaacttccagatggaaattgcccaatgggcaaattgttaaggccccccctttacccagcctttcaaaaagcaataaaattgcccctgtttttccca

SEQ ID NO: 506132 - DNA, 114 bp, Homo sapiens
ctgggatagctgtttctgcggaaggccaaaatcaagagtgagatcgtagaaagttgtataatagaagacgtggagttgctgaatcgacttgttcttgtcctcacatttggatta

SEQ ID NO: 506133 - DNA, 773 bp, Homo sapiens
cctgctcccggggcgagcgcgcagccccgagcccgccccgcgcctcccggtacgctcccccccgtctgctcccatgcgcgcgggtgggtcatgagcacagcgccctcgctttctgccctaagaagctgtaaggcacagctggcgtgcggtggcggcggctggctgagatggcggctggtgctagacccatgtcctggaccagcgctgctctctggaattagctccgggccccggcccagggctcgtccccggccgagaagcaccaagccgttttgtgcacgccgtgccccccctctctgacgcaccgcgtgcgccaggccaacctgggctgaccaaatcaatggtgctgaatgatgcttgactggcacagaactgggcgcactagttttgcaccaccggaagtaaccatgcaagccccgttgcacttccaacgcggggtcagggccaccaatcggaggctcggatgccaaggaaagagtcccgttgtggcgcttgattgccgtcaaatgatgttccgtcagatcggggaaggcccgtatcgccctcgcccttccttccaagaactctccgtcggttggcactccaaccgtgggtgcggacagacggaaagggttgcccggacgagaggatgctagcgtgcggaacaagagacaccaaattcgggccccctgaagactaacgaagatcgggtgaaaagaaaggtcagtacaaaccgtaactccaaccggtcgataaaagaaccgagaagagaagagaacaaacccggaagagac

SEQ ID NO: 506134 - DNA, 496 bp, Homo sapiens
taattgtacgggtgcacaaagcataccatataggatggcacacttaatcaattaatgttgaatagtagtactgactaatccaacaaccagccgtttccctgtctctctccctctcctagggcttccctattccaagacacagtaatactgcaatgaggccaattaataaacctacagtgcacaataagtgtacaagtaaaaggaaaagatgcatgtctctcactttaaatcataagctagaaatgattaagcttagtgaagaaggcacaggaaaagccaagataggtcgaaagctaagtctctcatactgagcagccaaggtacgaatgcaaaggaaaagttcttgacggatattaacaatgccattccagggaaccacaaatgaacagaaaggtacacacccttattgctgatatccaagttatggtggtctgggtagatcaaactagccacaacatacccatgggtgaaagcccaatccagagcaagggcccta

SEQ ID NO: 506135 - DNA, 434 bp, Homo sapiens
cgtaggacgcatgaaggtccctcgtggtgagggtacatgcctcccccatttccccagtagagagggaaaatcctaagaccggggaactccaaaaatgagtgtttggagcgcttcagttcacctttaaaggccagggcgggccccccgtgggtgggggcctcgttccagtggcggcacgtccttgggggtttttaatgtttccagcccaagggggggcccttttttaaaaataaaaagggggggtatttttatttttttttggaaagggatttttggtcttctgttgaccttcgggggggtcctgttttgccctgtggccaatgtgagatcggggggttttcctgatgttttcccggggcttgggggttggacccggggcccgcccccgtaatgccttgcctggaccaatgtaataaaaagccccttttttttta

SEQ ID NO: 506136 - DNA, 435 bp, Homo sapiens
gcgcgtgcacgctgatgctgctggtcgtctctagagttccccggtaccctatcgaccgcattgcttaccacagtgtcattgtcattcattatcattttcagcacagaataacctacagaaatgtcttctgtgtactttcccctgcttattttgtgattctgttgcgtctggtgactgcacatctcttttccatggcctctcttgaatcaattttatctccaatctgccttatcatgggtactctaacaagaaagcaaaccaggaaagttcagctggtctagcatcttctgagacagcgaattatctcactgttgatgtggaccaagagcctcttgcagaatgactatactctactctgagaatctgggtcccagctttttttttttaaatccaaagagacgtatatacttaaaaaaccggagtcccagcctagct

SEQ ID NO: 506137 - DNA, 94 bp, Homo sapiens
tcctttgaacattacaatggctatatctagctgggattagaggcgtgagccactgtgctctgggatcagcactgatttgcgtgcctaaactcac

SEQ ID NO: 506138 - DNA, 772 bp, Homo sapiens
ggatctcagactgctgtgctagcaatcagcgagactccctgtgagtaggaccctccgagccaggtgcggcttataatctcgtggtgcgccgtattttaagccggtcggaaaagcgcagtattcgagtgggagtgacccgattttccaggttgatttttcgagtagtgaaccagctttgcattcctgggcaatgcttacacacaggacatagttcacggacaggcattagaaggcatacgagtcacaaacgtgaataacgaactggtcttcttacactaatgcagggactggaagaagatacttggcaaacaatcacgggacagacgtgcacgaccgactacttcaaaaaatcggggacagcttttcatcataaggtccacgcaaagattcctgagcctgagtctactgacaaatataccaaatccccagagtaagttggagtctcttaaaacttgtcttgctggcatctacgcggagattgtccccacaagcatgttccttcatgacggatgcctgggtcagaccacctaattacattccttttaataagcacaaagattctgaagaagcactgaccctcccacgtgtcacactctggggagagatcattggaatgctcttgagatcaggctctctccaggagaatcatttccactaagtctagatgtccgctggtgatagcctatagcgctgctccaggctaatgtaaccagatttcccaggattgtgcattaccaggctacaaatcactcaacaatctggacacggtccc

SEQ ID NO: 506139 - DNA, 315 bp, Homo sapiens
  misc_feature (162)..(163): n is a, c, g, or t
tttttttttttgggggaattttttcccccccccttttccccccccgggggtttttaaaaaggggttccggaaaaaccccccctttgggggtggggggtttttttgggggttcccccaacccctcccgggatttttccaaatttttgggggggcccctggttnncgggcaaaggggggggggcccaaaatcccccggttttttgggggattccccaattattaaaactttggggtttcccccccttttttttttttggggggccccccgggggggccccccccaaaaagggggttttgggggggggtttcctggga

SEQ ID NO: 506140 - DNA, 866 bp, Homo sapiens
cgtacatagtcaagtactcttggccgggcatggtggctcatgcctgtaatcccagcacttgcggggaggccaaggcagtgcggatcacatgaggccaggaattcgagaccaacctggtcagcatgtgctaaaacccgtctctactaaaagtacaaaaattagccaggcgtgatggcacgtgtctgtaatcccagctactctggagactgacgtgggagaatcgcttgagactgggaggcagaggttgcagtgaaccgagatcatgccaccgcacttcagtctgggtgacagagaaggactccgtctcaaaaaaaaaagaaaaaagaatagtcatttttaaactacctatctcatgccatgacagcattttcttccacaaagagcttactcctcatgataggattgcctagtgtctcccatatagcaggttactgggcttgatagtcttaatgcactaatactgccaattgacaatcagctgtgctgtgatgcttcgcaaataggtctgctcctcacagcctttgggactctgactggcccgacgaccagagagcaagttaacaaccctccactggggccaacctctgctgaacacgtaggcccttaagtactaggacacatatactgtgccggtactagcctggcgtacgaacagtacactcgcccgaaacctcagctcaggtaaatcttacacgctactaacaacttcgggccagggcctatatatagaggtaatatccacattcaccatactacaaacccgtctaaactctggtacactctatcgccatcaaagcgaaatcggaaattctataacccgttaccccacagatttcatctcgcactatccctatcctaacctcctg

SEQ ID NO: 506141 - DNA, 131 bp, Homo sapiens
gctgtacagtctgtagggtcctgtctctctttatgtggtttctttttttcccatttacattaccagagtcttcttcagcctggacaggggccaccaggcaaacttggtgttgtaaatgggaaaaaaagaaa

SEQ ID NO: 506142 - DNA, 920 bp, Homo sapiens
  misc_feature (920)..(920): n is a, c, g, or t
atgacccaccatattcacttgccttatcatatagtaaaacccatcccatgacctactaactagggagctccttcttcgagtcactcctaatgatcctccgcgtcactaatcgcactgatgaattgtcacatatcacatcatccataatcgcatccatcatacatatcgtcatactaactcaaaaaactaatcactataccgaatgattggtcgtcgatgttaaggacgtagaaaagtcctctattgaccgaaggtgccacacaacacacgcagcgtgtctcagaaaaaggctcattcgtatactgggcataaatccttattgtgatttacgctactagacaatattcatatatcttacgaccgtgacatcttatactggtaaaccctattttaatcaacttccagaccatagtacctcttaactaccccacagtgtatcggtaaaaggtctatcatgagacacaccaacaatggtttatttgcaacctccaggcattaaaaattcaaccataaaaagcttaccaatttctctttatacattacaattcgcggtctaatcaacattcggtctattaaaggcgaagatattccaacttcacacacttgcagatttctaggaccattgtattgtcccctcaaaatacgcatagatatcaatatccgggaaacaccccaataattaaatttccaccacgcctccttgatgttagtttaaccacattactctttagatgtgtcgcgttatccctttagtttatgaacacccgtctcgtgacaaaaggcccattcaagcacaggtactattccgaaggttgtaccccctttcaaatcaatttgtagccagagacagcggtattatacaccgggctcataacagtatatattgttccggtatagccaaaaaatgtgcttttccaatn

SEQ ID NO: 506143 - DNA, 212 bp, Homo sapiens
ttggccccttaccccttaaaaaggttttttattttttaatgttttgaaaaatcaagcttgggggagaaagcagggcaagagggttattaaaagcaggttgggtttttttgcccctttcaccccccccaggaaaaaaaagttcggggttaacagtgacaggggtatcacatcatttgaaaaaattttttccttttaaaattaaaaaaaaaaaa

SEQ ID NO: 506144 - DNA, 402 bp, Homo sapiens
cccctgttgtaagtggcacatgtcacagtgtccatagacactgattttgggcacggagatgcgtctctgtgtagtggtaccggcctttctcatacaggacgtagagctggtgggcctgctcctctccatccatgctgccctccagggttgccaggaatgaatagccactgggggctggtcatagctggactgtctcttcccgccatgaggtaccattgctgaagctccatcgcagggtcaggttcactcggaactctggattgtgctgggtcggagaataacactatgccggagctggtgactacagctccctgcagctaccacagggtccacgacgctcagggtcggaacgtgtcacatcactgggcgccttgctacgtgggtacctcagcgtcgcatttc

SEQ ID NO: 506145 - DNA, 337 bp, Homo sapiens
  misc_feature (312)..(312): n is a, c, g, or t
  misc_feature (315)..(316): n is a, c, g, or t
  misc_feature (319)..(319): n is a, c, g, or t
  misc_feature (321)..(321): n is a, c, g, or t
gctatagagaccctctctgggtgaacatttttgaacatctcagaaagggctgggaaaggttgacttagtcccttctgccttccgctgcccccgcaatgctctttcattttatgaagaaggaaacagcaaggactctgacttctctgttatctcagaaaagagctgaaattatccctcaacctcaacctcaggttgcagacacggcaggtcagagaggagtttttctgcagagggtggtcagggaggagaggggttagcttagaggacagggccagacctactcataaggtatttctaatgtagcgaaacacntcnnccngncgcgaatttagtagta

SEQ ID NO: 506146 - DNA, 139 bp, Homo sapiens
atctagaggatcccttaaatgggcacagaaatgaaaaataatagcttccagttcagatatagaacagcaattacagaaaaattggaagagggtcaatgaaccagtgggatggcacccagcatggcgttgagctaaagac

SEQ ID NO: 506147 - DNA, 482 bp, Homo sapiens
ggaacaaagaatatataaaacaaccagaaaataatcaataaaataacaggagtatgccctcacctattcataataaccttgcatgtaaacagattaaattccatatttaaaagatataaactggctaaatggattaaaaaaaaaaaaacaagacctaactatatgcggcctataagaaactcacctcacctataaagacacaaatagggctaaaaggtgaagagatgggaaaaagggtattccatggcaaattaggaaaccaaaaggtggagcagggaatagctatatggtatttttggagcaaaacaaattttagggtcaaaagctggtaagaacaggacaaagaagaactttatttaataataaggggataaattagggaagaaaatataacaatggtaagtatttttgcacccaacatgggaacactcagatttataaagccaatattattagatctaaagagagagataaagggaaat

SEQ ID NO: 506148 - DNA, 223 bp, Homo sapiens
ctttgcgaggcagtctcgctctgtcatccaggcctgagtgccgtggcgccatcttggctcattgcacctccgcctcctgggttcaaaagattcttctgcctcaagctcctcagtagctgggactatttgcgcgttgcaccatggccaggtaatttttttggcattttaagtacagacagggtttccattattgttagcccaaagatgggtctccatcttccct

SEQ ID NO: 506149 - DNA, 1727 bp, Homo sapiens
ctcgccaaactgcaggcacaagtgcagcattggtgaggaaaggaactgctcgcacaaagaagacggtggttcatagaacagcccacagcagcatgcacacaaaaacattcagcttctccattaacagcacagctctcagctgctggtcacaacaatcatcatctaggtcattgcacagcaggctgacatcatgttataccaacacccaaggcacaccagttgatccacctatataagcaacaccctaccacgctacacaggccaatcatcatgcgccagaccgacacacatctaacagcacagtataacacgagtcacaccttggctatgaagaccacaaagcacggcgtgaccacgaacacctgacagtcaaccacaatggcgagtacatatgtaccacacacaccaaggaccttctgagcgtggcagcgaagctcagactcacctagacagcaataaagaatatagaacagagtatactgtcacattgaagagcaacagacacaagcacaactcatgacaccacaacaagacccacaactaccactgatgacgcacatgtagacaacaccacaggcagaagcccaaccatctgaccataaacactggagacacgcaagcaggcacactggcactatgacacatgcaaacttcagagcacacaggacacatccccaacacgacactccgactgatgacacatgagcacggacacaacaaatacacatgcacatcagcgacatgacggaccaacattcacaccacaacacaatagcaataaaaaatgtttgacacagactgtgaacccatcacacaaaccactattgaacacgcaattatacgcaaaccaccactacccacaaacacaactatatacacaataaaaacacccaacagcatacaaccagcacacaccacactagcaacacactgtagaacaaaaaagattatcacaacacatatgtaccaagctaacaacacatcatggaaacaatacacaaatgaacattactaactattcaactatcaacagccttggcacacccacaagtagtgaccaatatcatatacacaggacatcaaaactgacatacacacttaccacgatctagatcataatgaattgggatacacttagcaataaactatgggaggagaagacttaaccgagtatcgagcgaagttcagcaaaacaacagaagttctcgaattcagaggaaaaacagttgcaaacttaacaattcaacaagacctgcatacagaattcaaaccataaagacaagacaggagacgaacagcgacatcgacaagcactaccacacacacaattatgagaagagactacgccgaacacagatgaagaatacacagccacactcaagcatattaatgaataagccaaagaaagcaaacaaaacacgacagataggcacacatagtaaagataacacagatacgaaaaatgctagtacaaaaaagatataacatagtatagatgacgaacaagagagaacgcatcgaagactacgtagcaaaatacagagaaccacataacaaactgcaaacaagacaacaactagatgaggaagagcaacactcttacaaacactaagtcagtaaataaagtggaaaataacacacaaagaaacacaagagacgactacatagactacacgtcacaacagacagagatgacacacaacagaacatacgggacaccacataaa

SEQ ID NO: 506150 - DNA, 322 bp, Homo sapiens
ctaattggttcttcgatgacgtggctccagaacaaggcaaaaaaaaaaaaaaaaaaaaaaaaaaaaaaaaaaacccccccccctttaaaagcctttttttgggggggctcttccctttggggggggaaacccttgccaaaaactgggggggagctcgggggtccaaaggggtcctattacctcccccaaggggggactcaagtttttcccccttttttgagggggcccccccctcgaccccccaaaggggggggtcttataaaaaaaacatgtgggggtgctttttaaaaaccccccgggggcatacaacgttgggactggg

SEQ ID NO: 506151 - DNA, 323 bp, Homo sapiens
gtggattgaccactgggagtctcgttcactcagtgctcaatggtgcccaggctggagtgcagtggcatgatctcggctcgctacaacctccacctcccagccgcctgccttggcctcccaaagtgccgagactgcaacctctgcccggccgccaccccgtctgggaagtgaggagcgtctctgcctggccgcccatcatctgggatgtgaggagcccctctgcctggctgcccagtctgtaaagtgaggagcgtctccgcccatccgccatcccacttaggaagtgaggagcacctcttcccgggcgccatcacttctaggga

SEQ ID NO: 506152 - DNA, 148 bp, Homo sapiens
gacgagactataaggattaggagtctctctaccttacggtcttctccatactttagtcagtgaacatgctcggcagtccatttttagaaatacttggaactggatgtgatgcaaattgacgacagggcctgcaacatcacatttttct

SEQ ID NO: 506153 - DNA, 459 bp, Homo sapiens
  misc_feature (6)..(6): n is a, c, g, or t
  misc_feature (12)..(12): n is a, c, g, or t
  misc_feature (42)..(42): n is a, c, g, or t
  misc_feature (52)..(52): n is a, c, g, or t
  misc_feature (55)..(55): n is a, c, g, or t
  misc_feature (73)..(73): n is a, c, g, or t
  misc_feature (95)..(95): n is a, c, g, or t
aggggncggganttcttcacccccggccagctgccggcttgnatttgaaaanggntatgtggcccctctgganctgacttccaacccaaaatggncatgggtctttgaaaaatgtactttagcacacccctgtggaacgtgtttacttaaggattttaccccttgctttagaagtgagaatgtgactacagatggactgcccctcactgaaggcatttgctgcgaatgtgtcttctgctaatatgtttaaggatctataatgaaaacagagtcattctgaaataaaaggacattgacataaaaagcagtaatggttgacgctatctgtttttgaagataagggttttgtcacaaaggcacgatttatggtgggaatactgaatagcgggagtgtggcaggtgataaatcactgttctcaccactggatatggagaaaaaagggatacaaagacctttta

SEQ ID NO: 506154 - DNA, 193 bp, Homo sapiens
ggcagctgggtgctcgcaggacgctggcaccccgggcctggtccagaggccgctgcccaccagcataggcagaagctgctctggagtcccagtggagaatctcagcagcgtagccctgcgcttgaggcattggctttccccgccaacccccggcacacagagaagctgcttccatgccctcttgaggccaggc

SEQ ID NO: 506155 - DNA, 314 bp, Homo sapiens
ccgtatattcggtgagcctagggtgtcgtgagtgtaaactagatgcgatagagtaagggaagggagcctactagagtgtacaatagagaagtatgtgcctgcgttcaggcgttctggctggttgcctcatcgggtgatgatagccaaggtgaggataagtgtggtttcgaagaatatatcacacaatatgattcagttctgtggctgtgaatgttataattaaggagatttgtagggagattagtcatagagaggtagcagtttttttcgtgatagtggttcactgaataagtggcgttggctcacgaatatac

SEQ ID NO: 506156 - DNA, 441 bp, Homo sapiens
agtctaaaggatccctcagcgcttatacttcccagttcatacttaatattatacttgaattcaatacggaagtataaagcgttgaggaagtataaagcgttgagaaagtataaagcgttgagctcaacgctttatacttcactgcagcctttttttccttcttttttttttttttttggcataggccaaattttggcttaaaataccaccatttggtccacactagaaatttcttggacccaacttacattttttcaaatgtaagtttcaaaaatagggtttaaattggctcaaacggtgggtctagggatccgtgaataagtgcaagtatttaactttataaaggggggactggtcttgggggctgggtttggcacactttttttttttaaatatcctcaaacaggtgacttcacaaattttccttaaaatgggggtgag

SEQ ID NO: 506157 - DNA, 908 bp, Homo sapiens
gatttctgttcggggccactctcatccgtggacacggatgatgtacgtccgcgatgattgcaaggtgtgcagatttgcgcaaatcctaaatgtcataaaaactttaaaaagaagcgctaagtcctcgcatagagttatggtgggacctataagcatttcgggaagagcatgctgtgtagagagcttcaaagtggatatattcatttgaagtttgataataaggtaggaaatgaacctgatggcaaataccatgacgagagatatggatctagaagtaatgatgcggatgaagagatgttgaatgaaaattcaaaatagaaagctgccaagtgtaaatgttaataatggaccgagattgaaagaagaagtaagagagctagagaaagttcaggataatcataagaaggtcgagagcaaaaaatgcatcgtataatctgagtccttctctttgcacggcaaatagtggaagctagtgtggaaagagaaaatggtacagcacgttacaagaggatgtggagttgggaaagatgctccgtaaaaaatctctgtaacctattactcttagtgtaccagttttgaaaatgctcttggaatagtggggaaactggtaaattattatgaattttttaacattgaggtcatttaccttgacatcggttgaaatgactctttcttggttgcatttacgtatatgagatataacgggatgaggctggcatctcagtgtactttcagggtggggttacgtaaacttggaatttacttgactatggaggactggggagaaaggggggcatggagggctggggttgttgatcttggcaaccggggtggtcaaaaatttgggaaaccttgagagaagggacacaacaactttgggagtttaaacgggggtaaacaatggagtg

SEQ ID NO: 506158 - DNA, 421 bp, Homo sapiens
aactgccataatagcctatatctgtgcaccagaccctccattcctgcttcctgagacccgggaatggcgaattaccctgtggactccttgtgccctccctgttcaggatatcagcacagagggacgaaggcaactgcctaccctgcttgagagatgcacaggcctggtgcgaagttagcagaattatgagattggatcagcctggatcactgaatcactgcatgtacgacacactatgcagagtttattgtgccaagatcagacatggtatatgcaagaatgaatgtttgcgagaatcataacaaactataatcgggcacataccactgacatcatagaccataaagcaatacccactcggtgacttgggcaacgatcgaggctatacttacctacagacttttagactgtccccctgtgg

SEQ ID NO: 506159 - DNA, 143 bp, Homo sapiens
tacatcttcagtataaaccttcacttgttgaactacgaaggaaagcacgtaccacaaagggacctggagaacggggatgagaatcaactttgatttttataccgcaataccacctcatgagcaaataaagcaggtcctcactt

SEQ ID NO: 506160 - DNA, 986 bp, Homo sapiens
  misc_feature (61)..(61): n is a, c, g, or t
  misc_feature (95)..(95): n is a, c, g, or t
  misc_feature (182)..(182): n is a, c, g, or t
  misc_feature (613)..(613): n is a, c, g, or t
  misc_feature (635)..(636): n is a, c, g, or t
cagctgaaaaatgagactgctagaagggctggatggttgatgcttaaagagcaccctcttntgagggtagagggagatagatggagatgtaggcnatttagagggtcagcaaatgatttttaggggaaatgaaagagcccaaggaacaaacagttggcctgagacaaagttcctctgaggtnatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggagagagatcagtatgtcaaaagtctgtacttggtaagaatttggctgctaagttgtgccataatttgtcttttgagccttttttcctttgggtaagttgagctctacattttgtcttgccattcatgacagtaaaaatgtggttgtctgggggctgaacctccttctgaacaatgatccaagataaaagtactaataccacaatgcttttttatattcaagggaagaggaagtatgtttcagttttaccncctagataattacacgtcattnngcactgcctttcaagatatgtagaaaacagaaaatatatgagttatgaagatatctaggcacatttaacattctctatgccacttagtcctgaacagagagattttcggtataatggaggaagcttttttttggtctttttctcaccccccaaggaggagtctccctctgttgcccaggctggggtataatggtggtgatctcgggtcgtggaagctcaacctcctgggttcaggtgattccctgctcggctctcaaggtggcgggattggggtgccacacagcccagtaattgggttttacggccggggttccagttggcgggtttcaacggctgggtcccgcggggca

SEQ ID NO: 506161 - DNA, 298 bp, Homo sapiens
caatccacacttaggaaaggacttcggattggagttcagggccttaggttccaattcccagttttccggacagttcccagtgtattcttggccaggtcattgaccctttttggttcttgtttccctaccttttaggggattgttattcttaggcccttttccattgttttaagaatcaggttattgcttttgaaatttttcattttcctttaaagtttgattaatatattttctttttcttggattccctttttccctttgagccttgtaaattaacccttgttttgattggttgtta

SEQ ID NO: 506162 - DNA, 296 bp, Homo sapiens
gcatgtacagatccaacatcagaggtcgaaaaccctatagtcgatatggactacaagaaataggatcgcagcgtactccctagggtcacttgatccgttggacacgttattggcatcaattgagtatcagtcaacgctttgcactggtgaagtcttcacatgtactgctcggaggttgggttctgctccgaggtcgccccaaccgaaatttttaatgcaggtttggtagtttaggcacctgtgggttcgttaggtcctgttggcattaataaattaaagctccatagggtctcctc

SEQ ID NO: 506163 - DNA, 284 bp, Homo sapiens
cacgagggcggtcttcactgcggtcatgaaagacctgaactctgagctgtgcgcgcggctccagctccagaaatcccattatttgtttctgggccccacccgaggccactactatggcgggtccctgcccaacgtgaagcatatcgtgagtggcaccatggtgctgcccttccagacccccttctaatcctcgggtctggagaccaacctgcccacccgggaccatgggctggtggacatggtgtatctggagcgtggtcggatcgacttcacaaaccgacggg

SEQ ID NO: 506164 - DNA, 1290 bp, Homo sapiens
cgtctttgttactcttgctttatgctggcgcgtactgcgccttgctggcagcgttgcgtaattgttcgtttctcccggggttgatctcgcggtttgttccccgtgcctctcggtctcgtttcccgcccctgtgtgtcggtgtatgtctccttgtcggactcttttggaagagatatttcgcgcccgtatccatttttggggctttcacaaggttctcgtgccccatttgggcctttttgggatgggtaacccccccaaagtgctctcccgaaaccggtgcccacgtaagccattaggcacacttcctggggagccacgaactgtggtttgaagacccctgtgagaaatactgggagttaaacgttctttggatgggcgacctttaccacaaagggatcccgcgtcgttacacggtcccacgaaagatggttaacccgcggagaggttagttatacttgacctgattaaacacgtgtgttccccggtggcaccgggaaaccctgtatgggatttcacgccttttatctaatatggtaaaaattttgtttggtcaccctcccccccgagggttgatgacaccacgcccaatcccacaccctgggggggaatcaagagcctttttaaaattgaatgggagaactattatgtttgataaaaagtatacctggcgacgatagaattccccgtccacctcacgtgtaaaaccccctgggttaacctcgagaaatcactgaaataaattaaataaggttttctgaatttatcccaaatgggcccacctcggagacacttcacttcctggcacacctgccccttacccgaggcgcgctccccttgaatgtggcacaggagcctgtgaataaggagtctccacggggaaacccacgagagggcacaggataaataaaaggtttggaaaagaatcttttaaatctctgacacgctgaaagtgggctggttaaactccgcgccaagtgggtgaacttccactcacggtaattatattcgaaggtggagggagcaatatttttatccctattgagccacgccttctgaagaagcttttgagacacatgaattaatcgagttcacatttattgggaaaaggagtgggagtcccttatatgttggagttaactatcccttccccacaagaggaacacatcacagagggttttcacttgcctggaaaagaaaaatcgtataaacacgaaaaatgtcacatagggataaaaaaattatcttttcatatctgccagatttttttcatccataaaaattatcccttga

SEQ ID NO: 506165 - DNA, 183 bp, Homo sapiens
cccaaaaaaaaaaaaaaaaaaggggggaaaggattttttcctttgttgggcctttcccttcagaactccaaaggggtcatgccctttttccaaaaaagttcccctgttaaggtttgtttttgtccccccccttaataaagggtctcgttggccttttttttcctgaaatttttttgtccccca

SEQ ID NO: 506166 - DNA, 430 bp, Homo sapiens
ggatccctgtgtatcgatgcgctggtggatgctgattgcgttgtacagaacaacctccgccttgagggcacattcttgagcgtcgaccagcaggtcaacggagcctggacgcgcgtcgctccgactcgcaccgtccacgctctaccagtggaaccgcacgaacaccgtatgtcgaactcctcccacattacacccagcaatgcacttatttaccatcgttcctcttcgcagattctgggatacagcgtggtcaacatctcgtggaccattgagcccaacactcccggtgagcatcctttccgttaccttacactgcaacgaatatatattgacgatttctcttgcagccggctcataccgcctcgcttacttcggggacgcgaaggctcccttcacgggcacgatcagccccttcgagggcacctcatcg

SEQ ID NO: 506167 - DNA, 186 bp, Homo sapiens
gggctcacagcttcccaaactgagtgtattttaaagagacagtgaaggtggggcatggtggctcatgcctgtaatcccaagactttgggaggcagaggagggcggatcacctgaggtcaggagttcaagaccagcctgaccaacatggagaaaccccgtctctactaaaaatacaaaaaaattagc

SEQ ID NO: 506168 - DNA, 821 bp, Homo sapiens
catagtcaccattcagctcacctgcattatggaaaccagcaaggtgagtgctttggtgaggaaggtgaaggtgattatctgtatgactggacaggtgctcagttatggaccatatctgggtaagagatgagtgaggtgcggttcaaacactcttccactgagatactgctgtctgtcacaggagaacaatatggtcgacctatcagtgggcaaaaagaggtgcatggcatggcccagacaagtcagaacaactactggaaagccatggaaggcatcttcatgaagcccagtgagttgttgaaggcagaagcccaccatgcagagctgtgaatctagaggctctgagccactgttaacgcacaatgttcacagacatctgttgctgcctcaccttgggatccctgccacaagttccttgggcagtggccagtgtcaccattgcgtatgaagataatacaacaggaaataagtgggctgtgttgtgaaagccttcaagccctgacacatattgaactaggtcactgctcccagagcttgcggtgggtacaggttcttatcttgaagtacgagagacttgcatggtaaaggggcaggatgcttatttattaagtacatgataaaacagaatctgagaggaaacaatcacctcttaagcgtgggagaacttgttacttcttcagagagtcttgcgcatcaatggacgtgttaaatgtatagtgatctttccgccactatttttcttcttcttccaagaaatgaatataaacacacataaattcttaacaaagaaagaaaaaagaaaagtgtcggcgcgggccgcg

SEQ ID NO: 506169 - DNA, 284 bp, Homo sapiens
aatcagagcgaggccgggtctcacaccctgcagtggactgcagtggctgcgagcctggggcccgaccaggcgcttcctacccgcgggtatgaacatgttcgcctactacggcgaggattatctacaccctgaactgaggacctgctgctcctggtaccgcggttggacacgtgcggactcagattctccgacgcaagaagtcaacaatgaatgcctcctgacggcggaggcacctagagaggcctaccgtggaagacacattgacgtggagttggcttccacaa

SEQ ID NO: 506170 - DNA, 996 bp, Homo sapiens
attcttcccctggtcccccccgtcgtctaatctagcagtgtttgcgtgcacactcctcatagtgctgagatcaaacttgaatttccagctgggatgagtgcctgagatgagataaggtagtgactaggggttatatctccagattcttaaccaacccaagaatggggcctcgctcaccagaggaacggtgcccacttgaagcttatttccgtacgggctaggcaaggcgatttcccgtaatctctgctctactgatattagcctagtacctgcgttcatgctaactatgaagtgcatcgcggatcaagtgagactcaatattcccaaaggtatctaccaagtcaaataatcgtcatggattctctcataatgggcttataagacacaatatgagtgagtggaaatagcacaccgcgtgttcactccgtgacgtcccagaaggttgtacccaaggcatcaccacttcttgatcactcacggactgactttgttcttcacatgagatagagctaggccccatctcaactccctatcccaacagtcgtcctccctcagtaaacgataaggtcatccctcccgtcaatcatctctgatctttttccaatcagtagcggcgcagttgacggtggagttaggaccaaacccgcagctagcgcggaatatctgtagtcaatacatcctgagattagccacttatggatgacatattgggatgccctacgtagaaccctacaataaaccagttcttagtctaactattcatattatccttaactactagcgaattctaatactctatttaaattcctgatcaggacactaatagtgttcgcacccgaacaggtagtgaattcccctttgttcatcgacctcgtttcctaggggcgggccggtaccaggttgtgcgcacgggccacgaaaactaacaacggtttccacatttggcgcaccgttacttcaggggcattccccaaaccgtagagaaaaaatggcccc

SEQ ID NO: 506171 - DNA, 653 bp, Homo sapiens
cgagtatatgtcagattgatagttatttatacttaagtatattgcatggctgaaatcatctggatcaggtattctctgtgtatgattcagtttcttacattatgcatattatctttttcttgtgtgtgtcagtttaggttcgttgtatgtaccaatcatctgtcagttttatttagattttcaaatttattagcacaaaattgtgtaaaacaccttatcttttaatatctataatacatgtatagtgatttcttcttcagttttgatattatttatgccttccctctttcttctttcatctcaccaagagtttatcaattttgtaggtctttttactgccctaaaagtcttctgtactctgcctgtgtttaactctggctacccctgcttagttgttactggttatcttttctacttttaaatgttggagtgcccagggctcttctagtcttaagatttctgatgccatttaaatgccatttttgtatgctgatgacattcaaactttgtattttttgcctgtacctcttccctgatctctacttccctaacccctcaatctactccctgatggctcaacttaagaatatatccacaatctgcttacttctttaccacctccactcttataatctggtttgacgcaccattat

SEQ ID NO: 506172 - DNA, 244 bp, Homo sapiens
ggaatcacaatgcttatgtccatgtgcatagtaccttctattatacctctcagcattacttaagtctgcatatcactacacagaaacttaaaggctaaactcgctgggtgccccagcttcctttcaaatcaggcacacaaatgtgtggaggatgctactacggtcaaaaaggaaagaaagacaaaatataagggaaaagtttgcatacgaaagattatctacccttttctttttttacctactt

SEQ ID NO: 506173 - DNA, 147 bp, Homo sapiens
atgtgcatgtgaagctaggtaggtgagaatcacactccgtagcaacaggtctatcatcacagtgtactgcagacacagcaggctagtgagattacacgttaagagagccaggtatgaaaaagtgtcctcgcagacaaaaccagtcgt

SEQ ID NO: 506174 - DNA, 142 bp, Homo sapiens
  misc_feature (105)..(105): n is a, c, g, or t
aaaactccacctgtgaaaatgacaaactggaaacttgcacgtggtctctccctgatttctgctctattcaccttttccctttgctgattttaatctccattcttnttgttgtaataaaccataatggtgaataaaaaaaaaa

SEQ ID NO: 506175 - DNA, 841 bp, Homo sapiens
gctgcggcgcgagccgcgggggcgggtctaagcgcgcttcgcagaagacccccgatcgatgggcgatgccgagatgctcctaaggctccccggggctgacgatgaccggccgaggaggcagcaggcgcttacctccgtcgcaaggcctattcggtgcaccgagaatggccaacgtgtaaagagcgagtggagatttattcctcgcgatggtgtgaagagggagtcgcctcccctgtagatactggtagacaggatgaggcagccgggggcactggcgactgccaatcgaggccagcagcgctcgcgtagccaggtgtgcatgatggcgcatgggttggaggtctcccgcaacggaagacccccacatgaagagtaacgaaatctctcgtttcatcgaagggactttcaacattgagcggcgactgtccattcgaagagagaagtcaggaagggaggggatgggggtgtggagttcggtcgtgctgtctcttcattcgcacaagagagagaagatgcaggagcatgggggaagatacggtgacacttgggggttgacagatgggacagttgtttgggaccggggaaagggggggtagtactaacgcctggatacgtacgaagggacatcccctagggcgcacagggggggtatgacggacatatagtgcaaggcggtcaggataggagacgaagggtagggggttcacccaagggctaccaagatgcccagtcgcgatgtcctttcggggggacggtgagaaagtgggtcgttacgaacgaatggacgcaggttgatgcatgaattggaggaggctggggtagggggcaaggtggaggtgag

SEQ ID NO: 506176 - DNA, 207 bp, Homo sapiens
ttgtatgatgcaaggtgggtctcagaggtgatcggcgatcagtagggcgatgaagttctagatccattgggacaatgctctagactggtagcatgcagtcccactagctggtaccaggcagtccccagcgtctggtattccatgtttctgctccctgtggttctcctggttgccccaaactagcggtttacttggccccttatcgag

SEQ ID NO: 506177 - DNA, 599 bp, Homo sapiens
gacatcgcttttgtgctggcgtgtggtctgtgctggatggaagtctttaacttattcttcttcatgctgctgagagcatctgtgcccctgtctgggggagccatgcatcctctagggctgccgggctggtctcattcacaggtcatggccttcagcaccacttctggctctgtagcgcctgctctgtctccctgcagcttgcgagcaaacttgactttttgccatgctcagacccctgaatcagggcctctgacttttgggatctggtccctttcaatgtcatcacagcggcgctgccagtccaggcccagctgcacctgatcacgctccaggctccgctccctttccactgccagggacagctgttgcttgtacctttcaatgtcctgctgggatcgggccacctgtgccttgagcttcacctcttcttcctgcagcgtctgaatctgaaggtctctggagaccatctccttagatagttgagcaatttgagcatcccaggcagattttacagttgatgcatcttcacgaagttggtcaatggcagcgtccttctccttggcggtgtcagcctgtctccgctctgccctggggagctg

SEQ ID NO: 506178 - DNA, 135 bp, Homo sapiens
aatgcaccggcccgcaggggttgactcccagtgtcacagaggattacagcagttctcatacattgctggtgggaatgtaaaatggtagccgctgtatttcggaaagcagtccagacagtttctcaacaattgcta

SEQ ID NO: 506179 - DNA, 1628 bp, Homo sapiens
  misc_feature (1545)..(1545): n is a, c, g, or t
  misc_feature (1616)..(1616): n is a, c, g, or t
  misc_feature (1618)..(1618): n is a, c, g, or t
  misc_feature (1625)..(1625): n is a, c, g, or t
gaataagccttcgataattatgaagggtgtttcggtatcttccctccaaaatgctaagaaataatttaggcaacagttcagactctaaaaatgaagatggctcggtcttttcacagactgaacacaatattgttgcaacttacttgattatggcaggtatgataagtattatcagcaacataatagttctgggcatcttcattaagtacaaggaacttcggacacccacaaatgcaattattattaacctggctgttactgatataggggtcagtagcattggctatcccatgtctgctgcctcagatctgtatggaagttggaaatttggatacgcaggctgtcaggtttatgctggattgaatattttttttggaatggcaagcattggattactcacggtcgtggctgtggaccgatacctgaccatctgccttcctgacgtagggagaagaatgaccaccaacacttacatcggcttgattctgggagcctggatcaatggcctgttttgggctttgatgcctatcatagggtgggctagttatgccccagatcctactggtgctacgtgtaccataaactggaggaaaaatgatagatcttttgtgtcttacaccatgacagttattgcgataaattttattgtgcccttgacagtgatgttttactgctattaccatgtcacgctatccattaaacatcacactaccagtgactgcactgagtccctcaacagagactggtcagatcagatagatgtaacaaagatgtctgtgatcatgatctgcatgtttctggtggcatggtccccttattccatcgtgtgcttatgggcttcttttggtgacccaaagaagattcctccccccatggccatcatagctccactgtttgcaaaatcttctacattctataacccctgcatttatgtggttgctaataaaaagtttcggagggcaatgcttgccatgttcaaatgtcagactcaccaaacaatgcctgtgacaagtattttacccatggatgtatctcaaaacccattggcttctggaagaatctgaaataagagaaaaggacacgctatcaaaacactttagttttttgacaatgcttttcttttaaatatgagcccatttagatcaagtgcagacatggatcattgtcctatgagagtgtaagctcctcaagcacagctcgtgcttccgtttgtgcactctggctgctgtagtgtatgcttctctgtgtcctgatatatcaacttattgctcatctcctttgatgaattaggcatcagaggttaaggtcccctttctttctccctattatggcatgcattacactgtactgatgacctttaacttgcctggctcctccattagaataaaagcagtcactaatttaatgttagaataaatgaataattctagataattactgaaatgagttgttggatgttcccagttagaatagaaagcattttttgaatttcaacattttaacatttaaatcaattaacttatgttattaaacaaaaataaatgnacattaaacatgattgtttctaaataaaatgttaagtcaatgcatatatattatatagcattatgaccccngntgcatanttt

SEQ ID NO: 506180 - DNA, 240 bp, Homo sapiens
caacaacaacaacaacaacagcaacaacaacaaagacctttccccttttccttaagccctttggtggggagaaagggacttttaaggagttccccccaagggcctttttatttgggaaataggtaaacaagggtgagcccccccctgttgctttaaaaaaaaattaaaaaaagggtgggtttggaggttggatcccctgggccctttgggaaggtcattaaaacctttcccctcctttga

SEQ ID NO: 506181 - DNA, 404 bp, Homo sapiens
gggccggggggcccccccccttcaaggggcaaaaggaaattagtggtttgtgggtttccccccacgcccccccccgggttttaaggaaaacaaaacccattgggggcccctgggccctttaatgcatcccaccttggggttagggttaggccccggggaggaaagggggctccccttttccccccctctaattccccaaaactttaagggggggggttccccccggggggttttttttttttaaaaaccaacccttttaaaaaagggcccggttgggggttttccaaatttttagggaaatgctttgttttggttatttccaagatccccccccgaaaaaattttttttccaaaagtttggggggggggttttttgttttttaaccaaaaattttaatggggga

SEQ ID NO: 506182 - DNA, 320 bp, Homo sapiens
  misc_feature (106)..(106): n is a, c, g, or t
ttttttcttcctcgggtcggtctagccgtggcaacctgaataccacgataaatctgcaccgaatcgaagttgacaacttcgccgccgacagcaagcgcaacacggntcgccagagccgttttccgagatgccgtaggtcccgcaatggctattatcggctttgaatcgctgccgttgtgcataaaaaaccgttctctactacggaaaattatacgcagagcgacaatattacggcacaaagcattcgcctcattatttttttgaagaatttatcgaaatctttccgaggggcctgcgtgtcaccctacctgtagtattat

SEQ ID NO: 506183 - DNA, 597 bp, Homo sapiens
tcgcgaacgtgttactgacattttgtaaagccaaactctaatactatcaaagccatccttggattggagttaaattctccagctttacatccttcacctttcctttgctttaagtcatcatataatgactttgattggactcaaatcatattagagtctatacgtgtgcctttctaatagcaatcctgcactaatataaaagctgcattttcaatgtgagataaacaggtatttcacaaaagagtgcaagatttttgcacctgctggtgtagctgtagcaacagcttcacagatatcttttaaaaacaaaacaaaaacatagacaaaaaaatggtctttatcctggattcatttctcttgaaatggcaagcaaccaaagctgcagacctcaatcaatggtacatatcaagccattcaactttttcttgtaatgttgtgacatttctctcctgggggagcacttccagcatcactagctgcatttcatatgggttccatggtgtaattcaaggttcatgatttgcactatacatgatgaaacatatttgaaaaatactcaagaaccacaaaagatcactttttattgtgacagctaca

SEQ ID NO: 506184 - DNA, 163 bp, Homo sapiens
  misc_feature (118)..(118): n is a, c, g, or t
tagaagagcatccgtgtcgagaagcgccgctctgagggcgaaagatccgaaagaagtacccggaccgggtgccggtgatagtagaaaaggctcccaatagctcggataggagaccggngacataaaagaagtacctggctgcgcttctgagtctcacagcttg

SEQ ID NO: 506185 - DNA, 344 bp, Homo sapiens
  misc_feature (272)..(272): n is a, c, g, or t
gcacgagtcacgtttgaaaattgccttggccacctgaaaaagagcaggcttggctgggcacgatggctcagacctgtaatcccagcactttgggaggccgcggcgggtggatcacttgaggtcaggagctgaagaccagcccagccaacatggtgaaaccccgactctactaagaaaacaaaaattagccgggcatggtggcatgcacctgtaatcccagctactcgggaggctgaggcaggagaattgcttgaacccgggagggggaggtnttcttttacaccacttgtttaacattttgcttctccttagccaatgtatattgctgggttttgcatctttta

SEQ ID NO: 506186 - DNA, 175 bp, Homo sapiens
tacgccccaaactctgtcatcaccgtaccttcatacatcatcaacacctccaagaggaccgtcatcgactgcagcatattcaacgacaagtaagagaccagagactctggaatacacacacaagttactctagctcctgtttctactcctgtgatgttctatatacatgtcccaa

SEQ ID NO: 506187 - DNA, 930 bp, Homo sapiens
tggacattcacatgggctgcagagcactgtcaggtgacctgtaaatgcaacaagaagttggagaagaggcagttaaagcagcatgcggagacagagtgtcccctgcggctcgccgtctgccagcactgtgatctggagctttctgttgtcaagttgaaggagcatgaggattactgtggagcccggacagagctgtgtggcagctgtgggcgcaacgtgcttgtgaaggagctgaagactcaccccgaagtctgtgggagagtggaggaggaaaagagaacggaggctgccatccctccggaggcttacgacgagccctggagtcaggacagaatctggatcgcatcccagctcctcagacaaatcgaggctctggacccgcccatgaggctccctggaaggcccctgcaagcctttgaggcagaccccttctacagtaggactaccagccagaggagcatggcagcccagtttccagttcaaaataatctttttgaagaacaagaaaggcaggaaaggaacagaagccggcagtccccaaaggacagcgctgagaataacgcacacttggacttcatgttggccttgagtctgcagaatgagggacaggccaccagcatggtagagcagggcttctgggagtctgtgcctgaggctgatccggctcgtgctgggcccacatctctaggtgacattacaggtgctgctgacgaagattctggctgccgtgtgagttctgggaaggagctgttcccgagggaactggtccttgaccattcagacaaggtggacccttttatgccttagtcctcactccggcgcctccctcagggggtgggcaacccggtcccttccactttttcggcgcagtaacctgtcctggcgcggaacttctgggaactcccggtcttggtggagagggcccccgtc

SEQ ID NO: 506188 - DNA, 244 bp, Homo sapiens
tttctagctgaacccctttctcctccagcatcagctctaccatgtccaaggagagtcccaggtctgcacacagcgacacgtaccaagctttccacgtgcgccgtatagcctctcatcttcttgcttagaatcaccaacctcaccgcggctcgagatggaccccaactgctcctgcgccactggtggctcctgcacctgcactggcttctggaaatgcaaacagcgcaaatgcaccttctgcaag

SEQ ID NO: 506189 - DNA, 973 bp, Homo sapiens
  misc_feature (37)..(37): n is a, c, g, or t
  misc_feature (83)..(83): n is a, c, g, or t
  misc_feature (89)..(89): n is a, c, g, or t
  misc_feature (132)..(132): n is a, c, g, or t
  misc_feature (139)..(139): n is a, c, g, or t
  misc_feature (143)..(143): n is a, c, g, or t
  misc_feature (167)..(167): n is a, c, g, or t
  misc_feature (176)..(176): n is a, c, g, or t
  misc_feature (187)..(187): n is a, c, g, or t
  misc_feature (204)..(204): n is a, c, g, or t
  misc_feature (213)..(213): n is a, c, g, or t
  misc_feature (215)..(215): n is a, c, g, or t
  misc_feature (218)..(218): n is a, c, g, or t
  misc_feature (222)..(222): n is a, c, g, or t
  misc_feature (244)..(244): n is a, c, g, or t
  misc_feature (261)..(261): n is a, c, g, or t
  misc_feature (288)..(288): n is a, c, g, or t
  misc_feature (314)..(314): n is a, c, g, or t
  misc_feature (441)..(441): n is a, c, g, or t
  misc_feature (495)..(495): n is a, c, g, or t
  misc_feature (521)..(521): n is a, c, g, or t
  misc_feature (576)..(576): n is a, c, g, or t
  misc_feature (582)..(582): n is a, c, g, or t
  misc_feature (635)..(635): n is a, c, g, or t
  misc_feature (655)..(655): n is a, c, g, or t
  misc_feature (660)..(660): n is a, c, g, or t
  misc_feature (710)..(710): n is a, c, g, or t
  misc_feature (722)..(722): n is a, c, g, or t
  misc_feature (808)..(808): n is a, c, g, or t
  misc_feature (810)..(810): n is a, c, g, or t
  misc_feature (854)..(854): n is a, c, g, or t
  misc_feature (885)..(885): n is a, c, g, or t
  misc_feature (907)..(907): n is a, c, g, or t
  misc_feature (953)..(953): n is a, c, g, or t
ttaatacaaaaatcaatacaacgaaggagataatacngtacaaaaaccttatcagctcccccaacctttatacaacaaagacnggagtnaccatatctacaaaaccataaggtctttccacttcgggcttcngtctgtnaacnctcattaaacactttttaaaagcnctgtgtagnacttcggaccnagagcgtttaaaaatanatcttttcncnatnaacnccattatttccaagcgggaacnccgcggggaagtgcggnaagcgtttgcccccccgcggggaagcnaaggaccgggaagacgcccccggccnagagggagcacaggagagaaacggggcggcagggggagagagagggggggagggacagaggggatccaagggggggcgcggggcgaaagcccccgcggcggaggaaagccggggcgggaacgccacnccgggcccggaagcggggggagcgggccggggagggggaggggggaagtccctncccccccggagaacgaagggggaacnccccggcccaaaccggggagccgcggccggcgccacgcagccggcagaggaaagnccccgnccgcgcccaagccccgaaacccgggggagaggaggggggcagccagatgagcnaaatagttttaatgccacangatanacttacatacacagacatacacaaacacaaaagttaacgatcgttctctnccaatgagcctnaagctcccaggtctccagataagccagatgcgcccgggggcagtttgcgatgcccagaggcaaccagtttgcccaacgcgctcagncnccgcggtctctgggcgttctcgcagccgggaagggcctggcccncacttcggggacgcccgccgcaccacccccnccccgcagggggcccaagggcncagaaggccacgatggctgttccccaggggtacatgtttttaagcnccggcttatcgcagcagaac

SEQ ID NO: 506190 - DNA, 86 bp, Homo sapiens
cccagaaacaacaacaggagaaaacacacgctgttctctaccggcccgtgtgaaaccgcccccgtcgcggaataccgacctgcccc

SEQ ID NO: 506191 - DNA, 150 bp, Homo sapiens
tagccttaccctcagtgccctggtctcgcttcccccgtgctgtagccacccgaggcagtcggggcaggtggcattccggacacctgggcttaccaggcatacgggaccccaggaaatgttatttttggttaagtcaaatcatatgtggca

SEQ ID NO: 506192 - DNA, 119 bp, Homo sapiens
gggtggggggggggggggttttttttttttcccaaaacttggggaattcccttttgggtttcaaatttttggtcccctttttccctttaaaaggaccctttaaaaaatttaaacctgga

SEQ ID NO: 506193 - DNA, 577 bp, Homo sapiens
aattcgcggccgcgtcgacacggctgcgagaagagacagaaggggacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagagggtgctgacttccttgggagatgccataaagcacctggatgatctcaagggcacctttgcccagctgagtgaactgcactgtgacaagctgcatgtggatcctgagacttcaagctcctggaaatgtgctggtgaccgttttggcaatccatttcggcaaagaattcacccctgaggttgcaggcttcctggcagaagatggtgactggagatgccagtgtctctgtcctccagataacactgagctcactgcttatgactgcaggctttcaagatt

SEQ ID NO: 506194 - DNA, 539 bp, Homo sapiens
tacctcggctctacttgtctctggactgtgtcttggttatcatggagctagactgggcctggtgacagcgccctgatggggttgtcctgtgtggtcacggaggtgatcagaaaagatgcagaatggaattgctgcgaggatgaatgagatgactgtcagcacataacaggcagctggtgagtgttcagggattaccctcagtagctgcccagaggccaaaaccatccacctgatagtgacttttcccaaaccaggaggaagagaaaagagcaggtcccactcacctgaatctgatcagtgagctgtgttgagatgtgcctctcatctagaaaatggtccttcacgcagagctactcacagacactgctgtgtgtctctaactgctccacaacacagaggcgatggggactcagcaacagtgacattgtggggtgacacaacccacaaccatgggagtctgcttgggtcaacagggcccagagtcagtgtcctctatcccctgaactgacatgtgtgtatgcagacaaggtagagccgag

SEQ ID NO: 506195 - DNA, 1043 bp, Homo sapiens
  misc_feature (815)..(815): n is a, c, g, or t
aattcgcggccgcgtcgacacggctgcgagaagagacagaaggggacacactcgcttctggaacgtctgaggttatcaataagctcctagtccagacgccatgggtcatttcacagaggaggacaaggctactatcacaagcctgtggggcaaggtgaatgtggaagatgctggaggagaaaccctggtgacatggctccatgagcttcgtctacccaatggaccctagacggattctttgacaagcttatgggaatccggatgtcctcctgcctctgcacatcactgggcaactcccaaatgtcaaaggctacactggcaacgaatggtgctgactttccttgggacgatgccataagatgcaggctggattgatctcacagtggcaccttagacctatgcctgagtgaatctgcactgatgacgatagccttggcaatggtgggaatccctagacgtaacttgcaatgcctcctggaggaaaatgtgcttggctgaaccggttctttgggccaaatgcacatttcgggcgaatacgcacattcaaccccttgacgtgtcgcaaggctatcctggggaagcaatggatgggtgacgtgagatgtagcgctcagttgcccctgtcacttcccaagactaacctactagatggctcattgtcgcaatgatcgcattgacgctttcagaggggatagggctttctattcttggccaaagtcatacgtacacaaactaagataaaactcttcctttgctgcgttaatgcaggattccagcgacaaacacataccagaggctaaattaccaattggganaaccccttgcgcgaaaaaggtcggcttgaccaaatcccttaccaggtgattcatctccaagactgggagggtggcgccagacattcttaattggttcggtgtagaccctcaagtggccactttggtcgaccaacaaagttgctgccccaccctattgtggtgttaagcctccacaccttttccaaatggacggcatcccattcggactccgacttcttgtcaaagcag

SEQ ID NO: 506196 - DNA, 123 bp, Homo sapiens
tttttttttttgggggggggggttttaggtttttggttttttaaaccgggcctttttttggggaccccctggccccaaattttttcccggattttttggcccccttcaaaaggtttattggga

SEQ ID NO: 506197 - DNA, 374 bp, Homo sapiens
  misc_feature (186)..(186): n is a, c, g, or t
  misc_feature (198)..(198): n is a, c, g, or t
  misc_feature (206)..(206): n is a, c, g, or t
  misc_feature (212)..(213): n is a, c, g, or t
  misc_feature (217)..(217): n is a, c, g, or t
aattcgcggccgcgtcgacacggctgcgagaagagacagaaggggacacactcgcttctggaacgtctgaggttatcaataagctcctagtccagacgccatgggtcatttcacagaggaggacaaggctactatcacaagcctgtggggcaaggtgaatgtggaagatgctggaggagaaactcnggaaggttcctngttgttanccttgnncccnaggtttcttttacacatcttgcgcaccctgctctgtccctgtctcatcaggcaaccccaagtcagagacacagcagaggtggtgtatacttctgagtagcctacatgcacacgtgatctcagagcactcttccatcgtgatcactcttacagcagct

SEQ ID NO: 506198 - DNA, 992 bp, Homo sapiens
ggtgcttcccgcagagggctggtggtgggagcggagtgggtctgggcggtgcgagcctgggccgtgggctgtgtgggggccgggcggggcggtgacggtgtgatggcgggatgggtgcaccgtgagcgcgcgatggacaaggatgggtgccgagcgctctaagatgatcgataagtaactgcgggagtggaacggatagaagggggcgggaggtgaagttgctgcctgttgggtgctggggagtcatgggaagagcaccatctgtcaagcagatgacgatcatccacgaggagtggctactccgagcgagagaagtgccggcagtacccgtgccggttgtctacaggaacaccattccagtcctaatcaatggccacttgtcgaaagccatgggcaacgtgcagatcgactttgcccgaagccctccatgaagctggtacgacgcctacggcatgctattttgcactgttctggctaccgctgaggagcaaggcgtgctccctgatgagctgtccgtggtcgtccggaggctctgggtgacatggtgtgcaggcctgctttgggcgtcaatggaataccagctcaacgactcagtgctactacctgaactgacctgtagcgtattggcagagtgatagatccccacaaaggaagatgtgtacggaccgcgtaggacacggggatcgtggagacgcggcttcagcttcaaggaacgtaacttcagatgttggtggggtgccagcggctggcgaagaagtggaaccatggtatgggggtcgcggcatcaggttgtgggtagctgagcgggtatactgggaacgtgagggagaagtagaccggtctgaagataatgtttaaggtggactaatgtctcgagaggccattcacaagaggggtggggaacacagcctgatgtcgtagtgggacatttgggcccagagagggataagaagatacctgcgaaagtgtgctaaaaggtgggtggaccagtg

SEQ ID NO: 506199 - DNA, 745 bp, Homo sapiens
agcggagttccgggcgcgcgcccgcaaccgccgacgtcagccatggcagacgtgtcaagccgagccagggacccactgttgggatgctggctgcatggggcgccccaagcccagtcccctctgtcttctctttcgactagcactgtacttgtgtgctcctctacccgaggacctgacatggacccaatcctcgggccgccctggagcgccagcagctccgcctccgggagcggcaaaaattcttcgaggacattttacagccagagacagagttgtctttcctctgtcccatctgcatctcaagtcgcagagaccccccataggtagtatctcatccatggaagtgaatgtggacacactggagcgaagtagaactgatcgaccttggggacccggatgcagcagatgtgttctcgccctagcgaagatcctccaaacgaaccccccagatcgtctggggtggacaagcatttggaggagctgagcctgccggttgcctacatcagacaggacccacatctaggacctcctcctccttcctcctccgaattcctccagagcaacctgcataagcccaacatccaagtgatgatggaagcaaatacgcccttggcacagctcggatgacagaaggaggacaagcggctaatgcgcagagggcagagcctggacgacctgcaacatacacatggggccctggactaacagaactgaacccgcttggctatacccccacatggaacac

SEQ ID NO: 506200 - DNA, 325 bp, Homo sapiens
  misc_feature (23)..(23): n is a, c, g, or t
  misc_feature (32)..(32): n is a, c, g, or t
  misc_feature (263)..(263): n is a, c, g, or t
atggagtagtactggaattctgngtacggcanagcctggcacatagccggtattccatcaagtgctgagcacattggccgttggtatgaatgctataattaccttgaaaataatcagactctgccattgcaaaagagaaagacaacagtctttaattttaaacttcctgatactatattcagtcactctttcatgccatcttcaaactgcattggcatgacaatttacatttacaattttggatgagaaataccgcaagattnactcacaccttccacctcccaggacacacttaaaaccatgagcttaggcagcgcaaggtacg

SEQ ID NO: 506201 - DNA, 377 bp, Homo sapiens
aaatttctagaaccaaattgtgtctcacagtttacctctactaacacagttgtgtttccttcttgcaacagcccatctcaggccttctttggtcttcctcccttgagagcttgacagctttgctccagccctccttgtgggcctccttgtgaagccagttctctgcctgtttaaggtccccgccacaagtctccaaagctttcttgcattttacaaagaagtagctgtgttttccgccgcagcttcatagagaagctccttgttgagagcccaagccagcacagacggggcacgagcataaatatgtgtgccgtgtctggggcgtctcacacaaaagagacacagccgtatagctcgcggtgcgcgcgcacaggccc

SEQ ID NO: 506202 - DNA, 103 bp, Homo sapiens
gaaggtgagagcatgctgtctccttccttgctgtggaatttgctgacacaatatcttccgcctggtgctgggcatatcctaagaacttacaactttcctgtac

SEQ ID NO: 506203 - DNA, 864 bp, Homo sapiens
gaggcagcagcagccactcaagtggcagtatctgtgccaaagaggagacggataaattaaggagctaaataagaaggaggctgttggagaccttctggatgccttcaatggaggcgaaccctggcagtacgcagaggtggaaagatcgagcatcctgcaggtcagcaatccaggcccagagtctgagggcagtggtgtgcccccacgtcctgaggaacgcagatgagagctgggactcaaaggaagactaaaatgcacaatgctgagaacatccagtcccggggacacagaagtatgaatataacgtcatgatcagtggaagcctctaaagcctatgaggagacataacacgttacgaaccgtgagttcctgcgttggatctgcagattcatcattgtgccagatatgcagaagaccagagggattagccacgatatcaagtgacgtggatgcatggaccaggccagataaaacaccaactgcggagcactgtgatcccagtagacgtacacaggcataaagttggtggaccaagacttctagctccatacttatgtcaaccttggtcggacaagccttagcagacggtgggcgcccaagggagtgcggacaaggtggtggaagctagacccgatggtacacacatgagatgcacactggggaacccggcagctcctgcaaaaagggaagcccgcgaaaaaaggaagccaacggccaagaatccatttggccaccacgaggtgaaatagaacctgacaggagttctaaccagcgcggaacacatagggccacaaacaggcctggaaaaacccagcacagacaaagcgggccgaggggctgagtaaaggaacgaacgggcaacaa

SEQ ID NO: 506204 - DNA, 158 bp, Homo sapiens
tagttgaaatagtgctggttatcttataagctatatcagttatttgtccaattaaacacttaacaccagtatatagtccgagtagtacagacgatgtatatggatatagtcatggttcatctacagactcaaaacataatcaataactcatccttgga

SEQ ID NO: 506205 - DNA, 1607 bp, Homo sapiens
  misc_feature (267)..(267): n is a, c, g, or t
  misc_feature (460)..(460): n is a, c, g, or t
  misc_feature (698)..(698): n is a, c, g, or t
  misc_feature (768)..(768): n is a, c, g, or t
  misc_feature (858)..(858): n is a, c, g, or t
  misc_feature (973)..(973): n is a, c, g, or t
  misc_feature (1087)..(1087): n is a, c, g, or t
aggggagcagcaccaccaagatatggggggctccccacaagaccaagaatgtctcctgcagatgtttcccccgatgttgtctccttctctccgcgggggaaaggcctttgtggtgtcgccattatgtctggggcccccagaaacgaccacacgccgcgttgttaatgcggccccacaaaagaccatccttccccggaggggcccacaccttcttggggggagaacaccgacacccccgccgcgggttttgtcttgggtgagaagaanaactcttgtgctgtcgcctcctttcataattaatatctacccggcggcggaaagaaaattatttgggtccccttttttgtggtggtgtttctcccagcaccagaacggcgtggggcgccccctctctcctcctcctttgtggaggaattttcctacggggggaagccaatatgtgtttgttcgttgtgctccnccacgaatataaaaaaggggtgtttcaccacactatctgtgttctcttgtgtgccgccccctctgtggactgggggggggcgacaccactgtgggccgccccccacctcgtggtggagagagatttcccacacctgcggtggggccacacgatcccccacgggaacaccaccctgtggggttttctttcccgggggggtctccccgcagtggagtacgtagcccccttcccctctgtntgtgtcccgcacgcggctttttaatggggtaattcccacccgcgcctctatagagtgtctccccacgggngggacacccccacctttgaagattctccctcgagaggtagtgagatgtggctcacagctctcgagatctcacacgactctcggagagacncacacatggtggtggagagctccactgtcgagatatgccccacccgccttgtcttggggacacactgggctttcacagacagtgtgtgtccgcgccctgttgctgaccctcttanggggactctgtgtgtcactccccacgcccacaggtgtgtttttcagacgcacactgtgggcacggcatctttctatcacacacgccctgctgagagagtgggctctggagaganttcaccacagagagggcaaatctctctgcgcacttgtctccgcgtctccctctgggagaggggtgtgtgcccgcacacattgtgtcgccacagtgtgtgctctgtgctccgcacagagtttggcgtataccccacacttgtgttgcactccacaggaaccccactttctatcactccacaccgggtacccaaacgaggtcctcggcctctgttctcgtggaagaccggagttacaccctttcccacacttgctgagaaaaggttcaaggcctcttcttggctagaatccacttctgcctcttgtggctgctgcccccgtggctgctgccacccaccaagctgctcctgctgctgctgcacgccccacgctaaaggttgaagccacaaggaaagaagtcgcgaaggaagtccgaccgaaggaataatgggaatttggtctctttgactaatccccccaaagccacccacttagccccttttatttccccaacaccaggaaataaaggcttacttcctttta

SEQ ID NO: 506206 - DNA, 645 bp, Homo sapiens
tggaaatgggatctcgctctgtcacccaggctggattgcagtggcacaatcttggttcgctgaaccttcgcctcttgggttcacgcaattctcgtgcttagcctccctagtagctgggactacggtgtgcccaccagcctggtatttggtatttagcaagatggggttctcaccatgttggccaggcgggtcttgaactccgtggcctcaggtgatccacccacctcggtctcccaaagtgctaggattcacagacgtgaaccattgcacccagccaaataattcaaacttaacagctgtgggaacttaaatggtgctgagtcttgagaggaatgtgactatgcagcctgagtcacatggcatgcagctgcaacttctgcctttttttcacacctataacataacttgagacctaggctggtgccagagataaagaccccctcaaatcactgcccctttctacagagtaactaatggtcatcctcctgggggatgccggcattctgtaccccatccaaatcactgtgacattatggcccgtcttgtgttgcacactgttcaaatccttgccaaaatttcgtggtcggccccgcataagtaaaccttaattctccattggaaagtcgaacccatcgcggagtgagc

SEQ ID NO: 506207 - DNA, 85 bp, Homo sapiens
catggatttgctggtgcagtacaactaggcttaatagggacatgtccctattaagcctgttagaagcttgaattcgagcagtagt

SEQ ID NO: 506208 - DNA, 175 bp, Homo sapiens
catcgccgacagacgcgtggttgccccggcgtgatcgtgcgcagctcggctaacgcccaggccggggcaaccacgcgtctgtcggcgatgttccatggcctatggctgctggatttcgtgctctggctgtcgagcgtgctgcagagcattccggtcgcgagcctggcggttgtgc

SEQ ID NO: 506209 - DNA, 229 bp, Homo sapiens
gtgatttagtccttcaggtaatacagcttacccccaagaaggactgagaggaatatagagtacggacagttggcagatagacaatttcctttgcctaggctcacgggagaagtctggttgggccaggtatagtgggtgtttaggtgcctccatactggatagtagccagcagggtaacaaccaccctagcctatatacctagaataggcgcagcataacataatccata

SEQ ID NO: 506210 - DNA, 272 bp, Homo sapiens
tttcaccatatggtcaggatctcctcacatcgtgatccacccgcctcggcctcccaaagtgctgggattacaggcatgagccaccgcacccggcctaagcctgaaataatttttttttttttttttttgggaacagagtctcactctgtcccccaggttaaagtgcaggggcgcaatcggggctcacaggcaacctcgggcctcccagggttcaaggtaatttctccgggcgctctatggtcaggtttccggggtaccgacgctcagaatcc

SEQ ID NO: 506211 - DNA, 330 bp, Homo sapiens
cgaggtgactctagcaggatcttatccccggttctgggtacagtggctcatgtatgtaatcccaacactttgggaggccgaggctagagaatcacttgaggccaggggttggagagcaccctgggaaacatacaaggattccatctctacaaaaaaatttagcccaagtgtggtggctcacacctgtaatcccagcactttggaatgccgaggagggcggatcacgaggtcaggagatcgagaccatcctggctgacacagtgaaaccacatctccactaaaaatagaaaaaattagccaggcatggtggcgggcatctgtaatcccagc

SEQ ID NO: 506212 - DNA, 210 bp, Homo sapiens
caatctggactgggtgatgtgtacatggttcatctgtactgttatggggttttcatatttattaataacagccatactgaaatgtaattcacagtaccaaaaaatacatcttttaagatgtacacctcagtgatactttattatatttacagacttgtgtaactatcaccactatttttagagcatttttatcaccccccctcaaaaaag

SEQ ID NO: 506213 - DNA, 1063 bp, Homo sapiens
  misc_feature (751)..(751): n is a, c, g, or t
tggtcggatcctaggccccgtggtcccgctttggcgtgcgttgcgtctggctctgcccgcgtatgtgtgacgccctgggcgcctgtgggggtccagttgcgaggtgtcgggtaatcttggtgccaacgcgtatcccgtcggcgcctatccgcggtggaggactgaccagagacgtgggtgcgcgtccgttgggcgtggcgtctccacgtagctactctcacatctgagtggagcccacgtgcgttactccgatagtacgcacgaagttttagcgtctcgtacagccagagagtgactggatccctcctaactagcatggaaggtacaggtgagatcactaagactgcctcatggggcgaacttggagtagcggaaccagctatgttgtacaatggctggtctagaatagaacgtggttgggtgcacaaaatactcattgcagtaaagacttctagtgggcaattccctgttaagaagcaagaggtggtgaacacacttattaacacttgttcccctaggggtggggtatgggttgcgaggccacttgagacttgttggtgacacgccaagagagagaactttgatcccactgaaccaagttgaaggtgagctgttttccacaagggacttaccgtagaacagccgccgtaacgaaacttcacttggaggaacagaacatggtcgtacgcaaaagctcaggttggaattataagacttcgctagtgtttcaacacacgaaatcgtaaaagancaaataggagagaagattaacattatggcagtttatgggtgacatctgtgaccgttgttagtgacggaaaaaggagtgtcatcgtggtggaaccccagtgcacgctggatgggaagagaattacgtttgggaagattgtacaaagttggaaaagaggaacacgatatctatcgtagttacacgcgctagggcaaatggtgggaaggagtcgtacaagctgtacaacatgtaaacgatgggcacaaaacgaaagatgcaaaacggaaaactagtggataaagaagagaaaaccagttattgtcaacaaaagga

SEQ ID NO: 506214 - DNA, 1210 bp, Homo sapiens
  misc_feature (380)..(380): n is a, c, g, or t
gcatcatcactctgttcttccgccggtccgtcgacgcgtgactctgccggtcgcaacggatagaagagatcgccgcgctggtcatgtgacgatggctccggacagtgtgcaaatccgtggtcttggcgtggggactgacgctcccctgagccgttgcttatcctatccactcgtctgagagcgccccttagactatccagtggcgtacatggtgtgagcatggggccacaatggacatcctacgtaagcgacgatcgaggcccacgaagcaagcgtggtcatcctgaccctggagagtacgccactagtttgacgcatcggcatccgtcaccgaagcgtcgggaccgacatcttggagaacagatcttggcggccgaacnacgcttcggtactaacgacgcgtcgctcaggtaggcacccaggaaggcagcactccgagtggcctcgtttgacgcgagtgcccccccctgaaacgcccctagatgggccatacagaaaagagatgaggacttctactaattagtgtcttgaagaccattcaagagcatcgcgcctgggcacaattgatccagtgggcccctagtcccaagtgccccggctggcgttgatcgccttcatacggcactcgtaggagcagcaccacatggccattgtccatggactctggaagaccggtggttcgcccaacaacgagtagccccagtcgtaacgaaaggggcgtacgacaccatcacactccgacgccaattccctgcgatcgttggcaccctggacttggccgaggaccttgaccggaagtacctcatggaaagattcctcatctgcatgcgaggcttacaagcttcaccaccaccggccgagcggcgacaatcgtgcgcggacatccaaggagaagctagtgcttaccgtcgcccttggactttcgagcaaggagattggcccacctggccgcatacctcctctttctctgggaagaagaagcttacgaagcctgcccgatgtgccaggctcatcacccattgggcaatgagacgagtcccgggtgatccagaagggccctggttcccaagccttcctttcctggggtatgggaatctttggcggcattccacgcaagaccccttcacttcccttcatgacatgtgacgtggacattccgcaaagacctgttgggccaaacaggtctgtctgggggacccccatgtatccg

SEQ ID NO: 506215 - DNA, 406 bp, Homo sapiens
  misc_feature (46)..(46): n is a, c, g, or t
  misc_feature (66)..(66): n is a, c, g, or t
ggttaataaatgaaaaatagtttaatgtgtaaactggcctctgaantctcctgccttaaggacccnagaggaaaaatggttgttggaccctgaccttgttaaatggcctactgctttacctaaggagatgtgcaaatgcctgaaagttaagaaacaaggttaaatagcccaggcatggtgcctcatgcctgtaatccccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacc

SEQ ID NO: 506216 - DNA, 195 bp, Homo sapiens
cacgagtgtgcagctggaagcctctcccgccttcctagctgtcccagtgaagaagaaacaagcccctcactgcatctatgcgaacgaagcggcaaactgtgggtctgggcagcagtcttaaagtcattacgaaatgtgaatctcaccgtaagcacaaaaatgttagagtgttaagaaccgtgtttggctaagcag

SEQ ID NO: 506217 - DNA, 228 bp, Homo sapiens
  misc_feature (75)..(75): n is a, c, g, or t
gcccccccccccccccccccccccccagggggaaccccggggggggttcccccccccaaaggggggttttaaaanggtgtttgggccccccccccccaaatcccccggggggtccccaggggggaaaatttttttttttggggggggttttgccctttttttttttttttttttttgggggtttggggggttcccctttcccccccccaaaaaccgtttttttgggga

SEQ ID NO: 506218 - DNA, 200 bp, Homo sapiens
taaaggatattggatctattccaatagacaatactcttgcatttgatccagttcataacgtagataactaccatcaatcaacgtcatcagaatcacgatttgtattaagccctactgtgcataggcaaaacggtaatgcctaggctccagatgctaagtgccaatgggtacaccattcgtcgactcttgtcggaacgatc

SEQ ID NO: 506219 - DNA, 604 bp, Homo sapiens
caccggggcccaaacacaagggaccagttcggcaacagagaaacaacacggcggcgagccagacccagggttaggagcgaggcaccccaagaggcctaaatccgtcggcccagcagggccccggcctccaaggtcggagccccacagaacgaaagggagccatcccccacttggggggatacaacgtcgatgcgggcgcacaaattatcttggtccccccgccgtctgtggtgccccggcagaatcccgggaaggagccgcttccccccccctcatcaggggcacacacccaaggtgtgaccccgtattgaacacgaaccggacactgtcggagaaattccgccctcccccttaggatatctgtggggcacacattccctctgccaaggacccagtcggactattccccacggcacacaagagcctgggccccgcggcaccagcgccgaggatgcccgcacaacccgctgagggactgggcctgggacgggaaagccccgcgggcttgtagaaaccacacagtacgtgcaggggcctctcccgggagacaaccacgggggggcccgactgtttttttcaaaaaaaaccccctttcctcaaaaac

SEQ ID NO: 506220 - DNA, 880 bp, Homo sapiens
  misc_feature (1)..(2): n is a, c, g, or t
nncgcgagagagatgtagacagaagagagggcggaagcggcgcaccgtgaagcgcgagccgcaacacaggggagagagagcccacaggggtgagaaagcaaacacacgggacgccaactaatggacaagcgggaaacacgtaacgaccggataaaccggccagtacagttggcagctacatgccgcgcatgcggaggcagcaacacagcaacgagagtgaagcatgaggttaacacccagacagtggagtcgttagtcctgtctcgtgagtaggcatcaaccaggtggtgtatctagctaagcgtaacgtgaccagttacattagccgcaaacagtgcagaggacgaagtaagtgtattaaacgacggaaagtgaataacgagacgcaatgggctgagccagagggcagcacacaacagagcatctacgttaggagtcgacaatataccagcgcgcgagagcggtggtctcatgcgcaagtaaacggcgcggcatcttccgaaaggtcgaggtgggtggattactcgagcccacagagttcaagacccaccctggcccacacaggtgaaaccgccgtctctgatcataggaaaagcacctgcgcgttggtcacatagagtgcaccaccgccctgcctcaggctacaataggaaagactgagccacaaagagtcgcgtggaccccgggttgcaaaagaagcactgggagccaagagcgggggggacagacaccccaggcccacggagagcagagtgagagccgcgcgaccggggaaaagcccatgccacccccccccgggagtataaaaaaggaaattctttccaaaaaaacttccttttaactttaaaattttccccttccccctcccccccacaaaaca

SEQ ID NO: 506221 - DNA, 110 bp, Homo sapiens
aggcccatcagtgtgattctcagggtttttcttggaactttaggataaaagtattttctcttcctttggaaagagaaatattatgaaataaaatcatttttgctaccatg

SEQ ID NO: 506222 - DNA, 130 bp, Homo sapiens
actgttcgctgcacccctcgtccccgcctctctttgctatcacttagactgaccctgacacccatcaggctcagcaaattacctgggctgtcctgccgcaagggttcacagacagcccccattacctcag

SEQ ID NO: 506223 - DNA, 145 bp, Homo sapiens
tgatggactgaggcttcaggtggtactggagcacatgcctgtagccctgatgcattctcagatacgttcgcagggttgtgatccacccagcacttctgagagcaatgaagtcaggagcagaagagcttcctgagctaagcggaat

SEQ ID NO: 506224 - DNA, 332 bp, Homo sapiens
ttcattcctctacctcgcttttctaattttctagcttttgattttgagggagggatgtgtgattcttcctttcaccttaacactttatagagcattgtgggattactaattatcctactttcagtattcttgtttcttacggaatagggaggcccgataagcacgggttctagacaggctacaatctcgaaggtggagcattcagaacacgcacaatggctatctaattccacgtttgccattctatattgttactggtcattatttagtgacatttgtatttgctatagtgacatccaagatctctgatcacgcgttaccattggctgact

SEQ ID NO: 506225 - DNA, 774 bp, Homo sapiens
gattatggactgtgcttctggcaatgtgactcgctagttagttctgagattccaagattacagaatcctgtgactgcttttcagctcataattcgtggcctgtggaagcgtgcacatgcactggtacacatcttgattaagcgagcgtcaggtactcgcaaaaccgtgcaatgtgcaaaatgctttgaacaaacgataaaagcacagatgccaaatgcttcgacttcgtccagtatgaactccggcaatgagttcgagaaggaagcaacttttacgagcattcttaatactgtcatcttgctttggtctttagtggcttatttgcctttactggttgtatctgacggaataccgtatttgagcagcagtgtaggtaaaacaaaatcatatgggtgcatttacttcagccaggttgtgtgtattgaatactaagtcaccttcttcaagagagaacttgtgggatttttgtggtaattattataaacttagacttgctatttcaaaaatgctgaggttctacccatttttttaccttgctatcggttccaacctgtttgtgttgagacttcgcaatttcttgcaattggcattcaagcactcagtaggaaaagcccaaacacttatgaccttcacttccattttccttaggaggagtccgattattcccgtgaattttccagcaacgagcgaatccattacctggggaaagcaaaccggtatgtacaaatcattaagtccctggttgcttttaaaccatgtgttgacgaaattaag

SEQ ID NO: 506226 - DNA, 121 bp, Homo sapiens
cagctaagtttcctaaatggaaaattcctcacatgaaaacattctcaaccttagccatacctccctacagggtttctttctggggtgatgaagatgttctaaaactgctgtggttgcatag

SEQ ID NO: 506227 - DNA, 403 bp, Homo sapiens
ctagaggatccccagaggacatggtgctctctcgacctgatggtctgaggcaggtcaactcctctctgtctctgtccttgagccttctctacggtggggagaggggtgggggcaccagggttattgctgtcctctcctcctaaggaaagggagtagcagattgtctgaggggaagcacaggctgtgcttgtcgagggggctagtcgcttactcgccttgccatgaggccgggctctcagtttgggggtgtctgtgcaaccttcatctgcactgtgtcctgtgccccctcctccccattccatggtccccagcaggtgctggttctgagcaaactcccagggaagaaaacgtgcctgtttccatggccaggttcttgtggtgtccagtgtgcgtctctcctcca

SEQ ID NO: 506228 - DNA, 359 bp, Homo sapiens
cctcttatcagtttcatgttatataagagcttgggatatccatatttaaatgtgctgtagaaatgaaggaaactttaaatattagcttataaataaacaaataaccctcttgttctggaattttaccatctctaaaatggaattagactgagtgtttttattttctgtttgtagattcgttattttactcgagtgttgattttctttctgtcgatcagtggcgagcgtgctgtggtgttcttgctatccgagtctggttatctccacctctctgctcttgcgtctggtgcctgcctctacgtgcgtcgcctccgtggaggcgcggttttcgttgctgcgcctcatgcggccacagctgg

SEQ ID NO: 506229 - DNA, 425 bp, Homo sapiens
ttcacatgcaaggaggagtgcgcagacactcgggaggtgtctatacagattatcatccgctgaaggtgggggggagctcgacacaggcactcggaaggtgtcttgagattatacatccgctgagggtagagcagaaggtggaaggggagtgagccgaaactacgggaggtgtcttgagattatcatccgctgagggtggacgaagatagagcacacactgcgaaaagtgtactagaggctcaaggagtaatcaattatagaatgtagtagagttggaggaggtggctggtggaccatcctgtattataaagtaacagctgtgaggtcaggccagtagggcaatcctgaagaatagacgctgctccactgccgacattctgcactgtaaggccaaaggaggacaatgtattcacacatatacatta

SEQ ID NO: 506230 - DNA, 157 bp, Homo sapiens
tacgatcgagctcggtaccatctctgtcaggtgtgctgcgtacttcccggctcacgcgtcccagcagatagagatgggggccgttagaagcaaaatgtgaaacgtatccgccatggtgctggtatctccggcaataaaaccatcatcgtagaaaata

SEQ ID NO: 506231 - DNA, 438 bp, Homo sapiens
cctacgccgggctgtggtacccgcaaacaggccgagcgggcgggaggacaaggcgccggccgtgccgacaggtcactcgcgccattgccgtgccaacgacccgcatgatgtggccgacgtggcgcctgtcctcggcgcgttgggctgcttgctccgtgttacctgcccctactcggtctaacctacctctatcggaccaccctgacgggaccctgcgaagccgggccatctctgacccagacccatgatccccgatgggacctgaccttgactggagccgaggaccccgaagaaaggcgtagcggaatgaatgacccttatgtgacgaccccagagggcaggggcaagaccgagccagggggttgacgggaccacagagccaagaggaggatacttgcgacgccgcgacactggatattcgctgaaagaacccgacag

SEQ ID NO: 506232 - DNA, 318 bp, Homo sapiens
tacaagcgtgagtcaccatgactgggttttgttttttttttaaataaaggggatttgaaaaatttgggaagcgcaggcgggataagtgtatttatccctgctgggctaactgaagcatgagacgttcccaccccagggtgacaagtcactgaacctgtttataaacccctcactatttgagggttgaaaatccagagggcggtatttttttgtggagcgaaaaaaacctttcattttggacggaaacaatagggggtgcttaaaatggccggggcaagtttcaaaacaaatggggggggccacttttttctaacctga

SEQ ID NO: 506233 - DNA, 780 bp, Homo sapiens
agcggaaaaaagaaaaaaaaaaaaaagaatgactttaagggatggaaacatgtcatatatgtccaaatctatgagtggacaatacttaaaaaaaaaaaaagaaaaaaaaaaatccttttttccccaggggaggatttgggaaaacccaactcattttggaaaaccgggtcaaagaaggggaaagaagcattttattcctttgggggtacaacccattacttttgtgggtagccaaattagctgtgataaattggaatccccttttatagacattattgttccacctaccaaagaacagaaattcatagaatttagtatgccaccagtgttggtaatactctaagtgaaatcaagggggccagggtggtgggggcctcactcccggggtaatctcccaaacactttctcggaggccgagaaggcgggaagaaatggcttggaaggccagaaagattcgagaaccacccggggcaaacaacagaaccgtgttcatagtgcacacaagaaactccgtggtccccctacaaagaaaaaataagagaaaataaaaaaaaaaaactttgagcaccggggtgtgtggggccctgaggtgccccgtggttagtcccccagctgtgttttgggaaagaggctctgcgggtgtggagaaggaataccccttgtgaaagcccccgggggaggttccaagaggcgttagcaccaccccacgcttaagaaagtgggccccccaagtgtgatctcttaaacccttgttgtgtcaacaagagcggggaaacccca

SEQ ID NO: 506234 - DNA, 821 bp, Homo sapiens
gccttcgttgccggcatcagccagtactccaagttgcgtgctggcctctaaggagcaggtgctgcaccgtggtagttctggaggagaaagtagcactatgagcagcaggtggcagaggagaagcatcacgtcgccgagctcctgtctttattcgaggacagcatatccaggatggctctaaagactcgggaaggaggcgtctgctcagtggtattggcactggtaagcagaagggaggtcaccatggttgtggtggctgctctgtgaacaacgtggtgctgatggctcccttgtgcgaatggagtctgtatttcaaaccgaggaagggtgtgcatgggagtatctgtctgcctgtcgatgaagaaaggcacggaatgtttgttgctcgtggagcatctccttctaggaactcttgctctccctcatggctaggaagagcgaggaaggaaggtcgtgtgatatctatgaggctgacggggtctcgacaggaggactgtgatgactttgcgacgtaagggcagactgatgattacttaatagacggggatcagtgtgtgatgtgagtcaagatcacgtccggatgccgcattatggtcggaatactaggctattcaccaactggccattcgagaacagacgtcgtacgccttcgatcttacatgacgtgtgtttagcgcgaagtcgggtagaggaatagggagcagagtccattgatggtgcccctgggaaccccttgttggtgagttgttgccagctggccctgcgggggccgaggcaggttacgggaaaggtcctgggaacgagggacgccgccgaagcag

SEQ ID NO: 506235 - DNA, 188 bp, Homo sapiens
agcttggacttctttgcaacaatgtctcgcccattccagcagcagtatctcagatcacttgtgttcctgtttgcctccaggctcgagaacaaaatcacagtcttcatggaccacgtagggtgggccactttgctagatgggtcataaaggggactggggggactcaaacagagtatggtcgggctaag

SEQ ID NO: 506236 - DNA, 471 bp, Homo sapiens
tcatacaacacttctcttccttctacatctcgccaccacattactaaaagtctatttaccagagttccttctacacagtacatcttgtccacctttcaacagcaccaaaaaaatgcaaggcacactaaaaggcaaaaagcacagtttgagcagtcattgcgagcatcagaacgagacccagatacagcagggatgttggaatcatcagagcataaattttaaaaataattatgattaataagctaagggctgtaatgagaaaagtagacaacatgcacgaacagatgaataatataaatagaaaaatagaacttcttagatagaagcaaaaataaatgctagagataaaaaacactgtaattgaaatgaagagacctttgatgggcttattagtagattggacatggctgagaaaagaatctctgagctcgaggatgtgacgatcgaaacttctaaaactgaaaattaaaa

SEQ ID NO: 506237 - DNA, 466 bp, Homo sapiens
  misc_feature (78)..(78): n is a, c, g, or t
catttttattaaattactaatatatatataatgcccattttacttaatccttctcagggccttttgccagtatgtttnacttttttattttcccacaatagttcacttgtcaaaaactacagaaacaggaagtcattaaaccttggttgggtccatgagtggcggagatgaaagcgcttgtttccctccacagttgatagctgtggagtacattttagctcctgtcaaactgattgctaaaatggagcttattcttttttgtttttacatttatttgtaaaaaataccaacaagactgcttaaagttttaaaaaggaaagacaattgctaaattatttattgcctctaattactaatgtagttttggcagtcttaatggtgatttatttcatctgtggatggaattaaatgttaccaaacaaggacatttaatctatacaacactggcaaaagtagtcatcaatta

SEQ ID NO: 506238 - DNA, 411 bp, Homo sapiens
actctagaggaccccgcacatcctgcactggacaggctgcccctttgacaaaatacaacaacccttcatgctaaaaactctcaataaattaggtattgatgggacgtatttcaaaataataagagctatctatgacaaacccacagccaatatcatactgaatgggcaaaaactgaaagcattccctttgaaaactggcacaagacagggatgccctctctcactgctcctattcaacatagtgttggaagttctggccagggcaatcaggcaggagaaggaaataaaaggtattcaattaggaaaagaggaagtcaaattgtccctgtttgcagacgacatgattgtttatctagaaaaccccatcgtctcagcccaaaatctccttaagctgataagcaacttcagcaa

SEQ ID NO: 506239 - DNA, 139 bp, Homo sapiens
gtctagaggtcccggcagaatcacactcaaactccagaacacggggatagtacaatacgcgtagtgaatagtaatcttcatatctgtacggaaaagcatatcatgagaatagtgactgatacagtgtcacagatactga

SEQ ID NO: 506240 - DNA, 401 bp, Homo sapiens
gcactgtcaaacattttgattttcctgtcaatgtcttgggagctagaccctatcctgtgtctgagtagaggtttccaccaagagtatgattgtcactgacactagggcagaaagaaatcaggcattgacaagaagctgccctttcttttggactgtggcctttacgcttgggggtgagaattgtgccacctgggcagggggacaaaagtactgaggactaagtaagagaacccttggaatggcatgattggtggattctaggaaatgtgataatggatttccaactgaatgcactttttctgcatatatagtctgttatttcaaaccctccgtaatttttatcttaaaagctgtgatgtcatcatcattgtatctggtgaattaagaggaagacctgagct

SEQ ID NO: 506241 - DNA, 138 bp, Homo sapiens
ccagtccagctcaagggtaggtagacaggtattgcacctacatatgagagccagcagcctggtacccatcagacatccaaacttgcagaaggatttgctccactggaaaaagacctagctggagtatttcgtcgacgc

SEQ ID NO: 506242 - DNA, 1673 bp, Homo sapiens
  misc_feature (44)..(44): n is a, c, g, or t
  misc_feature (186)..(186): n is a, c, g, or t
ggacacctcctaagtatgattataattattataattaatgattnctttagcagacatatcagaattttgacatctaattaagtgttgtcccctcaatgtcatctagttttacttaagaagttaatacttattctaatgatgctgccatccttaaagttatttttgaaactcctctccttagaaatnatatcaaggaaggtaataaggtataagaaaatcagctatattatttaattagtatcactttgagaaagcacctggaagtatattctttctttgtctactttttctactactcttggttctgagtaacatttagccatttccagaaagcaaattcaaccctgtaagatgaagagtggttactgttgaagacagtaaaaaggataatccacaaaaaattctcagagaggaccttataatagaaagtgaacatgattaagacttaatttctgtaattttctgaataaggaaacttctgtgattccttagtctttagaatggtttaaaacattgaaagatatgggtattaaaacacctctgaaagaagttgtcactttgttcagtgttatttgatattggacttcgctcttcctgaattagaattacacaacttggtttgctaatacttgtgggaaaaacaaacccaagaaacgaactactttctcaagatgtaatatttgttttattattaatacttttggttgttttgattacttatttcctactctcctgacagataattgatcaaccaatataaccttccccaggttaggaacagttctgccttcagcagtgctgtgggaatgaagggatctttggggctgatagcctatgatgtggagggatctgcactcagctaaataaatacatgctatagataccttgggccaaaataaagtctctcttgataaggtttttctgtgatttcccagagtccttaaccttctctgtctgcaagattatcaggctcccatagccactaactttgagctttgggatgaaaatgacaggattgcccagtgtgccgggttaagcaaattagaggctgcctggcagaacagaaaaactatcacatgaatatttagaatggaagctttcctgaaacactccagatactgcaaagctatctttattcctctctaaaggctataattttatcaacacaaagtcagccttttctttttccacattagtaatgtttctgaagttggatgtgcttagatttcttaaatcagaatgagtgctaggaaatctataacaagaaacctcttttgcttctcccagatttcctttcactaatacgggatagggaggctccttgggtaatgctaacctatgcaaagaagttaccaaatggtggtagttgctagaattaaagacacgttcttggttcacactttgatgtagtgacctgaatttactcttttcctgtgagtattctactctgccctattgcactctcctttgtcatgtggatgtgtgtttatcataggtctttaacgcgtccttcccaagaagacaaagcatacagttgtacatgaagatatcttatgcagtaaaaatgtgaaatttgaacattgctgcacaagtattgtataaaaaaaagtctgtaaagaactttcttatgtaaacatacaggggaataaagacttttatctgttcaaatggga

SEQ ID NO: 506243 - DNA, 259 bp, Homo sapiens
ccccgataccctgacatggtgggttagtaaaaaaaacaaagaaaaaaaaaaaacaaaaaaaaaaaaaaatgataagaaagaaacaaaccaagaaaggaaatcgactggtgtgcgacggcctggatgcatgtagcacctcggaacgggccgatgctcggcctccatcttcatcatccagtgccccctgcctttacactcatctggagctccatgccattcacatgatgctgtcacggcatggtccaagcaaaacctggcc

SEQ ID NO: 506244 - DNA, 183 bp, Homo sapiens
  misc_feature (25)..(25): n is a, c, g, or t
tcccatgatgagacactgatatatngtgtactgttgactctacaaaaaaaaaaaaaaaaaaaaaaaaacccttcagaagaccttgttgttaacgcaaggtcttggagtttcttggaattagggaagaccttccccgggccacggccaattccctcttcgggggggggttccggagctcgaatt

SEQ ID NO: 506245 - DNA, 174 bp, Homo sapiens
agagatggggtttcaccatttggccaggctggttgagaactcctgacctcaagtcatccgcccgtctccgcctcccaaagtgctgggattacaggtgtgagccaccgcgcctggctgattttattttttaaagatgcctgtcactcaggcgggagtgcagtggctcaaacatgg

SEQ ID NO: 506246 - DNA, 551 bp, Homo sapiens
caacgaggatcccgggtacgagcttaaataagtagtcagggtctactgtaccatgccatggaggcttcctgatgcaagagagaacaacaaagcgctcataatcctaaggtcaagagcggttcagcctcacctgatataaataagtaatgagggacttgccccaaatacccctctaactggagtgaagcatccgaaggaatagcttgaagtaccccttggcttctcttaacatttaagcaagctgtttttatagcagctcttaataataaagcccaaatctcaagcggtgccagaaggggagggaaagggggaaatgcgggcaaacacttttccctagcttttaccaaaaacctggttacaaacaaggactaccccaaaaagccatttactctgacaaattcgccaacccgtgccccataagatactaacaaaggaacccttacaaccagtacaaacacggaatgcagacccgtaaaacatgaaatcccaggtaggaccataaaccaataaaacaggttatcaagtgaaacgatagaagtcaggaattatag

SEQ ID NO: 506247 - DNA, 366 bp, Homo sapiens
gcaacacacgtacagagagcgttctgtgtatccagcaggtgcagttactagccactgtaggtatctgagataactagtacaatatccaaatgaagacactgtcatgggtacaatatgtgtgtatagttctatgccattttatcggtcatgtgttcaagaaaccatcatggcactcacacatagagaacgtgtgccatcatcactaaactctccttaaatctacacctctatcacaatcaagcccagaccgggtgtggtggttcatgactgtaatcccagcactttagaatgctgaggcgggcggatcatgaggtcaggagttctagaccagcctaacatggcaaaaccacatctctcataaaaata

SEQ ID NO: 506248 - DNA, 379 bp, Homo sapiens
tgtagtgatctagaggatccctcaaaacgtatcagaacctatttctttatttaaaaaaaaaaaatgatggccaggcacggtggctcatgcttgtaatcccagcactttgggaggccaagacaggcggatcagctgaggtcagttcaagatcagcctggccaacatggtgaaacctcgtctctactgaaattacaaaaattagccgggtgtggtggcacacaccttagtcccagctactcgggaggctgaggcaggagaaacacttgaccctggtaggcagagatagcactgagccaagattgcaccactgcactccagcctgggcaacagagcgagactccttctggaaaataacataaaattcagtagtgtcagggtc

SEQ ID NO: 506249 - DNA, 707 bp, Homo sapiens
ttagtgctgccacactccctgggcatgccaggtgccctggtgcccacccctgtcgagcccctaaggatggggaggtgggggtggcacggaagcttctgtcctcccacattccatgcaccatcccctctgtaatataagcatctcccccctcctacgattgagcagggagcctgcaatggaaatcacatcccagcccctcagccattcatagtgagcaccactcatgccaaagtgtgagcatggtgtgggacactccaagttggagagcaagctctcctgtagcattgcagccgccaccgcccgatgatgccatgttcaagcaccatactagaggagtgctagatgctgagggagcaatcctcacttcctttatgtacaatatgtcgtccattggattagtccccttgaccctagtaacctagccatgcccccgttgcttgctctcctcatttacatagcccatattggcaccccttgtccattaaagagcaacaagagccacacaaaacacttgttgttagctttgagaggtcccacccaaatgacaaagaaaaaacaacatagtgaaaacagtcatcagtaaaaaaaaaaatagaataacatataacatgtacataacaccacaaaccaccattaaaattattagaacacattagtgcgtgagaatacatagatattgccaccgagaaaagtaagcacaagaaata

SEQ ID NO: 506250 - DNA, 287 bp, Homo sapiens
gggtgaacagggagtacaggaggggtctgagcaagcacccttgtggggtcccctgtgttgaggataagcgaggtggaggtgtttcctatcttcaccacctgggggcggcccgtcaggaagtccaggacccagttgcacagggagttcagacccagggtcccgatcttaatgatgagcttggagggtactatggtgttgaatgctgaactatagtcaatgaccagcattcttacataaggtattcatctgtcgacgcggccgcgaatttagtagtagtaggcggccgc

SEQ ID NO: 506251 - DNA, 1096 bp, Homo sapiens
cctgatcatactgaaaacaaatcaaatcatttactgtgtaaattgtattcttaacattttgtatttcagtaggattgatctctacttctctgagacaagggttgtaaaatgtatttgctctcaagcaacttcatccccttcttagtattaggtcattcttcatctgctgtaactcttctacttaactttgagcattcttatcacatgaaaatagttgcaagggtaaggtaattaactattagatcaccttcatttctaacagcaatttattgagctgcttaaaatttaaggctcgtaattagaagtggagtatcgtgagctaaaacgaggagcccagggagacaagacttgcaaagtaagatagagttgcaaatcatcttgtacgcatctcagcctgtgataaataaactcgttctgcacgaccaacacgccaaaacagcgcaatggccaaggggccatacatctcaaattctaagcccaagactacggcaaagactaccgtgctcatcactgggacaaggcaattctcacattcgcgcaaccatttcctatggttaacaacgaataatttccgcattccaattgaaacaagtttaggccccctttttcacaaagcccatctgaggcgcacaacgacccaaacggtgcaacgcaacaccgcaacaacaacctggttctccaattgcactctctctttgggttaaggcggttaggcacaacagtcggacacttcactttaagagcttaccacacttggtcttggaggttacgaattacggaaaagcttcgtccatccaatttttcacagaaacaagctgttccattgatcgggaacaaagtcccttggaacttgattcacctctgccaacctttttcctttcactacacgcggacctttcgcacgtcatctcgtccaacaccttaaccatacatccttcccttgtgttacacacggaactacttgctcctacaccacagtagaagcaaccgccaccacgacaacccaagatcccaacctctccacacaaacacgactgcttgtgcagcacacgcacctcctcgccgcactcactatcgaagaacacctctcttctgc

SEQ ID NO: 506252 - DNA, 628 bp, Homo sapiens
  misc_feature (384)..(385): n is a, c, g, or t
ggaaattgttttattttaaaattaccttcccaacaaaccatgaaacacttggatgttactttatggtttttcattgaaaacatactacattgtagatggaatttctaagtcagacatagaattgatcaaaatctaaggacaatattatgtaaggacaatattaaaaatggatagaaaaagcttcatttggtgaggttaatctaaaggatgcataaccatgtcacggtggacggataaaaaaggtgataaccttgtgcttttattcaactaaggtacttaccaaaaccttaggttttatacaggtgttaagctcccacctggaaagggacagttttctatattacacctaaatttactttaaataactgaagcccaagaaacagnntgtttaaaagaactaacaagccaatagctacataatttaagtaattaaataccactaagacagtgtaatttgatgtctcaaactataaaactgggaaaatacccactggcacaatttggaggtggtaaagcggccatcaagaagttgaccatgcagggatgccttttcagttcaagctcaaattgggggccaaccaaattaagcctttgttaaagttttgggtaggaaagcttgaactcaatt

SEQ ID NO: 506253 - DNA, 551 bp, Homo sapiens
  misc_feature (178)..(178): n is a, c, g, or t
  misc_feature (180)..(180): n is a, c, g, or t
  misc_feature (182)..(182): n is a, c, g, or t
  misc_feature (375)..(375): n is a, c, g, or t
  misc_feature (458)..(458): n is a, c, g, or t
gatagaggagggtgggagaatgctttcaagggtggagaaaagaagttggggagatggcaagaacaaatggagggagacaggaatgtaaaagattgacttggcacagagcaaactaattcagaggagggacatactaggggataatggatggcagatgatatgggtcaaaggatcctangngnctggccttgtgtcatagataaagattatagaccattgattatagttcaaccacctgatcctgaggttggccgtataggagatgcttagtaaatgtgggctgttgaatatagttccacctactgtgtagttgaggaccctcatgaggaaaatgatgcccatggtcctgcagctgccagagaagggattctaatnctgctctttttagttctggtacagttgggattttagattctgtctggtatgcaagagagaccattggccaagtgcagtggctnatgcctgtaatcccagcactttgggaggccaaggtgggaggattgcttgagaccagactgaacaacatagtgagaaccacctctttaccaaaa

SEQ ID NO: 506254 - DNA, 96 bp, Homo sapiens
catcttattttagggctccacattcccttcagttgcagaggagaaacgggaaggtaatgcaaatagccaatgacaccatgctccttgtcccctgcc

SEQ ID NO: 506255 - DNA, 567 bp, Homo sapiens
atgattcttggtcttgctgcatttcgtcgccctttttcaggctgctgtacactgaccgtcgtcaagactggactgcactaatccgtgatctttcacaaggctgcactcaagatagtcattggtaactcgtgtgtatataccagttccacaggtctttgagcactgggaccatgaagttgttagcacaatacatttctggccttgtagcagggttgtataggatgcgaggctccattccaaaaacagggagccgcttcagtgagctgccttttccaactgcaatcaattcattgtttctcgtcaactccacctcggaggcatcgaatcccagctccttgccaaggaggccgtcctggtcctccatggggtccttgatactatcctcgtcacagacccactcctcgcagcaactgcccggtaactttgaccagccgagggttgggacagcccaagttgaggagagatagttcttggggacacagaggaatgcagcccacgccgccatcaatacatgtgcactgatgtttacagttgggctggaactttccccgtattgagtgtgatctg

SEQ ID NO: 506256 - DNA, 597 bp, Homo sapiens
gcttagtgttccctttgtctgtaacagtaatgctggggtgtatatctagtggtgatttttttttttaatcatcatcagtcttaaccttgggtaacggggatgctactgtaaaaaaaaaagctgtgccttctcccctactggttgggttatttatttatgtaggtataacttcatggatatttatttaatcctacaggttaaaatcccttactatcgtcattctggttatctaagtggtcccagattgggccattgagagatcctccaagctaactactgagttctttggcccgcctctttctatcttcttctttttttctttttttggagatggagtcttcgctctgtcaccaggctgggatgtgcaggggctgtgatctcggttcactgcaacctcggcctcctgggtacaagcaattctcgtgcctcagcctcttgagtagctgggattacgggcttgaaccaccaggcccagcctatatatgaaacgggatcatgataatagctttaagggaaaataacagattccacgcagggatgatattcaaacggtttcgtagtgcacacagtttaagcactgaccaataacaaccagat

SEQ ID NO: 506257 - DNA, 395 bp, Homo sapiens
tgcagtgacacaatctcggctcactgcaacctctgcctcccgggtccaagcgattctcctgcctcagcctcccgagtagctgggattacaggtgcccacaaccatgcctggctaattttgtatttttagtggagacggggtttcatcatgttggccaggatggtctcgatctcttgacctcaggatccacctgcctcagcctaccaaagtgctgggattacaggtgtgagagacaacgccccggccgtgattagcgttttttttttttgagacagagtctcgctctgttgctcaggctagagtgcagtggcgtgatcttagctcactacaagctctgcatcccagattcacgccattctcctgcctcagcctcccgcccttctgtcgtcttctcg

SEQ ID NO: 506258 - DNA, 314 bp, Homo sapiens
  misc_feature (199)..(201): n is a, c, g, or t
gagattgtgattatctaggaagactaggagggtaactagaggaaacgtcttcagggcctgtttgctggctatgcttcgagaactggggatccgaaaaattaggggaatttcttcgagaaagacaatatcagcgtgcattatttctgtcttatcttatctagtaagctgcctcagaggggccagtccaacagaggttcannnatttctgcctgtgaagacatcaaaaaggaggcagcccgggcttctaggaagatctgctttgtgtgcagaaaaagggagctgctatcactgccagagatcagtgctcagaactc

SEQ ID NO: 506259 - DNA, 323 bp, Homo sapiens
tgcagtgagccaagatcgtgccggtgtactccagcctggacgacaagagtgacgcttcgtctcaaaaaaggaaaaagaaaaaaataaatctttaaaaataactagttgctgggtgtggtcgtcacgcctataatcccagcactttgggagtccaaggtggaaagatttcttgagctcagaaatttgagaccagcctgggcaacaaagcaagacctcatctctgctaagaataagagaaaattagctaggcatggtggcagatgcctgtagtcccagttagtcaggaggcagaggtgggaggattgattgagcccaggagagct

SEQ ID NO: 506260 - DNA, 286 bp, Homo sapiens
ttatcgcgctaacacaataaaagcctcttcctctgctgttcgtttataatatcccgcacatctttttggttataacaaaaagaagagaggcgactctctctatacaccacttctgtcacaactctgtcgctgccttaataaaaacgatgctaattttgcaaaactatactctgtgttgttgtagatacatctctttgtttgctaacaaataaattgtataaacgggctctttgtaacttgttcaaccacatttaacacaaattcccttagtataaaaaataaaaaa

SEQ ID NO: 506261 - DNA, 124 bp, Homo sapiens
caggcatgacgtactctgaaggtagctgtggccatctgggacacagcctgttccgaatggggctccagggaactgctcagccaggtgattcaccagtgacactgggcaggccagtgtgaaccct

SEQ ID NO: 506262 - DNA, 328 bp, Homo sapiens
ggaaaattaaataatgtgtactaggtttaatatctgggcaatgaagtcatctgtacaacaaacccccatgacagaagtttacctacataacaaacctgcactttcacccttgaacttaaaagttttttaaaaaaatgactttagtgctgtatactaggcattgtgtgacttggcaacattttccacatggagaaatgaagagtctgagactactgttggggggaatgatattcacagcagagtaagggtcatggctggcttacatccagactttgagctggttctgcacatgtgaagtaaggacaggagttctaaataagaagatgta

SEQ ID NO: 506263 - DNA, 454 bp, Homo sapiens
  misc_feature (129)..(129): n is a, c, g, or t
  misc_feature (354)..(354): n is a, c, g, or t
  misc_feature (433)..(433): n is a, c, g, or t
  misc_feature (454)..(454): n is a, c, g, or t
ggaatctattttttgaaactattatgcaagccagtggtactagaaagaatgttttagaaaagaaatatgtacaggtgacccatagctacctcactgtcactaaaatgttttttaataatcttaaagcangattctgcacttcatcggtaaagactattgaattgctttctcgtgcttgtataaagccatgtcacgctgagaaagaagaatccactccgatgaaacgtatgccacgacggtacatgtgcttatgcggttattacttcgcatactgtgattcgaaactttcttgatgtcacgatcataacagttcagcttctaaggtcatcagaaagcgcaatgtgtatttcaccnttgcttttatctcagttaaagaggtgattagcctcttgctagatattaaactatgatacagcaaaggcgtcacttcagntcaacacaatgataaaaaaan

SEQ ID NO: 506264 - DNA, 674 bp, Homo sapiens
  misc_feature (315)..(315): n is a, c, g, or t
  misc_feature (439)..(439): n is a, c, g, or t
  misc_feature (546)..(546): n is a, c, g, or t
atttttaaataaggtaatatcaacctgaattccagcaacctgttagtgaaagtctcgtctgttccatgtatttgcgagaagcacatgtaccgtcccacaagaatattcccattcgatctactgaacttaataagattgagtatttaactacatcgaacactgtagattcagtttagccaatggagttcacgataggatagagtaagaatacatcaagtgtagacaggtagctaacattcttctagcgaaacagtatgcttatatggagtaccctcgaaagtatccattttggctatactcatcacctgcaattanacaggttaccgtgatgagaggagccaaactacagaagacagcaaggtcaaaactacgcgcagacaagtaagctcgactagagtatcttctcaactacgtcctcatagtagtacatttcttcaantatcttctaatagtagtactgagttaaacttttagttacactaagagggagaactaccgattcaattctcatatatgatgtagacttcactctcgtctgtctatatntcctttcactttccttcaagtaggctcacatataaattctcaacttggttaagtgtgattcttgtgcaatttcccgatattttttgagtttcccaagtgtatccttttctcaatttgcgggcagctta

SEQ ID NO: 506265 - DNA, 157 bp, Homo sapiens
ggcacgaggatggcgtgcacttgtaatcctagctactcagaaggctgaatcagataattgcttggaccccagaggtggaaggttcacaagtaaagccggaggttggcaccactgcaactccagcctggggtatactagtagcgagtactctttcctc

SEQ ID NO: 506266 - DNA, 177 bp, Homo sapiens
ggcacgagggagagagagagagagagagagagagagagagagagagagagagagagagagagagagagagagagagagagagagagagagagagagagagaccgcgagctcccgcggcctcgctgggcctggctgggcctgcggaggccccgacctgtgcggccctgctcggccagg

SEQ ID NO: 506267 - DNA, 462 bp, Homo sapiens
  misc_feature (22)..(22): n is a, c, g, or t
  misc_feature (43)..(43): n is a, c, g, or t
  misc_feature (67)..(67): n is a, c, g, or t
  misc_feature (95)..(95): n is a, c, g, or t
  misc_feature (211)..(211): n is a, c, g, or t
  misc_feature (331)..(331): n is a, c, g, or t
  misc_feature (336)..(336): n is a, c, g, or t
  misc_feature (358)..(358): n is a, c, g, or t
  misc_feature (406)..(406): n is a, c, g, or t
cccccccagacctgccgagagncatcatgcatgtgcatgagtntgcccatgggcagacatgtgcctntcccagcacagcgggcagaatgagattntccacactggccccaccctccaagtcgacctctaccccatgtacaactttgaccccacggaggaacaagatgagttggagcaggagctgctggagcatgggcgggacgcgcctctntacaggctgctacttctgtgcaggccatgcagggcaagactactctgccctcccagggcccactgcagagacccagccggctggtgtttaccgatgtggccaatgccatccatgcgtgantgggnctggggacaagcctgggacttnttgattagaggacccattcaagggtggcctacagaggttccccaattnccttgattgtcaagacctaatctgaagatcttccctgccaagacaaaagaggggtt

SEQ ID NO: 506268 - DNA, 124 bp, Homo sapiens
tgcagatatcctgaggaactttttattggtttgcatgatattggacatggaagttttggagcagtttattttgctacaagtgctcacaccaatgaggtggtggcaattaagaagatgtcctata

SEQ ID NO: 506269 - DNA, 168 bp, Homo sapiens
tgacgaccacgtacaggagctgtctataatcgataaaccccgattaacttaccaacccttgtcaattcagcctatataccgccatcttcagcaaacccgtaacaaggaacaatacgtaagcacaatcagtaagcacataaaaacgttacgtctgtctgtgaaacatgt

SEQ ID NO: 506270 - DNA, 137 bp, Homo sapiens
caaagtgccttgtggctaagaagtgggctatggcatttttatatcttagagcggaagcctataatacagtggggcccgctcatacgggatagccattgctaggtttatagatagttaggtggttagcgttaattagt

SEQ ID NO: 506271 - DNA, 222 bp, Homo sapiens
ctgcaaagtattctagaatagaaaaaatctgaagtctgtaaaatttctgggcccgaagcttttcagataagagatactcaccctgataagtagtagtaacagtaatatgtggtgatgagaatattctagaggaaaaccattggaagtgctgcctgctttctggagttctggtctgagggatggagaaagtttgcccatagtttgctttgggaggctgggagg

SEQ ID NO: 506272 - DNA, 319 bp, Homo sapiens
aagaagtcatgcagatcatctagagtcacactgtcatgtaatccttgttaccataaattgcacggttgtcagagtcttcagtctggatctacaggtgggcctagatcaagatctggctcctgtcatccatgggtccgcattccacgcgtgtcctcctccccggccacctctgctcatgcctccgatgatcataactccgccctcttcccctgtgccggttatcagggtcactcatgctccggttctctcctggttcggatgatcctccagactcctccccatatacacccatgctactggggtggtcctgtcggtaatg

SEQ ID NO: 506273 - DNA, 358 bp, Homo sapiens
cgaggtgggcggatcacgaagatcaggagatcgagacaatcctggctaacacagtgaaaccccgtctctactaaaaatacaaaaaaattagccgggcatggtgttggggataacatcacccaacacttcaggaggctaaggcaagaggatcacttgaggtcaggagtttgagaccagcctggccaacatggcaaaaccccgtctctacttaaaagacaaaaattagccaggggttagtagcacgtgcctataggagatcgagaccatcttggctaacacggtgaaacgctgtctctactaaaaatacaaaaaattagccgggcgtggtgttgggcgataacatcaggggctcctctag

SEQ ID NO: 506274 - DNA, 477 bp, Homo sapiens
gtatatttatacccactttaactgcgtgcagatcaggggtggtttatgtggacatttctagggaagcggcagtaactttggggtcatcaggccatgccatggaaaggggcggtaactcccaggtgtgccatggtgatggtaaactggcatgatgcgttggtgggcgtgtcttatggaaggctgcttcctccctgaccctgttttatctagtcctcaatttggtcttgtgtctgagccccacttctggagtcaagttctgcctcttatctccatttctccaactaagatctacaaatggcccatagcacacaaaaagatgctcaacatcattagcctttagggaaatgtaaatcaaaaccacaagaaggcaccacttcacacccacaaagatggctacatccaaaagacagacaggccagcacggtggctcatgcttgtaatcccagcactttcaatacagtcagcaccaccaataca

SEQ ID NO: 506275 - DNA, 383 bp, Homo sapiens
gtctatagacatccgcctacacttggatcgctggtcaataagaccctgccggctgtagagagcagtcgagtcagagaatgtgcggagataatactatcattcgatccgtgtagcattgcctaccgccatcctcgtcgataccgcactcttgactcgtagaaccccctcgcgaccacgactggggtctcgcaagagcgaggggggtaagacatcctccacgatcttaggacattctcactccgtcttcttcctgctcgtggtccctttggtccgcagggtgttcttctcctgcgtctccgttttcttcagccttggccttgcggagaatttggcagtccgattggggcggggtcccttcagagacccacaggccggtgccatcg

SEQ ID NO: 506276 - DNA, 220 bp, Homo sapiens
caggaggatcacttgaggccaggagttcaagaccagcctgggaaacatcacgagaccccaagtctacaaaaaaattaaaaaattcgccaggcagggtggcatgtgcctgtagtctgagctactctggaggctgaggcagattgtttgaacccagaagttaagggtcacagtgagatgtgatcatgccattgcattctagcctgggcatcagggtgagacc

SEQ ID NO: 506277 - DNA, 196 bp, Homo sapiens
aaggatccccgaattcccgctctgtgggatcctattgctggtgactctgtgtgaactggccttctgcaaagatcacagagggcttaagcggcacatgacagtccacgaggtgctgggctggccttcagactggacagggtctctgctgactgccacgggcgggggctctgcatagccaggatgaccgctttcatgt

SEQ ID NO: 506278 - DNA, 510 bp, Homo sapiens
  misc_feature (459)..(459): n is a, c, g, or t
  misc_feature (469)..(469): n is a, c, g, or t
  misc_feature (495)..(495): n is a, c, g, or t
ccgaagcggcgggatgagcggccggcgtgggcggggcgtccgaggagagccaggccatgcaggccacgtgtctattatcctcccagtccacaacgctgaaccatggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcgtacctttgctttttggattcggatgacgtcatgatgccccagcggtggaggctgcaacacgaggctgccgtttcagcacccgtcgagcatcattggtttgcagagtgagggagagatccccttaattncaccgaacgnttacacatttgggttcaaccaggttngacggccggagcagg

SEQ ID NO: 506279 - DNA, 1400 bp, Homo sapiens
aactcaatttttattcttctatttaatacatggatatttggataaattttcctttaaagagtttgcaacccttggaggcaagtgttcctttgggttacgttaacgtattaaagcaacagcaaatgtgaaattctgaatgtgcgggaatgtgacaacgtggactttcgaaacattaatttaatatttcagtgaaattgtgcacacgattatccaattgagttattcatatgtgttcttcgttcttagccttctttaattccaaccttattcttcaacgtgcctttggcagtttgtgcgcttaccagaacaaccgccaagcttcttcttacgattacattctctgtggtcaagtgtgtaaagtgctgtgcacactttctgtggactgtggacagatctataaataaatttacacagagtggcgaaatatctacaatctctcagaggggaattattgtgtggtctgtagggtgagagtgtgccattgtgtccacagataaacgcacatgtgtcccttaagtgtatccctgtggaccacacagagctcttctgtgcgccccacgatatatagaaaactcttgtgggcgccccccaacagaggggggcatgtgtaagatgtggcgatttctgtgaactgtgcggatgttgtaaaccctctccgagagagtgcccctatgtgcagaagggggctcaccctgatggtgggggacaatctcccaccactgcaggagcggagacagcaaagtgttatttattttcacaactctggtgacaactctcttgcgaggcgcgcccgcgactttattttcaagacgggggcgttatattcgcggcccaagacaaaggcggaccagagggggggccacaaagggccccagatattgtcgcctgttggtggtatatcagaggacagggaaggcagttgtcgacacagcagattgtcgacgagcgtctaaactgtgggggtgtaataacgaaggagaaccacaaggggttgcaaaattcttcggaaattggtacctgtgggttttaccagaggcgacacggctatatgggcgcccccaattcccaacgggggaagaaaagaaattgggtggggcggaacaagataacggcgggatctgataaacagccggtttggtgaacactatcagtggtggaataccacccggtggtgtgggccagcacggaacaaatagagggatgaaccagatggattataggagcccctaatacaacgtctgtatcaagggcgcagaaccaccaactatattggacctgggattattatattatccacgcatagcttaacacgtctcacaaaagtagattgtgctccccagacagaaccacctcttttcgatggcggatcaccttcgggtcgcgtaaacacaccaatttcg

SEQ ID NO: 506280 - DNA, 468 bp, Homo sapiens
  misc_feature (337)..(337): n is a, c, g, or t
  misc_feature (453)..(453): n is a, c, g, or t
  misc_feature (458)..(458): n is a, c, g, or t
ccgaagcggcgggatgagcggccggcgtgggcggggcgtccgaggagagccaggccatgcaggccacgtgtctattatcctcccagtccacaacgctgaaccatggctggacgaatgtttgaggtctgttttgcaacaggactttgaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcgtacctttgctttttggattcgggttcccagggtgggagagcctntgccaccctcctgtcccccgactcccgtctttcacttggggaaccggccgcattggttgttccacgtgcacaggaagccacatgggctttcccgggaaccgccccgaaggcctttngaaantggggggctt

SEQ ID NO: 506281 - DNA, 235 bp, Homo sapiens
caggatcccctcagggcgcgagctgcagaatgtattgaacgtgacagatagaacaggacaaatgggcacggagcatggaaaggaaaggaaacggaagagtaaggtctgaacttagcaaggtaaattaaggtccacggttcctgagggactgaacgcacagagccgagaacgtcccgtgacattgggtaccacgaagggtgtattctcatgcacaaccgcagctcgcccctgagtt

SEQ ID NO: 506282 - DNA, 807 bp, Homo sapiens
  misc_feature (756)..(756): n is a, c, g, or t
  misc_feature (766)..(766): n is a, c, g, or t
  misc_feature (792)..(792): n is a, c, g, or t
cagcttcccgagtagctgggactacaggagcctgccaccacgcctggctaatttttgtatttttagtagagatggggtttcaccatgttagccaggatggtctcaatctcctgaccttgtaatccacccacctcggactcccaaagtcctttcagtttttttttcactttcaaaaacatgtagaaggcagttcagggaaagctaagacgtaaagaatcttacaagcatgttaagagcctggagaacaggagtggacaccttttgttgtcacggcatatgtgcgggtggtgaaggggaggtaaattagagccatggaaagggaactaagttttcacacttctgttaatccatttctttggaattccagtctattatcctcccagtccacaacgctgaaccatggctggacgaatgtttgaggtctgttttgcaacaggactttgaaggtaccatggagctgtctgttttcaatgatgccagtaaggacaagtctggggctatcattgaaaaatggagagtgaagctggaagattctggtgtccacgtgatcattggggggcacgattctccctctcctagaggcgtcggatacgctaaaaatcaagcagttgcccagagctcagggtcgtacctttgctttttggattcggatgacgtcatgatgccccagcggtggaggctgcaacacgaggctgccgtttcagcacccgtcgagcatcattggtttgcagagtgagggagagatccccttaattncaccgaacgnttacacatttgggttcaaccaggttngacggccggagcagg

SEQ ID NO: 506283 - DNA, 926 bp, Homo sapiens
  misc_feature (926)..(926): n is a, c, g, or t
ccacgcgtccggttttagatagttgatatgaaactgtaaactcactgcaaatgaccacagacctctgaccttctacttttatagactttaatacataagtaatttaaattagggtggtatttatttcactgttttcctatctaaatcttaatttcctggaataataatgttgatattcagcaagaaaactgcttgagtttaagccattttcaaaagaaacttgccttctaactcattgtgttccagaacattaagtgactaataggtactgggtattagtgatggtaagtttgtgttcttctttctggaatgatccatataactgtggggtgcatcagtgcttttcaaaggggctgcatactatagggttaactatgtatattcatgttaagagttaacttgtggtttggctgtttcctggattttaaaacatatacatgtgcagagatgtattcaaatgaaaggaagcatatctttatcaagatgctagtaaaactgaacatcaactataatatttcattggattttttttctttggataatgccgagaaacgcctaatggattccttttaattgggagacgctctcttctgtgtagaacagttgttccaagatagcttagtgttttgtttcctgtttgctgacagaattttgttccagcaggggagtgctgtagagtcagtgtcttaaaaaggggtttaagccaaattactttctaatctggagctattgcgacttgaagtttgtggaagagctaaaatttttgtaaagcctaaattgccgttacttggcccacaggacaattttcaagcggggccgggtcttcacggagacattggtaaagacagtgtgcttaacaacggagggggtgaaaaaaataaaaagggggtggcccaaataaatgattatagatccatcaatatttn

SEQ ID NO: 506284 - DNA, 868 bp, Homo sapiens
  misc_feature (597)..(597): n is a, c, g, or t
  misc_feature (603)..(603): n is a, c, g, or t
  misc_feature (614)..(614): n is a, c, g, or t
  misc_feature (763)..(763): n is a, c, g, or t
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaaggtacagatagaggcctcaccccctctgggaccactggcactcagggtgtttgcagcctcagagcccacctgcccccagggccacngctgcntctcctgcccngctgtcattacagggatgggcaggctggcatgggggcagccgctgcccctgcctgggtgttgctgtgtattcctgccggccaggggccactgccagggccacgccgtcccctttcatttcccgaatcttaagatctgctattgtggtantctggtggaaaaaaaaaaaaccgcgtggctgtttttgaactgcctggtacctaagaccctgaattcttttccccccccaaggggaaaactctatattggaacaac

SEQ ID NO: 506285 - DNA, 748 bp, Homo sapiens
  misc_feature (643)..(643): n is a, c, g, or t
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggagggatgggcaggctggcatgggggcagccgctgcccctgcctgggtgttgctgtgtattcctgccggccaggggccactgccagggccacgccgtcccctttcatttcccgaatcttaagatctgctattgtggtantctggtggaaaaaaaaaaaaccgcgtggctgtttttgaactgcctggtacctaagaccctgaattcttttccccccccaaggggaaaactctatattggaacaac

SEQ ID NO: 506286 - DNA, 210 bp, Homo sapiens
cacctgtgacgacgttccatacttcgtgaatagcctgagtcgtaatatgccggtaggagcaggctccaacatttagtctccatcaaccgttgactgggaagtagcaacagatcattctgatttaccagcaggtggagacataggaccaccacctggtgccagcgcaggaacataccagacattggccagcaagcaaacaaaaattcctca

SEQ ID NO: 506287 - DNA, 368 bp, Homo sapiens
cgcggttactgactacgcggctcatgcagcgacatttacaactaactgagcacagccaaatatagatgccttacatggtgtatcgcgaggcagactctgactatgtcacccaggacggaggacagggcatagcctcactgcagccttgacctaccaggctagaccaatcattccacttcaccctcccaagtagctgagaccacagggacacaacaccacaaccagctgattgtcgtactgactgtatagactggatctcactatgatgcccagactggtcttgaattcctgagctcaagcagtcctgccacctcagtctcccaaagtactgggattacaggcgtgaggtacctcgcccagccgcgtag

SEQ ID NO: 506288 - DNA, 722 bp, Homo sapiens
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttgggtaagttggtgcattggagctggaacagggtcaatcctccaatgtaaactaagccctcctgtgcaaaatcttaagtgactggagggaccagtcggtcttgtgttcacattgaggctagaagctgtctccaggggagtaaaaaccggattatttaggtcttcaacaggacaactgcccctagaggcgttgcaacttgttggctgccgtgtcaccatctgtgtcattaagtggcagagattacagaggctatgtctaacgctcagcgtctgcccgtgaacgtttgactgtttgataagttctcaccactcctgtttggtggacaaggcaatctggtttcctccgtggaatacag

SEQ ID NO: 506289 - DNA, 158 bp, Homo sapiens
ccctcgcgacggtgttatcacagaaaatgaatgaaactaaactcctctctctcatcatatacaaaaatcaactcaaacatgcattacagacttaaatgaaagaccccaaactatagaaactactagcaagaaaacctacgaagaaacacttcagatat

SEQ ID NO: 506290 - DNA, 272 bp, Homo sapiens
tttgaaattactgttcttgtacacaggtcattcccaggttctcagtcagaagtccatagttctctgttagcaaagtatgaaaagtgaggctgggtggcgtggttacaccttgcattccctcactttgggagggcggggcggggcgatcatctgaggtcaggagttctaaaacagcctggcccacatggggggaatgccatcttctactaaaatacaaaaattagctgggtatggttgtaggtgcctgtaatcccagctactcgggagagctg

SEQ ID NO: 506291 - DNA, 391 bp, Homo sapiens
cactcaccacaccgacctgcgatgagaaggtcgtctggactgtgttccgggagcccattcagcttcacagagaacagatcctggcattctctcagaagctgtactacgacaaggaacagacagtgagcatgcaaggacaaatgtccagcgcctgcagcagctggggcagcgcacggtgataaacggtcgggccccggggtcgccgctgccactgccctggcctcctgctgggccccaatggcctgcgtcctgctggccggcttcctgcgatgatggctcacttctgcacgcagcctctctgttgcctcagctctccaagttccaggcttccggtccttaggccttcccaggtgggactttaggcatgattaaaatatggacatatttttgg

SEQ ID NO: 506292 - DNA, 888 bp, Homo sapiens
  misc_feature (617)..(617): n is a, c, g, or t
  misc_feature (623)..(623): n is a, c, g, or t
  misc_feature (634)..(634): n is a, c, g, or t
  misc_feature (783)..(783): n is a, c, g, or t
agcggctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcgcgagccgcgggatgggggcccgggccgcggaggaggcgccgctgctgtgtcccttggtggagagggcgctgccggccctgcgcggtttccagccaggaagcttcgggaagcctggacgtctgctcactggagatgacacgtgcgtggggtgttggcattcttgttatttaacacgggaaggaggtgacttcgcctgtgatggacttccagtgtgagcactggccagagtgaccaggctgaccagcaccagccctgatccagatgcagaggccaggatgtgggcccagccctgtgccaggaggctggctggaataaaggtacagatagaggcctcaccccctctgggaccactggcactcagggtgtttgcagcctcagagcccacctgcccccagggccacngctgcntctcctgcccngctgtcattacagggatgggcaggctggcatgggggcagccgctgcccctgcctgggtgttgctgtgtattcctgccggccaggggccactgccagggccacgccgtcccctttcatttcccgaatcttaagatctgctattgtggtantctggtggaaaaaaaaaaaaccgcgtggctgtttttgaactgcctggtacctaagaccctgaattcttttccccccccaaggggaaaactctatattggaacaac

SEQ ID NO: 506293 - DNA, 1516 bp, Homo sapiens
gtgcaaaagtatggttgatgctcacttgtgtgggagggcgacaccactacggatggaacacgccagacaacgcccgcgttgacaacttttgcacagacagctgattaacatgtcacctgtgtgttggtggggggataattaattattacactgtctacagggcgctcgacagccccatggtgttcttgctccgcactgttgatggatcactacacagcgaattgtttatgtactaacgcgtctttataggctggtgcgctcgcattaaacgtgttgtgcttctgtcactacgaatgtacgcataaacggctgtgatccctttctgggtcctgttttgtggggggttggagtcgatgagcccgtccttgtcgggcccgtctcttgtggtgagttcacatcacgtcccactgggacttgtgtgacacgtgttgctgttccaacgaccgcagggcctcccatagatatgcttgcgtttgcaacgagagaagtttgtttcgcttagatgaggattgttgtgttggtggagcgaaacaaagttgttctaatgaagtctggtctcggctcccaatagacaacagcccgccccttccatactgtcacgttgtgtgtcctacgacggaaactacggaagaatgtatgttgtcgtcagaagtggccccccccctgtgagtgtcatttcacgacctgggtggagtacacccccggcgtggatgtattgcttcccaccctcgctgagtgtggtgttcttcccctctctaacgcggaattgtctttcgttgcacaacaattgtaggcgcacggtgattcccacacgggatattcgacgacacacacaagcgtgggaaaatatgtagagaccctatgggaaatccctctctgtggtgttagaccggggcctccccctccccgatggggttacacccaccagagttcgcccttgcaacattgtttgtccacagagaactcgtgtggatagtcgtggttgccagaccccttggcatagagcgccttttacagtgccactcgcagaggagacggcgatattatgtcaccacaaagacccccggagaggtgtttctcaccaccacgagcggcttttcccaatgtatctccatctcttaaagatagggtgccccccctgtagagcccatctcttgtcgtggccagatttcacccttggaactgtgccaggaagtgtgtacataacatctcagacgtggcccgtcaccagaatctcatctccaatagggtatcagcttgcgtcctcgtgccagtgtgaaaccaccaacttcttgaacgtgtatgaaagagacgcccagatggtttgctagccatgtctccacccgatctccagccccatcccaaatgcccggcgtttctacccctggtgccagagaaatagtgataccttccacattttgggaaacatgttaccgtgagaccccggggagaattttctggcccttttaggtgtatcacagaccagaatgtaataaaaaatggtgaaggctgttta

SEQ ID NO: 506294 - DNA, 259 bp, Homo sapiens
ctcgaggccaagaattcggtacgaggaggattcattctccagtgcaatgctgaatctgattccacgtcatggacgtgccatgtacaaacagtgctgaagataatatattacagagatgatgtaaagtcgttcagtcgtcgtattaatcatttgttcttccatatcgatcatgattgaggattttccaattttatggcctggagtgaagtgaccgatcctgataaaggatttatagatgatgatcaagttacctttgatg

SEQ ID NO: 506295 - DNA, 369 bp, Homo sapiens
atctacacggttatcattgcactcatctactcagtgcctctcgtagtggtttagagagccctaatagttaggcttgtattcatctgttgtggcttcttggcatgtgccttccgatagcatgtgtacagcagtcacattctaatagcccatgtacatcttgtcattgatgctggtgggcacttttagaatcatgtggtcagagtccttgaacagcaggtcgttcccatgagcagtcttaaatagttggaactcattggacatgtcttgcccatagtgttcctggtattgtttcagaagcttccaaatcaagtccttcgtaccagccctagttgtgagcacggcggtatgaaaatgtagctggggcttggt

SEQ ID NO: 506296 - DNA, 1260 bp, Homo sapiens
  misc_feature (296)..(296): n is a, c, g, or t
  misc_feature (310)..(310): n is a, c, g, or t
  misc_feature (330)..(330): n is a, c, g, or t
  misc_feature (455)..(455): n is a, c, g, or t
  misc_feature (501)..(501): n is a, c, g, or t
gcggtcattgtgcgaagaccatggttgtgggagttggcactactttatgcggggtggcggtgcgagagagctgggaggcgggatctggtgcgcgccaggcgctgcgacgcgcaaacttgggctccgcgcttcccggcccggctgcggagcccggggcgcccggatccccgccatgtctgcgatccaacctggcagaaggagtacaaatgcggggacctgggtgttcgccaagatgaaagggtacctcactatctggccggctccgttataagaacgacgatgcctgaggcttgccngtgaaatcaacagncaacaaataccaagtctttnttttcgggacccacgagacggcattcctgggccccaaagacctcttcccttacgaggaatccaaggagaagtttggcaagcccaacaagaggaaagggttcagcgaggggctgtgggagatcganaacaaccctactgtcaaggcttccggctatcagtcctcccagaaanagagctgtgtggcagcagcctgaacccagagcccagaagcatgccagcagtggtgcacggtgcatcacagcacaggggcaatgccagcagaggcagccagcgcacgcaggacagggcacagctggtcattgatgagccagccaaggagaagaacgagaaaggagcgtagaagaggagagcaggggacattgctggcaggactctcctaaacgtcccaaggaggcagaaaacccgtgaaggagaggagaaggagagcagacaccataggaggatagagaggaccacaacctatggaggtggaaaagaatagaaccccatctgagcccggaatctggccggaggcatcacaacaagaggacgaagaagagagaggatgaaagacaggacaaggaaacaaaagacaaatgaagaaaacaaaggaatcagaagaacatgcaaccctgaagacaacaaaagatacaaaaaggatgcaaacaaaacaagaataccatgctgccgaattagagaagacaaaagaagcaacatggacgttagaaagaaaaaaatgtgaaacaatataccaacacacaaaaaagaaaatacaaataagacaaaataacacagaacaagaacaaacacaagaaaaatgaccaaaaagtaaaaaaggacaaacatggaacagaaagtaagaggacaaaaccagaagaggcaaacaaagaaagaacaaacaagaaaagaaagacaagtgataaaacaaaacaaagaaagcaaaaagaaaaa

SEQ ID NO: 506297 - DNA, 143 bp, Homo sapiens
  misc_feature (46)..(46): n is a, c, g, or t
ggtacctagaggatcccctacgacgttggtcagtcatcacatctancagatgccagagattagagcgcatgacaagtaaggacggtgtcagcgtctaagaggtttacctcccaatgaagaaataacatcacggtaacgctgca

SEQ ID NO: 506298 - DNA, 156 bp, Homo sapiens
ccaggctctctacctggtcaggtaggcagcatctacttccttcttcagcatcacaacctcaggaggcagcgggacagcatcgggggggaacggggccgcctgaggtggtggatgtacggctcgaacaagggctccaggttctgcctcacagtctgg

SEQ ID NO: 506299 - DNA, 299 bp, Homo sapiens
  misc_feature (1)..(2): n is a, c, g, or t
  misc_feature (52)..(52): n is a, c, g, or t
  misc_feature (105)..(105): n is a, c, g, or t
  misc_feature (111)..(111): n is a, c, g, or t
nngaactctccccctgcctccctgtgagccagggagtgtgtgaactgcggcnacaagccactccactgtggcggagggacaggacaggccactacctatgcaacnctgcgnctctatcacaagatgaatgggcagaacaggccctcatccggcccaagaagcgcctgattgtcagtaaacgggcaggtactcagtgcaccaactgccagacgaccaccacgacactgtggcggagaaatgccagtggggatcccgtgtgcaatgcctgcggctctactacaagctacaccaggtgaacc

SEQ ID NO: 506300 - DNA, 466 bp, Homo sapiens
tagagtgtagtataacttgctgtatatcaaactaatttgacaagttttcatcctacagcctcacatcatgtaattaataatttgcctgtttattgatgacctaatagtgattctatattattaataaaagctaatgggaaaaggatccctgattaagctgatgactagacctacaattaattttcctgccaggtcatcatgaagtcatagtaccagagtattaaaagcatcatgtaatcattttcatttcatcaagatctcatcctttaaacaggaatacgttttcaggcatgtcatcattttgcatgtgcaatccatgtaaatgttgcataatcatgctgtttcattcatcatttcagagtttcaagagattcacttaattgccttttagcccacgtctattatgtagtctatttgccactgtacttaaaaaaatgacattaaaagcaatagttcatgtagagaa

SEQ ID NO: 506301 - DNA, 648 bp, Homo sapiens
ccccctctccgaggcttttctagtgtttggggaaatcgggtgaggtcccaggaaaaaggtaaggggaaccctaaggcaggggtgtaactctttggccctggcggccagaaaagcctataataagggtttgggggccccaaaatgggggctgcagtcagaagaatctgggcacctggggtgatgatttccaaaaagggtcctagggtccagggtggcatttctcccgcagccattgaaaaatttgtgggtcctgcaggcaaagcacaagccagaaggtccgtttgaaactcctaggtaatttgtccccgagcttcatccgaatgggccaggggggtggttttccacttcctcggggaaggggccctgccaaagccctccctgggcacattttgaccctttgtaggattggaattagcaggactgggctatttaaagcaccagtttggggtgggtggggcccctgttgaccccctcctccagagcagccagcccagcccggggaaaaagagggatttcttttcccttgggattcacagcctttgaagagtcaagctccacttgaaggtcactcagtaaaatcctttcaaggggttttaaattgttttgacggccttttttggtagaaaaaaaaattgcccttagaattta

SEQ ID NO: 506302 - DNA, 1255 bp, Homo sapiens
  misc_feature (1255)..(1255): n is a, c, g, or t
gctcgagttttttattaagaacatagagaggtcacaacgcctatttattccccacatcgtcactgccctgacacccctgtgtgtgggcttggcacacacctcaccgccatgaccggtgcagggccgaggcggccccgtcctacggctcacctacgaatacacggtactggcgccaacctcaaagacggccaggagccagggaagccccaggatgtctccgaattgacaaccctgctgctgggaccactggagccgtgggactcgtctgccacccccaaggcctcaggaacccaaacacggctttgccatgacatgtcacaggatactcaagagcaagcatacacatgggtggcctagtacaacgggagccaaagggaggagctgacaaaccttagagggttagtcccaagtgaccatccaacccagagcacaaggacgggggaaagcattccacatagaaggagacacacaagaggcccacattggaaaccctaccaggggcacacagaacagggagcccccacgagaagggagaacaacaaagaaaagaaaaaaacagggccacaaagaacgacctaaacccacttgttagcccaggggggactcaaaagaggagggccctggcgcaaacagaaacgtgcacaaacggatgtgacagcaccccatgagcagacccatcaaagaacagagcaaaggcaacacaaagacaaaaacatatgaagcgcgtttgacgcaaagagaaagtgcgtcaacaaacaatagtattcgtgtgaacaacagaaaagtagcagcacaaaagcgtgtacaacaaaaaagaagtgtagaagaatacaacaacatagggtacgtaataatagcgcacccacaacggaaacagaatatatatgaacaaccgcagggaaaagagcaaatgcatgaatcgaaccacgaaaagagacaaaatctcataaaagtagcacagccacaactcaacgcagaagatacgccacaaaaaagcaaccaaacaaacaacagaagagcgaccaagagagagaaacgaccaacagggcaaggaacgacagtagaaacacgagcaacggcaccacacacaacaaacaaagacagaggcccaaccactagccaacagaaagcataagcgcccaaggaacgaagggaaccgaacccaagcagaaaaacacacgagtagacaccaacaacacaataggagaccgaagaacgagagacgagaaacaagaaccaccaagagacaacagan

SEQ ID NO: 506303 - DNA, 1409 bp, Homo sapiens
gcagcagggtgccagagcgagtggaaccggatgactggacctccacgttgatgtcccggggccggaatcgaccgcctctggtgttaggggacaacgttttttgcagacctggtggtgcaattggctagacttgccagaactggagaagtggtggggagaagggtgagactgggtggtggcactgtgaacccaaaggacgagaaatggccatgcccaggatgctgggccgcaggttatgccctgacagcaaacatctttaacgaacgttcttgcgtagttgtgcgtgctgaccgtgaccggctgctgacacggagaagccaggctgggtgacacccatggtccctgagatcccgaacctggccgctcacagaaggtcaagaagcggagcctttccaagggctctggacatttaccccattcccaggcaccggggagccacaggcgaggggagaatccccccacaagcctgcccaaggacctggaagcactcaccctcagcgattcgatattaacacagctgtttgggtctcgacatcctagagacagaacgttgactgagcctgaacgggccagggcccagttgctgggccctgcggcacgcaggcacgcgctgcgccgcccggccctccacacccacccccctcctccccacgacacccggacaccccaaccccgcccccgcacccgcacgccgccgccccgcccccggccccccccgccagacgacacacacgccactccccccacccaccaacccccaccccaccgccacaccccgcgacccaacaccagcgcacccacaccccaccccaccctcatgccgcgccgcacccccacaccaacacacccccacaagcgccaacacacacacaccccaggcacgcaagcgcccagcccgcacgccgcagtcgcaaccaacgccacaacacccccccacaacgccgcgggcggagcgacgagagcacgccggacggcacgacgagcagccggggcgcagaagcggcaagcaggcggagcagacgggacggatcgagagagcgagacgcgccgaggacagccgagcaagcgcgcacggcagcgcacacggcccgagactcgaggagacggagggagcgcgggagaccagcgaagaggagcaggggccgagagcgcgacggcgcggggggggggggacgggcgggtggggggggggcagcgcccgcgtggcggcccgggtgcgatcgcggcggaccggcaggagccagggccgcagaccgcggggggacgaggagagaagggcacgcggcgaccacgggcgcgacggaggcgcaagagcgagcggccccgacgccgacgccgcggcgcggagcaggggcgcacgcccgcgccgcgcacggcccgacagagcgggaggtccgcgcgggcgccgc

SEQ ID NO: 506304 - DNA, 236 bp, Homo sapiens
tgacgtgtcgacactcagaggatccctactttcaccggcaggaatggaagtagatagcacacagacaggattatccggttctgaactcagtatcacgtaggacttaaatcgttgaacacacgaacctttaatagcggctgtcgaccatcgggatgtcctgatccaacatcgaggtcgtaaaccgctattgttgatctggactctagaataggattgcgctgttatccctagggtaa

SEQ ID NO: 506305 - DNA, 431 bp, Homo sapiens
  misc_feature (28)..(28): n is a, c, g, or t
  misc_feature (93)..(93): n is a, c, g, or t
  misc_feature (111)..(111): n is a, c, g, or t
  misc_feature (115)..(115): n is a, c, g, or t
  misc_feature (227)..(227): n is a, c, g, or t
  misc_feature (231)..(231): n is a, c, g, or t
  misc_feature (305)..(305): n is a, c, g, or t
  misc_feature (327)..(327): n is a, c, g, or t
  misc_feature (410)..(410): n is a, c, g, or t
  misc_feature (416)..(416): n is a, c, g, or t
ttagaggaaagtggtgaggaggataagnagaggtgatttagtgatagtgatgaggatcctggcagacctggacatcatcacacattcctgaanctggtatgaggcaagaancagncctctctatacaagacctaaactcttaaagaaatgatatgtccctttttagcccttaaggatgcccattatgccatgctcttggtacacctacatagatgttaaggccaggnggcncttgttccattgtatatagtggtgcaagctaagttagttgacccaatactcccttcccagagtctccagctgtntttatatccccaactacttgantattgtttgatggacatttatttccccaggggaattcttgcattttggtatatggttccctccagggtgggccccaaaaaggntttggnttttttttttgggga

SEQ ID NO: 506306 - DNA, 242 bp, Homo sapiens
ctagtggcacgtagaaaagaacagtagatttcactagtcctatagattttgcccaagcagaagtagcacaaggagatgctaaagttacagagtacaaatgtatatataactaaacctacttcacgtactaaaccttttttttttttggacaacaaattctcgcccggttggtccaggcgggaattgcaggggacagccctcagctctcaccgacacccctccatctctccaggtttacaagc

SEQ ID NO: 506307 - DNA, 106 bp, Homo sapiens
gattctcagagagagagggaaggatttgctttgtagccccagaggagattttgtaggacccatatcttaggggcaaatgatagatgtaggacccctgttcctctta

SEQ ID NO: 506308 - DNA, 241 bp, Homo sapiens
ttatctagaggatccttcatgtcgagccccttcatgcatctccaaacaaacccattacctcaaaagaggaagaaaatgggccaggcgcggtggctcatgcttgtaatcccagcactttgggaggccaaggcgggcagatcacgaggtcaggagatcgagaccatcctggctaacacggtgaacacccgtctctactaaaaatacaaaaaaattagctggggatgaaggccctcgacatgaa

SEQ ID NO: 506309 - DNA, 572 bp, Homo sapiens
ctcgggaacccattccaggaagctcctgaaggaaatggtggatctcatcggatctatgagtgaaagttctgcaggacctgtaggaggctcgcctggacagtctgggccagtggaagggccttggatagggttcaaggaggaggggccctggggaagcaagaaggaggctctgtgctctctggggtgaatcccatttctgacggctaaccccaggagaaactgaacaatgccgtctctggctgggcacttgtgtaaattgtttatgccatcctgtgactgtgaatgacagtactttagtcccttaaaacctatgtacaagcaggacatgaggggcagacgggacagagaggaggacaggaggggttcatcggttgactacggggatttctcagaatcgttatgttgtttggcacaggccagtactttcccagataatgtgtctgtgttttgtatgtaaatagatcatttatctactacagggctatagattcagcccaggctgtagcagttcattcctgggtcagaaacccaggttgaaattcaccaataaaaagatttaatatccaggaaaa

SEQ ID NO: 506310 - DNA, 154 bp, Homo sapiens
cacaagagacaatgaccctatggagctttaattttaaatgcaagtttggtaatttaggacctgtgggtttgttaggtactgttaagcacttaataaacttaaagctaccatctccgtctcttctcttgtacagtcctcgtctcgttctcttgta

SEQ ID NO: 506311 - DNA, 286 bp, Homo sapiens
actggtccgtgagttgtacaggtctaattgtctgggtcgcctaggaagtctggtgagaatagtgttaatagtcattaaggagagaaggacagagaagtaagaccgagggcgtctattgattgtgatagtaagggtggaaggtgatttaatcaggaatgggaggtgattcctacagggggttgtttagatccacgtaatcgtgacaagaataggcaggtggcagtgctagctaagggctagcaaataatgcaagggccaagcatgaagtgcaacaggtcaaagcaat

SEQ ID NO: 506312 - DNA, 170 bp, Homo sapiens
ctaccacggtgatcacacgtgtctgatatactcttgtgccacgttctccttggggtcagtactgcaagactgcatcagaatgctttcagagagtcttgtggactttggggacgtgtcatctgggtgaaatgctgggggctaagggaatgagcccgaattccttggtgact

SEQ ID NO: 506313 - DNA, 247 bp, Homo sapiens
cctctcgggcttaacaggtgccatctgtgcctgtcacctgtcgttcatgaagatgggggttaccgtgctctccacacacgagctgacctctctgctcgagaaaggagctggagcagtagccagaacggaggcctcagacgcatctgtgagcagaaccaggctcactgcgaggaccatgcgtgagtggtaggcccctgtggccctgtggatgcatgagctgccctgtgatggggcctactgtgcttgc

SEQ ID NO: 506314 - DNA, 122 bp, Homo sapiens
agcgggggcagtttcccgaccagagagaacgaacgtgtctgcgggcgcgcggggagcagaggcggtggcgggcggcggcggcaccgggagccgccgagtgagtcgaaagataaaaaaaaaac

SEQ ID NO: 506315 - DNA, 218 bp, Homo sapiens
  misc_feature (41)..(41): n is a, c, g, or t
gatccggctacaacgccaaggcgatcaagttaagaagctgngtttcctctccaacgacctggttatgaacaggttaatttcatcctttgccacgtgccctctcgtgtcagaagaagataaacacgccatcatagtggaaccggagaaaaggggtaaatatgtggtctgttttgatccccttgatggatcttccaacatcgatcgccttggcgttgtag

SEQ ID NO: 506316 - DNA, 393 bp, Homo sapiens
ccagtcgcaggcatctctactgatgggagccacacttaacatcagtttctaccaccacttcattcccaaagcacagcttcacagctgtccacgtctagtcttatcatgcagtacttctactcctactcttagctgaaaccgttggtacttagcgcacactcactatattagacatctcatagcattacaactggattggctttctccctctctgcaccatcttcctcttcctctcctgtagcaggagtgtctagttatatttctcagcctggtgtgctgcatcctttggtcattccatcagtcatagcttttacttctattaatccccaagcagcaggacctacttctacacctttattaccccaagtacttagtatcccacccttggtacag

SEQ ID NO: 506317 - DNA, 102 bp, Homo sapiens
atcaagtgcaaggctgcagttgcttgggaggcatggaaagctcatcatccatagaggagatagaggtggcacccccacagctcaatgaagttcgaatcaaga

SEQ ID NO: 506318 - DNA, 119 bp, Homo sapiens
tcagtgcggcaagtacctgtaaacctgtcggggatgatgaaactgagggtatcgctcgtgttcatctgagcgccctctcgcgcgggcgcccgttcccgctgccatgcccgggcattggg

SEQ ID NO: 506319 - DNA, 606 bp, Homo sapiens
  misc_feature (325)..(325): n is a, c, g, or t
gatgtatacgaaggaagcaaaaccaggcccccacaccccccctgtccaaagaggccttcgaagggggataatcccatttatacccccagaagttttttttttggcaggatttttttgagccttttaccaatccagcatggccccaccccccaattaggagggcattggcccccaacagggatccccccgttaaatcccctaaaagtccccctcctaaacacatcggttttattggcatcgggggtatcattcccctgggctccccatagtttaatagaaaccccccgaacccaaataattcaggcccggcttattccaattttanggggtttttattttcccctcccccaagcctcagaggatttggggtttcccttccccatttccggggggatttaggggtcaacattttttgtagccacggggttccccggacttccggtcattatggggcccaactttcccccaaattggtttcaccccccaaataatatttccctttacatccaaacatccctttggttttgaaccccccccctgaaacgggcattttgtaaatggggtttgactttttttgtatgttcccctctattgatgggggtttta

SEQ ID NO: 506320 - DNA, 131 bp, Homo sapiens
ggtgatctgcctgccttggactcccaaagtgctgggattacaggcgtgacgaccacgcctggcctcaaaactttaatttgtgttcatattcatgtaaactacttttggataatatgacaaaccaccaaata

SEQ ID NO: 506321 - DNA, 1241 bp, Homo sapiens
  misc_feature (764)..(764): n is a, c, g, or t
  misc_feature (959)..(959): n is a, c, g, or t
gtatgttggttgtgttcgttggtatgattgtttgtttttggtgtttgttgctcggcggggggtgtggtgtctgaggtgtttggcctccggtcctgggagccccccccccgtgttcgtcccctaggaagcccggggtccttcttctctctcggctttttcctttgccccgggcccggtacccttttttcaccccgggacccgctttttggccctttgcgctttttttgggccacgattgggacccaggttgtcccagaaagcccgcgtggtacccggttccggatttccccgggtttttttttcgccccccgcggttctttcccagaaggaaattgggaggaaagcttcttttaagatggcccccaggctcccctagggctccccccaggtgtccccccaaagcattggcaaagcatttcgctccgttttctactccctccttgtgtccacgccaggtgatttttgggctgtgaataaccgggcccctgggaccccttcccccttccgaggtgtttccacccagggttctttgctcttctcccccaccaagcgtttccaggatagcccctagttgttacctgggggggaaatttttagcccctttgtggcgttcgcccccaccccccttcctcgtccaccctcggaggccctcccaccccctcgctctgtttgagagcccctcgagtttggcttaaggggagaatatgggagaagaaggagttttccacactcgcgcctctggccatatctcttgtgttgctcgnctcttggtttatgagatcacataataggctaaatgagaattatggccacgcgggagagctatatttttttgaaagagatgagtgtgacctaaaatgtttgagaagacccacgctttgagagaatcctgttaaaaaatgtgagatttttttaacctctccaccctattaaataacttgttgaattgtgggaaggtnttgttggaaaattcacaattattgagtgagaaaacccattcttttttggtaaatgttggcacaaactctggggaaatttaagtggccaaatacacattctccccgccggcccttttgttggttgccctaactgccaggttgtctgggagaatatgagtcccatttggttgatgagcctttgactgccggttttgggacccttacctcttcctcccttatgccccaaattgcctgtcttgggtcctattccaataaagttatttttcctggtttccaaaacca

SEQ ID NO: 506322 - DNA, 692 bp, Homo sapiens
  misc_feature (120)..(120): n is a, c, g, or t
actataattcaatttctggcggtctcctgtctattggcaggaacaggcagcattgatccagcagccctcatgcaaatcggtgtcattccaacaaatgtccggcaacttatgtattatacntgaggcctcatcagcattcattgttgtgaagttaatgcctacaattgactcgccgattagtggatgtaatataacatcaatttcaagctataatgcaacagtgacaaaactcctacagccgatcggtgagaatttggagacaattaggaaccagttgattccaactcggaggagacgccgatttgcaggggtggtgattggattagctgcattaggagtagctactgccgcacaggtcactgccgcagtagcactagtaaaggcaaatgaaaatgctgcggctatactcaatctcaaaaatgcaatccaaaaaacaaatgcggcagttgcagacgtggtccaggccacacaatcactaggaacggcagttcaagcagttcaagatcatataaacagtgtggtaagtccagcaattacagcagccaactgtaaggcccaagatgctatcattggctcaatcctcaatctctatttgaccgagttgacaactatcttccacaatcaaattacaaaccctgcattgagtcctattacaattcaagctttaaggattctactggggagtacctcgg

SEQ ID NO: 506323 - DNA, 302 bp, Homo sapiens
tccctccattaaaagggttaaagggctccccccccccggaaaatttttttttcccccaaaacttttaaaaaaaaaaattttttttttaaaaagggcaaaaggggaatttttttgggggcccaaaaaaaggggttttttttaaaaatttgggtttgttttaaattttttttaaacccccaaaaaggtttttttaaaaaatttttttttttttaaaaaatttttcgggaaaaaaattttttttttttttaacggggccccccacattaacccttttttttgggggttcccctaaaccaattgaa

SEQ ID NO: 506324 - DNA, 1070 bp, Homo sapiens
  misc_feature (74)..(74): n is a, c, g, or t
  misc_feature (77)..(77): n is a, c, g, or t
  misc_feature (144)..(144): n is a, c, g, or t
  misc_feature (285)..(285): n is a, c, g, or t
  misc_feature (405)..(405): n is a, c, g, or t
  misc_feature (431)..(431): n is a, c, g, or t
  misc_feature (459)..(459): n is a, c, g, or t
  misc_feature (469)..(470): n is a, c, g, or t
  misc_feature (472)..(472): n is a, c, g, or t
  misc_feature (474)..(475): n is a, c, g, or t
  misc_feature (481)..(481): n is a, c, g, or t
  misc_feature (490)..(490): n is a, c, g, or t
  misc_feature (548)..(548): n is a, c, g, or t
taaaactcagtaattcctttattttggatttaaaacttaatcacaaccatcgaaggtggtaagaaacagctganagngtgtacttaaaaatactgaattgacagctacattgaatgcagggtttcccagggtagttcttatttngtcacttactccaattacattcaaggtcgttatgcctcatctttttcctgagctgtggcagctctaactggggcacccagagaagatacataccaggtaatctccacttctacttttctggtagcttggccctggcaaaantgagccccacaatctagaaagtaggatgctaaacaaagttgaatcaacatatctttttagaaaatatcaggttagagaatactcctgaggacctgtttctaaccagagttgacaaatgtnaaaaatgcatcagctagacagcagtnatgtgaacacagcccggaactgcaagtnaaggaaatgnntncnnggcctnccttcccangtaaccaaaaccattattcaaaagcaactactgaaatgccagcttgtggggaaagaantgggaaaggtgataaaatcacaattaaatccatgtatatacatgaataccaaagctattatttacaaataaaatcaaaacactttacaccaacaacaaatcacacacctcctactctatgggcccacgggttaacattcaaaactcggagtaatcttggcctaagccttgatacggggcaccactcttacccctggggaacacaccgcagttgtttcaacaccgtccacctgctccttctcccctcgaactacgggtgccgcacatatgtccgcaacagctaacagcgacacgccggggaagtggtcgccagccaaagcacggtgaggacaaaaggcgttcacggagagccggacgcgacacaaacgaaaacaccatggcccccctggaaaaaacaacgacgacgggcgaggaaacacatcgacaacgacaccgaagttagcagagacaaccgagccaagcgaacgcaacacagtgaagacaaacacccggtgggcaccccagaaaccacacagaacgaaca

SEQ ID NO: 506325 - DNA, 578 bp, Homo sapiens
gacacacataggctcaaaataaagggatggatgaatatttaccaagcaaatggaaagcaaaaaaaaaaaaaaaaaaaaaaaaaaaaccgggggtggcaccccttttgggggaaaaaaaacttttaaccccaaaaaattaaaaaaaaacttcaagaaggggggatatacattaagggggaaagggcatcatggccagaaaggaaaaacgttacccttctttaaaatattattgcgccccccaaaacagggagcccccaagatttcatagagggaagggttctttaaaacgaccttaaaaagagacttatagttccccacaaaataatattagtgctggacagactttaaaccccccctgtgtaatttttagccaaagaaccgccgaagacgagaaaatttaaccaggttttccgggttgggacctcacgttcgggacgcaagcggatttaataaaatctcaccagaacttccttcccaagaataaggtgggactccacattttccagacccattcaattttccttaactgatatatggggataaaactctttggaaaggcaagaatgattctaacaagg

SEQ ID NO: 506326 - DNA, 278 bp, Homo sapiens
gaccctagaaaacccattggcggagcccttgaacagcagatctttctgcccaataggggagccaaagagcgggggcttcggtgacttgtccttgccaaacttttcctgtgcctggcggagaagattccagatggcatcctccttgccattcacacttcgtgccacaacggcatgagaagggacccgcaccagatggcagtctttgaacttgtccactggcttccgagtgttgtctgggcagaagaactcatactcgtccctttcagcctcgtctgaca

SEQ ID NO: 506327 - DNA, 948 bp, Homo sapiens
gggagagaaggagaaagacgagtcgggagagggcggtaggatgtgaggggggcctgaagcgggagtgggcggcttcgtctggcgagagctaggacgtgggaccgggctgctgctgttctcccgggttgcctgtcggccggcagtccttcatacgcagactccatgttggtgctcgtgcgcgcgtgggatcaagtgcgcaggtcgggagagtctgtcttcatggggtgtggtgctcgcctgtgagacaggttattgtttggccgatgtggggtcgtggtctgtctgtgggctgggttgagtcggtctttaatcccggttgttctgagtctttccctcgtcttgttgtggcacttttggctcggggtgaggcagagatgcacgagtaaaatgaggtacgatgtatgcgctgagttaatagttagcagcggtcttttgggcaatagtgtgaagcagtgggagagagttgcgtggagggggtggtgggagaagttccggtagtcactcagggggattgaagtatgtgggtgccttggccattggttagtaagatgggggattgtgtataggggaagggggagtggtagtgttgtatcgtgggttgaggtgaaaagtgaagaggagttgttgttacatggatagtgtggaatcgatgaatgagtcgttgggggggatggctggtgcatgcgaagggccccaggagaggttttcggattgcccatttgacttgcttgtgtggcaggaccgttcattcaggctcgggataagtggtcttggcgagagtggtaccgtgggtcaattcccaagggtcctttggggaaggtcttttcagacaccggggcggagaaagctccgggggtaggcagccataatgtatcggtgggtgggcctattggtccacccggcgggttttctctgggggcgaaaggtgtagccctttttgtgcatgag

SEQ ID NO: 506328 - DNA, 146 bp, Homo sapiens
gtgtgtaacttccaagcaataccttggtgtcatgttactgctgtcagatgtattgttccttacataggaaatcaatgccaagatgcaactagagattctcatactaagaagtaagtcagaaagagaaaggcaaggggggggggggg

SEQ ID NO: 506329 - DNA, 283 bp, Homo sapiens
aggcaaagctcctactacatatgaggaaatatagtgtagtcacagtatttatcgcatactttgatagcctaggaagttattcaatcctgttttcaggtaaaagagggataatcgcatctatctcatgtagctgctcacaagattgaatgagtaaatacatgcaatgtatattggaataagtaacgtggcatgtaatagagcaccccaagatttgacttatctctgtgcaaggcacgtgggaaaacaaaagactgcgaaataatgtaagaatccaccggttcta

SEQ ID NO: 506330 - DNA, 150 bp, Homo sapiens
gagtctaggagacgacgtgcagaaatagcacctcggaaaggggaaggaaaagagggaaggacaggtcatcagcctcggacctcaggtggctaagggagagaatgtatttggtgtctccatatctttcatcttcaattacacttttgtcat

SEQ ID NO: 506331 - DNA, 145 bp, Homo sapiens
ccttttaaaaaaaaaaaaaaaaaaaaaaggggggggggggggccaaaaccccccccttttcccccccccaaaagggtttgggggggtcccccccccccctttttgggttttttttccccccttttaaaaacccttttccccggta

SEQ ID NO: 506332 - DNA, 401 bp, Homo sapiens
  misc_feature (26)..(26): n is a, c, g, or t
  misc_feature (56)..(56): n is a, c, g, or t
  misc_feature (60)..(60): n is a, c, g, or t
  misc_feature (67)..(67): n is a, c, g, or t
  misc_feature (70)..(70): n is a, c, g, or t
  misc_feature (75)..(75): n is a, c, g, or t
  misc_feature (77)..(77): n is a, c, g, or t
  misc_feature (79)..(79): n is a, c, g, or t
  misc_feature (88)..(88): n is a, c, g, or t
  misc_feature (90)..(90): n is a, c, g, or t
  misc_feature (99)..(99): n is a, c, g, or t
  misc_feature (108)..(108): n is a, c, g, or t
  misc_feature (116)..(116): n is a, c, g, or t
  misc_feature (122)..(122): n is a, c, g, or t
  misc_feature (125)..(125): n is a, c, g, or t
  misc_feature (128)..(128): n is a, c, g, or t
  misc_feature (131)..(131): n is a, c, g, or t
  misc_feature (137)..(137): n is a, c, g, or t
  misc_feature (259)..(259): n is a, c, g, or t
  misc_feature (293)..(293): n is a, c, g, or t
  misc_feature (401)..(401): n is a, c, g, or t
ctgaggcagagctcgggggctgtcgntggggaccttgcaggagggcaccccaagcncgcncggccgnccnacccngncnctgcgcgcngnccgggccgngttgacccngcgccctngcatgnggngcnctngcggtnctgagaccgcgcgggtcgcgtggtcaacgatgacattttggaggtgggcacgtgctgttggaggacagcgtggtgcgggcactctggcacgaactgctgtcttccgggggcgcttctgtggngctgtgggtccttgacgccgccggcaagctcgtnctgtccggaggcattgacacacacacgcacatgcagtttccctttatgggctcgcggtccattgacgacttccaccagggcaccaaggctgttctctcaggaggcacn

SEQ ID NO: 506333 - DNA, 330 bp, Homo sapiens
tggtctgtgctggaataaattctccagcttagatacctcaccttccttttaagtgacatataatgactttcctttttctcaaatcatattagtctacaagtatgcctttcatatagcaatcctgcatccacataaaagctgcattttcaatgagataaaaagctattttgcaaaaagcacaaggttttgggcacctgctagagtagctgcagtgacagattcacaatttccttttttttttaaaaaaaaatttttaaaaggaggatcttactctggtggcctatgctgggagtacagtgggtgccatcaatcgcttactacagtctcgaa

SEQ ID NO: 506334 - DNA, 936 bp, Homo sapiens
gtctgtgttcctgcgcgcacgtgaagcaccgtaaaggtgctgcgcacttgcgcagcacggtgaattacgctgagcggcccggttacatcaagggcatcgtcacaggacatcatccacgacccggtaccgacgtcgcgacccctcagccaaggtgtgtctatccgggatccgtactcggtatctacgagagcggaactgcgagctgattacatttgccagcgagggcattcacacgggccagtttgtgtattgcggacaagaaggcccagctcaacattggcaatgtgctccctgtgggcacccatgccctgagggtacaatcgttgtgcttgcctggaggagaagcctggagaccgtggcaagctgtgccccgggcatcagggaactatgccacggttatctcccacaaccctgagagcaaggaacgacccgtgtgaagctgcccctcgcgggctccaaagaaaggtaatctcctcagccaacagagcatgtggtggtgttggtgcctgatgtgttggcgattgacaaacccattctttgaaaggctggccgggcgtcccaccaaattctaaggcacaacgaaggacctgcatggccacaaagttacgggggtgtgaccatgaactcctgtggaagcaataccttatgggaggtggaaccaccaggccacatcggcaaggccctccacaatccggagagatgcccctgttggccgcaacaggggtctcatgctgccgccggactggacgtctaccggggaaccaaaattgtgcggaaacaagacactaagtgctcgaggcccccaaaggttgggtcactgccaaaaagacaaaaaaaaaggggggcacaaaaccagcagggcacacgtacaccagtttagacaagccacacaggcgaaaaagagagcggggaacacggcacgaaacgcgtgcaacg

SEQ ID NO: 506335 - DNA, 204 bp, Homo sapiens
ggcccagcgtcgcctattttggggggtgcgatggagaggggactcgctttcgctgcagctgtctaaactggctacagctctcacttcatttaaccctctttcagtctttgtcttccaggaagtgtgcgtccctgtaatttaccagctttaatgggcatattaagaaaaccataaactttttggcagtttatgtcaaccccaaaa

SEQ ID NO: 506336 - DNA, 189 bp, Homo sapiens
aagaacacgcgctttgatagcttctggtatacctcacccatttctgattacgaacgcagacaccagagggctgctgttgaaagccgttttttctgggacaacgtggtggccaagcaatcaataaatgcgttcggccaagcacgcttcgaattcactgccaacgcaaagggccaagtgcgtccgtagcgg

SEQ ID NO: 506337 - DNA, 271 bp, Homo sapiens
caacgtggatgcctataaaagtcttctgcaacgatggagatttggtgagacctgcgtgttcccggactcagcccattgtgggccagaagaactgttacatcagcgagaaccccctggacaagaggcgtttctggttcggtgagagcatgagcgatggattccagttctgagtatggcggacagtgactcgatccttccgatgtgtgcatccatctgagcttcttgcgctcttgattgtcaccgagggctcccagaagatcacctaacgact

SEQ ID NO: 506338 - DNA, 89 bp, Homo sapiens
gccgaaagggatggaaagcgcctaccttgtcctttccgttcccctccccccatgccgggcagtgcctcaagatcctgaagggaaagaag

SEQ ID NO: 506339 - DNA, 1386 bp, Homo sapiens
  misc_feature (38)..(38): n is a, c, g, or t
  misc_feature (77)..(77): n is a, c, g, or t
  misc_feature (110)..(110): n is a, c, g, or t
  misc_feature (137)..(137): n is a, c, g, or t
  misc_feature (156)..(156): n is a, c, g, or t
  misc_feature (162)..(162): n is a, c, g, or t
  misc_feature (189)..(189): n is a, c, g, or t
  misc_feature (230)..(230): n is a, c, g, or t
  misc_feature (239)..(239): n is a, c, g, or t
  misc_feature (292)..(292): n is a, c, g, or t
  misc_feature (320)..(320): n is a, c, g, or t
  misc_feature (336)..(336): n is a, c, g, or t
  misc_feature (344)..(344): n is a, c, g, or t
  misc_feature (444)..(444): n is a, c, g, or t
gggttggagacgaggccaggtctccagttggggtggangtgcccaccagctgccgaaggccaagacgccaggtccgntggacgtgacaagcaggacatgacatggtccgntgtgacggcgaggacagaggaggcgcntccggcttacctgaacacnttaggntggtggggctgcggcaagaagcgggtntgtttctttacttcctccacggagtcggcacactatggctncctctgggntcccagaacccacaacatgaaagaaatggtgctacccagctcaagcctgggcntttgaatccggacacaaaaccctctagnttggaaatgaatatgntgcacttnacaaccactgcactacctgactcaggaatcggcttctggaaggtgaagctagaggaaccagacctcatcagcccaacatcaaagacaccatcggaacagnagcgcccgcagcacccaccccgcaccggcgacgtccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggtgtgtgccagaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaaaaaagacaccaaaataacatacaaagaaaaaaaaaaacctctgaagacaagccctgcacccagcagcctacgcggtcaaaacacagagggtagcgcacccacgcctgcagagacgaacaaagaatgcggagcaggcctcagcagaagaagcctccatcaaaacgcggcactgaccgctgggtacgccacgacagtggggcaagacggggccgcgcctgcctacacaacgtggcggccgcggtcgtcaactagcgcgaagcccacgtcagttccagatgccctgcaggctcggagaaaagccaacggaccgccggcacacacataaccccccactgacaagggacaaacaacagggaccaagacagggggcactatccacaa

SEQ ID NO: 506340 - DNA, 790 bp, Homo sapiens
atcgcacgaggttagcaccgagcgccaatctgtctgcctattgaatcgggagagatcaagggctacaagattatgtctccccgcggccttgtagatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggtgtgtgccagaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaaaaaagacaccaaaataacatacaaagaaaaaaaaaaacctctgaagacaagccctgcacccagcagcctacgcggtcaaaacacagagggtagcgcacccacgcctgcagagacgaacaaagaatgcggagcaggcctcagcagaagaagcctccatcaaaacgcggcactgaccgctgggtacgccacgacagtggggcaagacggggccgcgcctgcctacacaacgtggcggccgcggtcgtcaactagcgcgaagcccacgtcagttccagatgccctgcaggctcggagaaaagccaacggaccgccggcacacacataaccccccactgacaagggacaaacaacagggaccaagacagggggcactatccacaa

SEQ ID NO: 506341 - DNA, 610 bp, Homo sapiens
gtcatctagaggatcctttggaaacgagagacctccatctgggccggtatgactgggcgccggtgtgtgccagaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaaaaaagacaccaaaataacatacaaagaaaaaaaaaaacctctgaagacaagccctgcacccagcagcctacgcggtcaaaacacagagggtagcgcacccacgcctgcagagacgaacaaagaatgcggagcaggcctcagcagaagaagcctccatcaaaacgcggcactgaccgctgggtacgccacgacagtggggcaagacggggccgcgcctgcctacacaacgtggcggccgcggtcgtcaactagcgcgaagcccacgtcagttccagatgccctgcaggctcggagaaaagccaacggaccgccggcacacacataaccccccactgacaagggacaaacaacagggaccaagacagggggcactatccacaa

SEQ ID NO: 506342 - DNA, 349 bp, Homo sapiens
ccagttacaacagctaatagtatgcagtgtccatacaatgaagttattatataaactgccacattcactccgaagcccactcaatctccttcagcatcccacagactacgtcacatgttccgcttagtctagatcataatgaggtggcacacacgctgcaccgctgacatcacaggacagctgcctataaaactagacttctagacgctgggctctcaccttcattctcacaggtcatcatcctcatccgggagagcagttatctagagcaacctctaagtcgtgctcatactgtgctgccagagctgggtccattacaacttctggtggtgcgagtagcaggcattgt

SEQ ID NO: 506343 - DNA, 1568 bp, Homo sapiens
  misc_feature (38)..(38): n is a, c, g, or t
  misc_feature (77)..(77): n is a, c, g, or t
  misc_feature (110)..(110): n is a, c, g, or t
  misc_feature (137)..(137): n is a, c, g, or t
  misc_feature (156)..(156): n is a, c, g, or t
  misc_feature (162)..(162): n is a, c, g, or t
  misc_feature (189)..(189): n is a, c, g, or t
  misc_feature (230)..(230): n is a, c, g, or t
  misc_feature (239)..(239): n is a, c, g, or t
  misc_feature (292)..(292): n is a, c, g, or t
  misc_feature (320)..(320): n is a, c, g, or t
  misc_feature (336)..(336): n is a, c, g, or t
  misc_feature (344)..(344): n is a, c, g, or t
  misc_feature (444)..(444): n is a, c, g, or t
gggttggagacgaggccaggtctccagttggggtggangtgcccaccagctgccgaaggccaagacgccaggtccgntggacgtgacaagcaggacatgacatggtccgntgtgacggcgaggacagaggaggcgcntccggcttacctgaacacnttaggntggtggggctgcggcaagaagcgggtntgtttctttacttcctccacggagtcggcacactatggctncctctgggntcccagaacccacaacatgaaagaaatggtgctacccagctcaagcctgggcntttgaatccggacacaaaaccctctagnttggaaatgaatatgntgcacttnacaaccactgcactacctgactcaggaatcggcttctggaaggtgaagctagaggaaccagacctcatcagcccaacatcaaagacaccatcggaacagnagcgcccgcagcacccaccccgcaccggcgacgtccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgtgacattgttgctgcctgtgctttgtgtgccctgaagtgctggtgctggtgtgctgtgatgtgcaatagagctactcagtgagtggagtgataggttgcagtgcagggtgtagatgtgatgctgcagcttggctgtgctgatgctggggatgtgcacttgtgcctaccagagcccctgtggcacaattgctgtgtgcctacgcgtggcgagctgactgtgatgcctgggcatctggttgcctacagcagtatccgggcttgtgaagactgatggccatgagtactaccatgcttggtgtgtaggactgtagccacaccaggctagcctgaagtgccaaaggactgcacatgtgtcctggtaggcactgtgacaagccagtgacattgacatgtgtcccaggatgttggaccgcgccgacgtgacctgatgggaggcgctggtccaggccttaccttgaaacagccttaaggcttgggtggtggttgctgggagagaacgctgggtctgtttctattacttgctaccaaggaaggtcagggacgactagttggcttgcccctactgtggttccccagaagacacacaacgcatgaagagaagtggtgcaacccaggcttcaagcctgggcctatggattccggaaccaaaccctctagcgtggggattgagttgcttggtcgttagagactggggtactgacacaggagccggtctcgaagagaggagaggaccaaaccata

SEQ ID NO: 506344 - DNA, 95 bp, Homo sapiens
  misc_feature (36)..(36): n is a, c, g, or t
  misc_feature (48)..(48): n is a, c, g, or t
gacagcagcttctacatctgcagtgctacttctcgncgagcgggaagnagcacagatacgcagtattttggcccaggcacccggctgacagtgct

SEQ ID NO: 506345 - DNA, 95 bp, Homo sapiens
  misc_feature (25)..(26): n is a, c, g, or t
  misc_feature (35)..(37): n is a, c, g, or t
  misc_feature (39)..(40): n is a, c, g, or t
  misc_feature (42)..(42): n is a, c, g, or t
  misc_feature (45)..(46): n is a, c, g, or t
  misc_feature (48)..(48): n is a, c, g, or t
gggggactcggccctttatctttgnnccagcagcnnngnncnacnngnagcacagatacgcagtattttggcccaggcacccggctgacagtgct

SEQ ID NO: 506346 - DNA, 114 bp, Homo sapiens
  misc_feature (67)..(67): n is a, c, g, or t
catcctgaagacagcagcttctacatctgcagtgctaggacggacgatccggggtgggccggagcgnagcacagatacgcagtattttggcccaggcacccggctgacagtgct

SEQ ID NO: 506347 - DNA, 479 bp, Homo sapiens
gactttcaaggaacagatgggtactgtgctgaacgatcacactaatacctaatacatcgctttatcatccagacaggaggtacagggtacaatcatagctcaccgcagactcaaacctctgagctaaggcacttctcccgaccaagtctcccaatcagccaggaccacaggtatgcaccagcacacctgattaattttctaattttttgtagagacagagtctcgatatgtagctggggctggtctatgaattcctgggctcaagcaatcctcccgactcagactcccaaagtgcggggattacaggccacggtgcccggcctgattattctatttgaacagataagatttttacctttgcctttactatgttggcacaatgtgtttggatttttacacctaaccagtacatcacccatcatgcataataggtatacgatctatggtagtcgaaaaaacttgaaatggtcgcccatccg

SEQ ID NO: 506348 - DNA, 104 bp, Homo sapiens
  misc_feature (57)..(57): n is a, c, g, or t
catcctgaagacagcagcttctacatctgcagtgcccaacttgatacgcagtattgnagcacagatacgcagtattttggcccaggcacccggctgacagtgct

SEQ ID NO: 506349 - DNA, 150 bp, Homo sapiens
cctcctctgagcctatgcttttactctctgtaaaatgacgataataaagcctagagagtgtatgaggatctttaaagccgaagcttttttctttatttccaaggttctatccctttgcgggggtttaatatataactttctcttgggact

SEQ ID NO: 506350 - DNA, 88 bp, Homo sapiens
  misc_feature (7)..(7): n is a, c, g, or t
  misc_feature (55)..(55): n is a, c, g, or t
ggtcaanattagtaaactttatttaaacttcaatgaacataaaataacagacaanaggcagctttagctttgttctgtcccgaggatc

SEQ ID NO: 506351 - DNA, 180 bp, Homo sapiens
cactcctttgagtgagaccgacttcaagcttgcagcgccgaccctcggacggatcccagaatgcaccgcgtgtacacggtcttataaacgagtgcgggtggaagcgtggcgacagggtaaccgacatagaggactatccgaacgatacggccgccacgtcggcctcttgacaacgtatcg

SEQ ID NO: 506352 - DNA, 682 bp, Homo sapiens
  misc_feature (421)..(421): n is a, c, g, or t
tggaaacgaaatttcactctggtggcctaggctgggagtgcaagggcttgctatcagctcactgcaacctctgccttgcaggttgaagcgattctccggcctcagccctcccaagttagcgtggcatttacgggcttgcgccaacaagcccggctagttttttgtgtatttttagttagagacgggatttctccatgtggtggctcgaggcgtggttctcgaacctccgtgacctcgagggtgactccctcccgcctcgtgcctcccaagaggtgcgtgggaattcacaagggccgtgagccacgtggtgcccgggcctaatttgtggtattttatagtagaagaagaggggtttatatctcggtgtgtggctcaggcgtgactctgtgaaactcccgaaccacgagggtgactccacccngcctcaatccacccaaaactggcgtggggactacagggcatagacgccaccaagcccgggccgttatataagcggttataaaagggattggcagcatggagttgggtggcagtccctcgtgctccgggcacagacgcggggggagacccgtggtgtcttcagacagcagggacttcaggaccctacggagagagggaatcaagagctctcgggggtctaggaggggggaggttgatcggaaaccaccataagcgcgccgaa

SEQ ID NO: 506353 - DNA, 428 bp, Homo sapiens
agcggacgtacgccgtctctaacactacagggtggtagcggcctcattcgtactgcgtccggggcaggaccgtgcgcggggccgcggtgggtgctgggagccagcgccatgcctcgccgccgacccgtcgcatggcgtgccactccggtcttgggccgttctccgcaccgatgcagaggcggcagggactggggactggagcggcagccaagcaacgaggattcacaagcacgaaggggcacagccagcgtagaagacacctgaaggggacacggggcacacagagcggcccatgaatacaaatgagtgcaatgctgattggccagacaaggtaattccagcttactgatgggccatagaagtcattcatgccattcaatgaaagatgccatgacgagatgcttgatactatgacatctattcctaca

SEQ ID NO: 506354 - DNA, 324 bp, Homo sapiens
  misc_feature (69)..(69): n is a, c, g, or t
tataaaaatattaattaaaattgttttaaaactaagcaggagaggctgggcgcagtgactcacgctgtnaatcccagcactttgggaggccaaggtagttggatccctgaggtcaggagttcaagaccagcctggccaacatggcgaaagcacatctctacaaaaatacaaaaaattagctggccatggtgacaggtgtctgtaatcccagctacttgggaagctaaggcaagagaattgcttgaacttggaaggcgaaggttgcagtgagccaagattgctccattgcactccagcctaagcaacagagtgagactctgtctc

SEQ ID NO: 506355 - DNA, 500 bp, Homo sapiens
atgtatatagaaagagatctatgaagaaattaacttccatgattatgaaagttaatatctcttccatgattatggaaactggtaagtctacaatctgcatgctgggctggacaggctggagaaccggagagaagacaatgctacagctcaagtcaaaaggccatcaggctgaaggaccccaggaagagctgatgttgcaggtggagtccgcaagaacagttagctggagaatttgcctcttgttcagggagctcagccttttactctattcaggccttcgactgactggacgaagcctgcccaggctctggaaggcaatctgctttactgaaggcccagcaatttcaatgtaaatcccctatcagaaacaccctcacagaaacattccggacaagttgagactcaaaatcagctacagaagctccaacacatcagactggccatgacattggtcttgcagtaccaagtgttgacccaaaaggcgaacactagaaagtcat

SEQ ID NO: 506356 - DNA, 172 bp, Homo sapiens
gcccctgatgctacgactggagacgagggacaacgcaaattaacgacagtgcaaagggaataacaatctgaaaccaaatcctcttcgtgtcaccccatcgaatggttgaccaaaagcggcctatgattgcagatgtctgagctctgaagactcggttgtctatctggctctt

SEQ ID NO: 506357 - DNA, 558 bp, Homo sapiens
tgcagtggctcatgcctgtaatgccagaacttgggaggccaaagcaggcagatcaattgaggccaggagtttgggaccagcctggccaacatggtaaaatcccatctctactaaaaatacaaaaattagctaggcatgatggcacaggcctttaatcccagctacttgggtggctgagccatgagaatcccctgaaccaggaggtggaggttgcagtgagccaagatcgcatcactgcactccagcctgcgtgacagagtgaggctctgaaacaaaaaaaaaacaaaagaaagaaaagaaacgggagaacagaaacgaacaagcgtgttcaggggccaggcccgggtgactcacaccgttgtaatctcagcacttggggaggctgatgaaggcagaatcacttgaggccaggagtttcaagaaccagcctgaccaacacacagtcgaaacccaatctctcactacaacttagcaacaaattagccgggccgtggtggacgggcgcctgttaatcccagctactggtggcagcgctgaggcagcagcaatggcgttgac

SEQ ID NO: 506358 - DNA, 152 bp, Homo sapiens
tcggcacgagggcgggtgaccagcatggtccctcttggaatttggattcgccatttatttttctggctgctaattcacgagcccggagattagagagttttatttctgggattcctgtggacacaccaccacatacatacatttatatatat

SEQ ID NO: 506359 - DNA, 334 bp, Homo sapiens
caagttgcccttcccttttgaattttaaaatgatggttttatttgttgtgtgaagtggttcccccttgaggcccaggagcctccatttcctgactgaaacccttttttgagacttaaagtaccagtacttttggttccttgagttttcctgtctccaaataccaaatgcccttgacttttttcccttgtgaatttgtagtccaatcagctgaaatttaatcccttgggagggacgcataaaaggagctttaggaacccagtgccagtgcagaagtttttccaggtggcctccctttcccccaatgtacataataaagggtttgccctttcccta

SEQ ID NO: 506360 - DNA, 302 bp, Homo sapiens
aatgctgtatacttaggatatactcaaatttttaaaaaattgtgttagtacgcatattctcactcataggtgggaattgaacgatgagaacatatggacacaggaaggggaacatcacactctggggactgttctggggtggggggaggggggagggatagcattgggagatatacctaatgctagatgacgagttagtgggtgcagcgcaccagcatggcaaatgtatacatatgtaactaacctgcacattgtgcacatgtaccctaaaacttaaagtataatatttaattttaattttt

SEQ ID NO: 506361 - DNA, 396 bp, Homo sapiens
  misc_feature (33)..(33): n is a, c, g, or t
  misc_feature (104)..(104): n is a, c, g, or t
taaagagtttaatggatataaggctagccatgntgtatgggagatagagttattacctaaatcaattccctgaaaatttaaagttcagggagcttgcttttgantggggcttaaggacttgtggggtggagggagagcaggtccaggtggagccatcagtcgtcagaaatgcaaaaacttgaaaagacatctcaaccaccaatcttaggctctacaatagtgatgttatttgcaggagcagctggggagttgcaaatcttgtgatctctggaataatggctggtaatcttttatgtctacaccttagcagaattcaggctcctcacatcctcctaacctggtggcctttcattagcttcgcaaaggtgatttagtttgggggaagactgttatcat

SEQ ID NO: 506362 - DNA, 122 bp, Homo sapiens
atgaacatgaagctgaagtgtggaccttataacgagacgagcgggacattgaggacaaaaagtctgattccagggacacagagtaactgatgagctagattccagagctgcgaggtcgtcat

SEQ ID NO: 506363 - DNA, 340 bp, Homo sapiens
tacaaccccggacaatgcaggtgacgccccaggcttgtcactgaccacattacacgcacacgcacacttcgatcgcgctacccacactcacatacacactcagagtgctattgagagccttgggccaggacgctagaagatagggatgtagttgtcgattttggcgcggtggcgctgggcgatacattcagcgatccacacgatgttgcgacactcctgctccttgagcttcaggaaggcatagaagacaccaaagtggaactggttcaggaaggccaacttgttcagctttacctcgtgctcaaagaatcggtcctccagcgtcttgtccggggttgtt

SEQ ID NO: 506364 - DNA, 225 bp, Homo sapiens
ccccagggcccaatccccttctccacttactataatggttgactaacgtcccaaggggtttccggtgaaatggagctgtggattgtctggttctaggctagtaggcaaagagacctcctctccctcttacccgtgaggcaagatccctcaaagcaggagtctgccctctcccatgggccggcttgtctgtgtatgtaccacccatgtagggaataccggcctagg

SEQ ID NO: 506365 - DNA, 178 bp, Homo sapiens
aaatatctcagtgacgtccagctaaagcgaatctaactaattgatatatacataaataccgctgctctcgacactaataaacagtaactgaacgtaactacgtaaataaaaacacatttagaggtccagttataaaaaccttaataacaagacagcaacaacataccaaataaagatt

SEQ ID NO: 506366 - DNA, 1570 bp, Homo sapiens
  misc_feature (847)..(847): n is a, c, g, or t
  misc_feature (932)..(932): n is a, c, g, or t
  misc_feature (989)..(989): n is a, c, g, or t
  misc_feature (991)..(991): n is a, c, g, or t
  misc_feature (1028)..(1028): n is a, c, g, or t
  misc_feature (1309)..(1309): n is a, c, g, or t
cagcctcctctgtggtgtgttgtgattagtacagcctattctgtggtaactgctctcccgttgatgatcacttatcgcttggttgtgtggttgccatccactaatgatctttgttcatatcaatcgctgctgcctctgtgctcacaagtagtcagcaatttgggggtatggatcctcttcttgtgctgcacgtggtaggttgtgtgttttcgtctaacccccgtgtgttgggagcacccctgtgcccccgctccagtttcaccccgcgagtttacttgtttgctccgaatgcccgcccctggctgttttggtagtggttctctctttccccggggggaacacaaattgtgggggtctctccaaatgtgaacgaggaagtgttgctgtgttctcgcaagggaagtttgttttcgtgtcggggggaccaacgacttttgtgtcggggggtgaccgaccgccgcaagatgtggagccgccaccccctgctggggaagcccccgctcttggggcctttctcatctccggctcccacggtgtgggattgtattgcccgttgggccccccgtgtcccacggtcgtccatattatgtccccccggcgcttaatgaccccccggttagttgggaatttgtgcccacccaccagcggcgtccaccacagttgggcagaggacacaaggttttgcgctggtaggcctgtatagcgtgatacagaagtttggatctgccccgcttttcctgcggtatacaaaacgccttgtgaagaagattgggccccccagagagattgtctgtggaaggcttcttcgggtggatattgcctcggcgcactctggtgtggaataatnggagtgttcctcggggagcacaagaccacacatcggtgggttgttttggagagagaggctttttctcccacggaggctatgttcncacccactcttctcgggtgtttctcgctcttgtactcggttctctgctcgagtaatntngagagacacacagacccacagcttctttgccggcgtntgggggtgtgttccactaccacaaacgcacacagttgggacacacacgagaaaggtctctgctctcgagagagccttctggcgcacacaggtgtcacacccacacagtgtctcggccccacagagaaaagtctctcacagagtagaggtctatacaatctgagatgatttgattgcccctcataatatcgctcgcccacccgcccacacttcttagaatccacagtgcgtggagatagagaccgcgttctcacgaagactcgttttgttgttccacaattnggccacatcttataagtttatagtatagtataaaaagagacttggttataatgagatacacccaaatgcactcgtaaaacctctcacgagaggaaaggagaatgttttgtggagccacctcttggttttctctttttgcgctgtggcacgtctttaacgttattagtcttttataaatcacgtacctttttatatggaaacacaacttgagcccaaaatttgtcacagaattttgagacccctttaaaaagtttaatgaga

SEQ ID NO: 506367 - DNA, 492 bp, Homo sapiens
  misc_feature (10)..(10): n is a, c, g, or t
  misc_feature (17)..(17): n is a, c, g, or t
  misc_feature (224)..(224): n is a, c, g, or t
  misc_feature (228)..(228): n is a, c, g, or t
  misc_feature (251)..(251): n is a, c, g, or t
  misc_feature (254)..(254): n is a, c, g, or t
  misc_feature (256)..(257): n is a, c, g, or t
  misc_feature (268)..(268): n is a, c, g, or t
  misc_feature (291)..(291): n is a, c, g, or t
  misc_feature (308)..(308): n is a, c, g, or t
  misc_feature (311)..(311): n is a, c, g, or t
  misc_feature (325)..(325): n is a, c, g, or t
  misc_feature (350)..(350): n is a, c, g, or t
  misc_feature (385)..(385): n is a, c, g, or t
ggccctgatnggcctcnttggtaatagacggttggactatattgttagcgccacgtaagcagtcattgtatagtaatgctgcaccctaactagtatagccacgaccatttattaacagtcagggcctatccttgcctgtagttctccgtcatggacgcacaaatcactgtgtaacttggctcactggtgagcatagggttgactgataaatgtttaatccttgntagnttgtgagagaatgagttgatgantgntnnataccagtggntagatggagtattaaggtggagnagaaaagaagtgagaanatnttgattcccctttnacttgatggtgtttatgaacatgcngtagtgcctttatggccagtttgagtcctgcctantttgacttttacgttcccattcctgtgttaccaccttcctcccgatttgttcacctattttgtgctttaaatctcaataaaatacttactgagggaaaaaaaaaaaa

SEQ ID NO: 506368 - DNA, 254 bp, Homo sapiens
tccagaaaggaaagagagtcagcgctacgaagaacaggaactcaaggagaaagtttcttctgtagattaacaggagagaacagtacatgagatcctggtagcatgctcaagaatgcgtgcgcaggacttgattggacaccagccagtctgatagtatcgagtagcacgtctgatcgagctcatgatgaacactagaagaaagctgaaattcagaagaaaccaattaagaaatagaacgaggatgatgttggaat

SEQ ID NO: 506369 - DNA, 835 bp, Homo sapiens
tgtgtcccctgtgttcgctctggcctgtgtcgtccgtcttcagtcggcgtctccctgttctcgggcgagctgttcgccattcgtggtttggcgttctatcctcctcgcatctgtctggtgtttttccttctggtgttggcttttatccgttttggccttccctgttcttcgcctactgtgctgtgtgttagctgcccattggtgctcgtgtaatcccctctctctcccatatgctgagttcatgccatcactagagccagaccttggtaggatctgcagtccttctcggtgtcggggtgacctctccctcaggagagtctgtccttccatgtccacctaatcagcagcctccccggcactcttcgaccagaactgcctctgcatcctgtggggtctgtgccagttagacccaggcggtccccagggtacgacttacatggagcagcttctggagaagcagggcgacggggaggccggcgtcaactatctgtggagatgctgaaggcgcttgcacgcgctgcagaaggagaactcatgcggctgcaagatgcagtatcctgagcctgacggcctaaaaaggagcggctgctagattctcaacgtgctagctctctgtgcccttccctgccctgccatgcgtgtcccgtgccagccggcacaacaggaccatgtcccgtgggccctatggccgtgcactcacaccaagccggcagcagcgactccttgagcaccagcaagagccctccgggaaagagcagcctcggcctggacaacctcgctgtcacacttcttcgtgaggtgggcgctaacgaggagtggggcaggaaggagggga

SEQ ID NO: 506370 - DNA, 285 bp, Homo sapiens
  misc_feature (153)..(153): n is a, c, g, or t
  misc_feature (185)..(185): n is a, c, g, or t
  misc_feature (285)..(285): n is a, c, g, or t
ctgagtcggatactgtcaggaggagatgatgactgggacatctgtcttcaaagaagtggacgtctaaggtgactccagtcctaagatgcagaatcgaagggcaagtctctggaccctcccaggaggaccacaggctgaaggaagctgcttgtnaccacatctcccggcagagggtgacctgcggntgattgagtccctctcccagatgctgtccatgggcttctctgatgaaggcggctggctcaccaggctcctgcagaccaagaactatgacatcggagcggn

SEQ ID NO: 506371 - DNA, 226 bp, Homo sapiens
  misc_feature (8)..(8): n is a, c, g, or t
  misc_feature (32)..(32): n is a, c, g, or t
  misc_feature (62)..(62): n is a, c, g, or t
  misc_feature (135)..(135): n is a, c, g, or t
  misc_feature (138)..(138): n is a, c, g, or t
  misc_feature (174)..(174): n is a, c, g, or t
ggcctgangtgctggtgtctcctcgcgggccnaaaggtggctggccgcttctccgggcgcanacttcgtggccggcaggttcgtgcccgatgacgtgcgccgcaagattgctctgcgctgccgggataaacgggncangactgcgtcgcggcactgtgacgccacccgggccanaccgcagggaccctcgccaataaacagccctcccaccaccgccaaaaaaaaa

SEQ ID NO: 506372 - DNA, 1004 bp, Homo sapiens
agcgggtgggcctctgcggtccgctccgccggttgctgtccctggcgcgcctccgttgctctcagcccagccgcctctgagagccgcccacctctcagccgtccccgggcagtgccagtagcggcggcgggtcctcgacgcgaggagcccctcctgtgcgtgcccaggcgggagcaaaatgtgggctctcatactccacgtcttgccatgctggcactcgacggtcaacgttttaagacggagtttgactactgagaggcacagaagtcacgataggtgccaagatgagctatagccactatgttgtcacacaattgtctgggagaaagcgagctgtcgcgtagctcgtctatgttacacgctccaacacagagagagtctcaaactcgctcgtagcggggcaacttgtccggtgtaaccgtaggacttgatactgccagggtatcgagctgatcttaagtacgcgtattatagccacctgtagtttcactgtcactttcccatgaagtcagcggcaacgagccaggatgacttcgatcatcgtatgggcaaggctcgatgcagagggcatgctatttccgttcgtctcgcatcgtgcgtgcctgaaacttggcaggaagaatgatgtccgaattctacgtccgacattggcctactactgagaggctttactcagcgactgagggtcccaggaacaaggttatggaggtaggcgccgccaataccgctgaccttggacgcaagtgattcctctgcaaggaggtccatgtgctaggtggtgatagtgcaccgttcccggagacgtggttagtgcgtaggcaggcaaagtgacctgagatgatggtcccaggtattcagcgtaaccaggagattcttggagccgataagtgcgagtcaaactcccctttaatacgccttggactgcaaaaaggccaacttcgtgttcttacggctgagtgtgagaagaccacaaagttccgggatttaaagaacctcggaaaccg

SEQ ID NO: 506373 - DNA, 832 bp, Homo sapiens
gtcattccgagagcctgattatttcctcttggggaattgctggcaattcaagaatctaccaccagatggcagtggtgcttgtgatggatctaggcaaagccagttttctacagggggatagttgttgaacaggcagttctcctttatggcaagaatgtacagaaaataactcttttagataatttctaaaataattgatcatgaaatcttagatataggagttgttttaaagttaaatttacctttcaaacattacagctgagctttccaatatggtgaccactagccatgtgtggctttgagcacctgaaaagtggttaaatggtgatgtgctgaaggtgtcataaacacatggctttcattctttagaagttcctatgacttaaagacataaataaaaaaattagctttcaaaagcaaaaaaagtcttattaatatgaagatggcatgtgaaatatctgagttgagttaaataaaagtttattacaattcatttcgcctctttttcctttttaatgtgactactagaaaagtttagatcatatgtgtctcatattctatttctaatggaccggtgctgctgaaataatctaaattattcttcatttttgcaagtggagatccggggctcagtttgatggaactggggttgagtcaagcctgttattcacgtggaacacggttagctcgggagagatacttctgaccccttatggtggggaggggttaggggtcttaagatttagcacgggaggttggggggtagcacagaaaaatgtgggggagaaaccccgggaaaaaaggggcgcgtgggggagagcgtgactcgtta

SEQ ID NO: 506374 - DNA, 387 bp, Homo sapiens
gacttacaggatcttgtgtcatccccttgtgtctcatcctacttgtgtgtcataccccttcgtgtgtcatccccttcgtattgttgatcatgaggtgctgatggtctttggcatgaggtcgcggatggacttgtgatgatggccacgtatgagtacaccaggttgcgaatggtctgcacctgccgctccagttggtggtccatggagaaggtggtcttcctggtgccccatcatcgttgtcttgtgtgtggctcttcttgggtaacaggccagttcgaaggaactgaggccttccagctgtccacgtttttcctgggagttcacagggccagctcgatctgccgcagtgtccttgtagacgtgtctctacgcaaagggggatggaca

SEQ ID NO: 506375 - DNA, 301 bp, Homo sapiens
ttaaattctgggacactgagttagattgcaaataatgacttacgaaagttgaattgggtgaggcgggcaaatcacctgaggtcagcagtttgagactagcctggcaaacatgatgaaaccctgtctctactaaaaatacaaaaaaaaaaaaattagccaggcgtggtgttgcacacctgtagtcctagctaattgggaggctgaggccggagaattgcttgaccccaggaggtggtggttgccgtaagccaagatcacaccactggactccaacctgtacaacagagcgagactccatctc

SEQ ID NO: 506376 - DNA, 685 bp, Homo sapiens
ttgggagtaatgtgttaacctataacctggcaggtagctgccagcaaaaattgcgtatttaccaattccaaggactttcctgcgggtcggtggctcaggcttgtaatcccagcactttgggaggttgaggtgggtggatcacttgaggtcaggagttccggaccagcctgaccaacatggtgaaaccctgtctctcttaaaaacacaaaaattagccgggcgtggtggcagtcacctgtagtcccagctacttgggaggctgaggcacaagaatcacttgaacctgggaggcagaggttgcaatgagctgagatcgtgccgctgcacgccatcctgggtgatagattgagactcagtctcaaaaaaaaaaggcaacaaagtactttcctttggaaaagagtgcccactggctgggtgaagtggctcacgcctgtaatctcagcacttgtggggctgaggcaggcagatcagttgaagccaggagtttgagaccagtttcatgtggccaacatggtgaaaccccgtctactaaaaatacaaaaataagccagatgtggtgtcatgtgcctgtagtcccagctactcaggagagtgagacaggagaatcatttgaaccctggagttggaggttgcagtgagcagagatcggccactgcactccagcctgggtgacagagtaaaactc

SEQ ID NO: 506377 - DNA, 642 bp, Homo sapiens
  misc_feature (260)..(260): n is a, c, g, or t
  misc_feature (438)..(438): n is a, c, g, or t
  misc_feature (446)..(446): n is a, c, g, or t
  misc_feature (459)..(459): n is a, c, g, or t
gccctggtgaaccctatcactcactacccctaactggcatatatgacatctgtgccttttcaatacacccagtttggacccctaacttgctgggcagccttaggcaagtcagttcacttgagtcttagctctcatctgcacacacaaaagcagaataatctatccctcccctacttcaagtctgttctgacagctcagtataaaaacatgcaggaggttcccacctctgtgcctgacacttgggtataaacacaagtgtntaagtgaaattttcaaagttggcaatatttggtcaagataacttccctactcagaaactgaaatatattccaagccctaactctggaatctccagtccctggtctgctaccataccacctttacccaggcctgagaaatgaaagatagatgttttaaggcagcacttcccaagtcaantgaggtangggtgagtggtcnggattttgtttaaaatgcagattccaactgacaaggtcaggaggttaagttactgcaaacaagctatggagcataagattccaaagaaccataatgcttctagactttttttttgagacaggaatttcgctcgtacccagactagagtgcaatggcacgatcttggctcactgcagataggtt

SEQ ID NO: 506378 - DNA, 275 bp, Homo sapiens
tagcgggtacgcggtcagggtggcgtcgcgtcccaggccggcataagccaggaaatctgcaggtcgggcgggggcaaaagaccctcggccgctccggccattcgatcaaaacgaccgcatcttcacgcagtaaatcccggaatcctgcgtccaaccattcgcgcgaatcactaaatctataaaaatcaagatgatagaagtataagttagaaactttataggattcaagcagcgcgtagcttggactctggattcggcctgtgatgccgcattcg

SEQ ID NO: 506379 - DNA, 244 bp, Homo sapiens
  misc_feature (46)..(46): n is a, c, g, or t
tctagacgatccccgtacacggtagattttggagaaaatcttcacngtttatacatctgacaagactaatatccagaatctacaagggactcaaacaaattagcaggaaaaaagaaagaaagaaaaaaaaatcccatcaaaaagtgggctaaggacatgaatagacaatcctcaaaagaagatgtacaaatagccggcaaacatatgaaaaaatgctcagcatcactaatgatcagggaagtgc

SEQ ID NO: 506380 - DNA, 1345 bp, Homo sapiens
  misc_feature (471)..(471): n is a, c, g, or t
  misc_feature (473)..(473): n is a, c, g, or t
gacgcatatgaggtgaccgttcaccaaccgtgcccaagacccatccctgaatggggacccacaacagcagtccataggaaatttgctcgttgatgctcgtgattgtgatcgacgccagagttgatgggtaaccgacgctcatgcattgaagcgtcagggcatgtctgtgggttacccacatagctagtctatcacgctgagtagggcacctcgtgagaagtgccgcgaccgaggctgacgtgatgtacgcgtatcatcactgctggaaatcgtaacgtctacaccatttgacctacgaattccatgactagactcacagattatcctgcaacgattggtaggaagcgcatcaagatagcctgttgagcaactaattgcacacaactagtaccctgagtcccatgacctacgaacgagattctcaaactaagcggtattccaaacgtgtcacaactttcaacttgcgtagcnancaaaaacctgtctaatgagggtatgtcgctgtctgagcaacctatagtatgtcatggaatccaggtctcgccatcctttcgagacgacgtcatgacgcctcatattgaatcgttgcgcgtctagtaacgacatccggcagaactgttttccgtgctccagaagatgccagacactccatgaaccaattccggactacatgccccgtgtgggttgtactaggttcatcacgggcatctccatcctgcgtggtgggctccgtcatcctgctcatcgttctgcatgacctggaggctagctgggcctggaagtgaacacactacagtgatgacaccaaatacaccgatggccttgcctgtggctgacttgaatccccccaacggtgaagcccaagaaggctggatcatctactcaggcggaacaccccttacgtggacgctggtcctgaagaattggcccaggttctgctccaccgacagacggcacaggaaaggtgtcctgcgaacctggtggcacaaacgggcaacaccgagaggagcaagcataaccagtggtggacgcaaagacggacaggggcggagagacaacacaacaagagacggaagagaatgaccagcaggagagagccaacataaagagaggccaccctgacgggacgccgccaacgactttgattccacagcagggtgagacggcgaccgacaagaacacatactgcataaagagaaagcggaggacaaccataaatacacagacatggaagcaaaacaccgaggaactcacaacagagattacatcaaatgcagacgatgggagagagaggcgcgagctccgacgcgactgacgtctacattggtctgagcactgactacct

SEQ ID NO: 506381 - DNA, 974 bp, Homo sapiens
agctcccagcatatttagataatagggcaggggaagcagcctctttcttgctagagctggattatgctcactatgctccactgtcccatgacacttgtttgctaaatgtctgtgcccatttgctgtagcatacacgttcagaattaagagtaggagaaagaatgtgctgagtgttttcctcccttggcctctacctggaccatcatccgcaacagcaccagtcaacggggagagacgaaacgagaattcttttctatagaagcgagtgggggcggggatgggtagggatttatccaactctaagccgcatagacgctcgcagcgttagtgacctcagtgtgctcttcgcattccttcttactgccctgtcctctgcctgggaagaggcttcgggaactaggttcatagggaagggacaacatggaagaaacagcgcatttcacattgtcatcgaacagggcatataaccatgcattctgtaccctgatctggccatatagcgtctcacaactgccagtggcgagtgtccactcgtctgtcagttagctaccgttaactgtccagccgttactacctgtgggatcggtgcctggtctcgtcttctctgtgtccaggagcaaagccagctaccttaaaacgtgaaacgtccagttctacgtctcgggaaagacaggaggtcctacctcaggaactgggggaacggagcgggaacctaggacctggggccgcgaggccgggactcaggcccccgtcaaggatccccagaaaatggcattgagctactcctggccggtggcgactaggccgttcgatgcaaagacctaaaccctagtcatcggacccacaggcccctagcacccaaaggcagcaagggcacagggcgaatacccatgagactccaaggacccgccgcaacacacagcgcggcccacccgcccaacacaaacccccatggcggcagcccagcacccaca

SEQ ID NO: 506382 - DNA, 172 bp, Homo sapiens
tgcatggacactgaaggacttcaccgtataggggcaggaggctttctggtgggcagtccgacggggcatgtgccctaatgccatggggtccctatctcgtactcagtggccctggcccagggagttctcgcttctcgtcctgtgcttgtccacgggagtggctgacttgcca

SEQ ID NO: 506383 - DNA, 320 bp, Homo sapiens
agcggaggtcacgtcatgagatccttcctcttcgtgtgcctctcccatcttggtctgcatctgtctgcactgatctccagcaacttcactttctcatagtcttctcctctgccgcagatgcctttttcttttcctcttcctttaggttcccactccaaacagagctttttgtggcttcccaagtttgcacggtaattttcagtcttttatcttacttccacaatcctcctggtgacttacattaccgacgcttacttccgcactcaggtgcacgctcccggaactttgcgcacgtctcgtgttcgcgacttctgacgcgg

SEQ ID NO: 506384 - DNA, 421 bp, Homo sapiens
  misc_feature (175)..(175): n is a, c, g, or t
  misc_feature (206)..(206): n is a, c, g, or t
  misc_feature (232)..(233): n is a, c, g, or t
  misc_feature (260)..(260): n is a, c, g, or t
  misc_feature (341)..(341): n is a, c, g, or t
  misc_feature (352)..(352): n is a, c, g, or t
  misc_feature (383)..(383): n is a, c, g, or t
cttactgtcatacagagcggtactagcgtcgtgctgtataaaatcatttgcacattcctgagtagaggtatactgattataagacccaaagggtaatttctatagcaaaataccataaaatcagtcggagctttgtatacaaacaatggaagaccaactttggtagaacttttgnccgcattgtgatctgaggagtctggaatatnggagcgtttgtaataccacattcatnnatttcttatgttggacaatatgcaccnaggtttaagatatgtacctcctctgagtgggcctttgactagaagagcgccaagttttaatgaagcgtagttgtgcatccnactaaggaatnatgttttatacagctaagagacccactgctntgcctgaaagggccgttctttaaatttgtgtgcagcga

SEQ ID NO: 506385 - DNA, 568 bp, Homo sapiens
ggacgatggacccagctgctgagccggctgagtgctggtgtggtgtgaccacctgtggcacctctgccgccagctccagcacccagcagtcagccctgtgcctggctgtgtgatgactgttcctcctcctccagctgcagccccaccactgcccagggccctggctaagccctgcctgtcttcatcccctgtgaacctgctcccctggaaatgcatggatgtgaactggctgaatgctcccaattctctccgaagaacaagtaatcatgtgagtgctgtgtgcctgagcaccccatcgtcatctgtgtgtggtgagacctggcagctgggaagaccacacagtgtgcctacagtttctctatgaagcatggcttcagcagttgaatgacatgcatcatacggtgtcactggatgcccctgcctgacgtgtgccgcctgttgtgccatgtccgcatctgagttggccaatgtgagatgaatcttgtccacagctgcggtcgtctccataccacgatcctggtatgacaggaaactgtgacacgaggagaccagaatcaagttcattgac

SEQ ID NO: 506386 - DNA, 200 bp, Homo sapiens
ttgggggggggggggggccccccccttttttggggccccctttttagggggggggggggggttttggccccccccattgggggggggattttttttttcttttgttccttggggggggggtccccccccccccggcccccggtttttttttggggtttcccgggaaacgggcccccccttcttttaaggtttgggcggga

SEQ ID NO: 506387 - DNA, 405 bp, Homo sapiens
tctagaggatctgcaagatcctattgggactgtcagtaggagggacatgccaggttcatggagtgcatgccttcagcagcctgaccagctagggtcttgcgcctcacctcatagctgtcaccttgacactggagtccctcctgcaggacccccagtgctaggcacatctttggcaggatcaaagcccagcaccttgccaagagctatgcaggaactccacaatggtccatgcagtctgagaaggctccactgagcaatgtcagaccaggtactcgtgagaagtcaggcaggggctgctggtccgtcagacacatatcctctggcggcttcttcatttcctccaagatcatctgctgcctctgccgttcctccaagcgcctctgtgtggccagggtcttatctgct

SEQ ID NO: 506388 - DNA, 694 bp, Homo sapiens
agggcccccgggtggaaaggcccccaagaaaacgcggggcttacaggggagcattacaaaagtgtcaagagaagaatgaggggaggcccaaaacgaagtttggtcccacgccgtagtgatgcttgaaccagcgccgcggccgcataaagattggtagcctgtgaagaaggggtcataaacatgtacataggcacagtagttagtaatgatagggcgggagggccaaaaacaacaggtgcgtggggagagaaagagccctgcttctcaagaagaggcccccgtcggtgaaacctcaaaaaagtggaatatcgcgcccctcacaccaaataacggcgtcttctcgttagggccacaccgtgaccacagcatattgcgtgagagtgctcgccgccgcagccgttctgcggggccttgggccaatttcttggctgcatcatggaatcctttacactggcggttccatacccccctggatcttctccctcggtgggaattaaaacgccgagttacccccatacgctgtgtcgaacaacgaccagtacgatcgtgtaactacccaccatcagcgaggtagggcgcgtaagactcgcgcgcaatccggaacgaccgaagcgcacgcgaagacacctcgtgaagaagacagggaccgtcggcccgcacaagcgtcgaatagcatacaccactacgaagatta

SEQ ID NO: 506389 - DNA, 931 bp, Homo sapiens
  misc_feature (931)..(931): n is a, c, g, or t
gaggcagaggttgcagtgagtcgagatctggccactgtactccagcctgggcgacagagtgagactctgttcccccactcccccaataaaaaaagtctgatgagcaagaaaagttcaggggtagagttgcttgtgtaattgagatgtttaacagcatcaggctaattccttgccatagtagaacccagaagctctgagctgtgtgccaggagatacctccctggtcagtacttagtaccagagttttccctagattctttaattttagtaaatgtgctcacattgagtcaatccttacataactgggtatgttatttccagcccaaggaatgtttatttttaaaaatatttttaattatccataatttcagacttacaaaatgtcgcaagtattcccggataccatttacctagatttgccaaatgtaaacaatttgcctcatttgctttctttccccttctcactaataattttttcctcaacatttaagagtaaaatgcagacatgatgcttctttatcctttaaatatttcagcattcccccccgctcaaaaaacaaggaattctcgaatcacagtgtagtgatcactatcagaaaattaacattgacacaaaactgttatctaattgataggccgtattagatgtccgtatctcataagtcgttctaaaatgtaatctaagatcgcgtgcatcaggttcctatttcctcgcctcttactcggactagtcgacggtaggtcatggactggacttggaagatcagccggttgtacaggaacaccatggtgcgagtgtccacacacgatgccctgggaatgcgcgatgccattcgacgtagcaggcggagacacagccacctgtggcgacgacgcccactccaaagcagcgcgcaacaacccgcgaacgcgtgacacaacatgccttccn

SEQ ID NO: 506390 - DNA, 672 bp, Homo sapiens
gcactttaacacctaacagtttctatgtgttcatagtggacttgtcaccagaaatacacacactggatgatattaggagattatatagatctgcccacacgcacgctgcattggaccaatgtgtgacttgtactggtccgatccttctgaaaattcggcaatgaacccaatcacaggaacatcttagtcacaatacagttcgaggctgtatcttatttttataactatccagcagtgtgtgaatttttgcaaaacaatacaattagtcatcgattcattagagctcatgaagctcaagatgcaggctatagaatgtaccagaaaaagtcaaactacagggttcccttcattaataacacatatttttcggacacctaattacttagatgtctacacagtaataacgctgctgttattcaaaacgtatgacaaatcaatgtgcatgacatattcgacagtataactgttctccacatccttactggttgcctaactttctatggactgtcttcacgtggtctattaccgccgtaggacgaaccaagtgcaccgaaaatgttggtaaatgtcctgagtacttggctctgcatgatgcacctacatgactgacaaggtgaagaccatgtatagatggatcaagcctgcagcccggaacacaactccataccgcaa

SEQ ID NO: 506391 - DNA, 313 bp, Homo sapiens
cgcgtatatgctgtctcagttttctcctctataaaatagggtaactaatagtatctacctcataggattggtgagaggattaaatgtattgctataagacaagcacttggaacagtgcctggtgcgcagtaaatgtttcatattttctagtttttttttttaacctcaaagtaaaaggtgagtatgaagtcactgtacaattagttagatttgggaagtgaatagaataaatcatgtatctcttccctttttttttttttttttatttttttttttttttttttattggggggggaaaaatataggggggccc

SEQ ID NO: 506392 - DNA, 412 bp, Homo sapiens
  misc_feature (36)..(36): n is a, c, g, or t
ccggggggggttaactgctctttttataccatttgntgccagtgcttgattcgtatctggggagcgctggctgggcggatttgtccctgcgcctgggcaatcgcctggcgccattgattggtgcgcgtgagggcgaggtggtgatcaccgataccacctcgatcaacctgttcaaagtgctcagcgccgtcttgagtgtgcagcgccaacgtacacctgcgcgcaaggtcatcgtcagcgaagcgagcaactttcccaccgacttgtacatcgccgaaggcttggccgaattgctgcaacaaggctattccttgcgcctggtgaacagcccggcggaacttccccaggctatcgatgcggacgtggcggtggtgatgctcacccacgtctactacaagaccggctatatgta

SEQ ID NO: 506393 - DNA, 469 bp, Homo sapiens
  misc_feature (42)..(42): n is a, c, g, or t
  misc_feature (55)..(55): n is a, c, g, or t
tgaatgtcataactaaagacaatgtagagattgagccccccncaatccccttgtnttagacatggggacacagagacccaggcagggtacgtcagcaacttgctggtgattacacaactacagacaaggacgcggccagccctgaaacccagggtgaggagccaattagacaatgctgtaacagtctatgaaacttaaggactgctttgcttgatggaagtaacaatcccgctatgtacaaggaacagtaaaactgaggctaagggcaatgcaaggatggcacatttcctaagtacagagatgacaggaagctctcgtcacgccatcttggaaagcctctagaagtggtgtgtggatgtctggtctcccatgagattcctctgattctgcatcttcttcaacactactcatcagctgtgtcatgattatcattcctgagcccttgcttaaattttggatcaatttcaaa

SEQ ID NO: 506394 - DNA, 175 bp, Homo sapiens
atttgacaacgtactctatgcttgtgggaaacacagccttgctagtcatgttaatagaatttcagggggaagcagaagtagatagggtgggtttagagctgccctctaccactcgagaagtccttgttttgaccttgttcgtactggtatgggtgtacggggtaccgacgctcga

SEQ ID NO: 506395 - DNA, 221 bp, Homo sapiens
ttgatcccctcaactgcaaattgcccagcatccagagggtgaggacgaggagcgcgagcagatcaagaccctcaacactaatgtttgcctccttcatcgacaaggtgcggttcctggagcagcagaacaaggttctggaaacaaatgtggaccctgcatgcaggagcagggcaccacagcctgtgagtgcagaacctggagcgcgttgttctgagcagtac

SEQ ID NO: 506396 - DNA, 126 bp, Homo sapiens
acttgagttcagcagcatcttgtactcttggttctggcactccatctcactgcggagtctcgcatcagtctgggcctcgatgctgctgatgagtccctggatctgctgcagctgcagggcatagcg

SEQ ID NO: 506397 - DNA, 430 bp, Homo sapiens
tctgataagcaatgcctgttcctaccagtcatctgtgcatgcttgcagagtatgcagtgagcgatccgaggtctgtttgcagtagtcagatgcagcctggtatacttatgcctcataggcatagtccaagctatgggtcggctatgtgactggtcatgcggttaagactcagtgtcaggcgtattataccatagccgcctagagttcagagtagtccggcaagtcctattgatccagcgatggtggctccaacatgggctttaggcagtcatcagtgtcgtcagtatggcggcatcctgtctatgcaacctaatgcgtaagctcgtcgtattgaggtgctggcgcatgagagtgatagtgcctggtcactgagactgagtagtagaatgtctagtgagtctaggctgtggcaagtgtagcagagtgcgtt

SEQ ID NO: 506398 - DNA, 189 bp, Homo sapiens
catccaggcgcacttctccaggaagctggggaagagttggggagagggaggcaagaagattccccacccatcttaggcgcagggagcggtcagggaggcgccagaggtgggccagagctgtgacctggcctcacaccccgtcccggtggggctctcaggcccctgagggccagaagtgcgcctgggtgc

SEQ ID NO: 506399 - DNA, 138 bp, Homo sapiens
ctagttgaactgcaggaggggccggagccggcgggcatccacgaccatgtgaagcgggcctgcatgtatagcaccaaatacaggataagtgtacatggagaaggaaggcatggccatgagaagaaggacttcgctggg

SEQ ID NO: 506400 - DNA, 746 bp, Homo sapiens
ggaagaggagtgaggccaagtacattggctcagctgacttccaggccaaggagatatttagcacctgcctggagggagagcagaggtgccacaggtttgtcgccctctggccccaccccgttgagcacagtggactctgtatcccaggtgtgcaccggcagtcgccctgtggaacctgaaacattccctgtatagggtattccctgcagttctggctttgggcaacttttgagttgtctcctcagtggctctcagagacccgaatacagcaagaagcggtgcttccccccttgtgcgacaacccagtaagagctgatccagacataaggtgtccagaaggttaggcagggtggagcggaagagatgagcgagaaacagataagagtgagcatttttccaaaggtggattcctagcaaggattgtaaattgcttggaagcaacgggtgagcttccatattcccaccagagtgtgggaatgctgtggcatgtgattgtatgatctccttgcaagctcagtgtgagttgattcctccaatatgggccagatgctttggaatgatagggaaagtctacatatcaatccagtgtcctcttgtatagagggagtatagtgtattcatctcagtgatccatgtgcttagtgaagtccactgttattctctgtggggacaagagctgggccgttttgaatgggtacttgacgtgggtccccctctgtgagtctgaggatgcctcacttcctgta

SEQ ID NO: 506401 - DNA, 474 bp, Homo sapiens
ttcacaggtacaaagcaagttctaagtcaaggccacaccaattcctacagtattcgtatcgcgtctcaattctcaaaactaacttttaatacgcttaaacttaccctaagggattatacatgaaaatataaactagaatgaacaatcatgagaaatattgctttgaatcagggagctagcaccttagagcttgccacaccgcaggtctccccggggtgtgcacggtgatgtggtgtatcagatccaccatttaagcatactaaaagtatttagacttagataacatcactctgaagtatactaccaaaatgttacttgagaaaagctgaaaatagtattagtatatgcattatcacatgctagaagaaaatatggcatgagaaaacattgaagaggtcattttttactccagatcatgcagaaactcagtggtgcaaaatgggtcccctagtttcctctattataagtgctatt

SEQ ID NO: 506402 - DNA, 697 bp, Homo sapiens
  misc_feature (692)..(692): n is a, c, g, or t
acttagggagctggccaggcacttgcaaggttggacattccaggcaaggtacacagaatatgcagaggaacctgggcgcttagagggagtgtcatgtctgcagaaggccaaaccatttggcgtacctggagctcccactaaaggctgcagcctgtgctaaggaaggaagttgagccagaaggtaggttaggtgccagctcaccaaggctatcatccaaggcatggctgaactgctgactttattggttgtgacatgacacgttaggataggtcactccatgagacaggtgattgtgctttcatatggtgtgaaaatgatggtgcttaaactgttgcagaactaaaaggatctgtgccttacatttcaagtcaatttcacatttgtgtgaagcttatcctgcttctaagacttgaaagttcatgtgcctctgctgagctgcagcgctagtaattaggtgcctcagtatactcaccgcaacccatgctcatgaaaagacttgagaggcagaacatacttgtcttgaagatagctgcactcaagcgtaccgaatgagtgcgctgccttcacgcttgaattactcgtacttctctaggatgcaccggccatatcctaatgtcagaaaaccgtgccatagtgcggcgctcttaccatgcacagatatattccgaccgagtgttgattccaactgccntcccg

SEQ ID NO: 506403 - DNA, 592 bp, Homo sapiens
caagaaatggaagcttatacacccaagttaactcaggttctctcaagcagtgctgtgatggtactactggcatgcactacttagagagaagctggactaactaggatgtataaacgctcctgaaatccagcagcatttaagacagctagccgaccggaaacccaacagcaggacaaccaagaacctgaagagagaagacaagaggtctacacaagacacgggcaagtcaacggactagcgacaaagcacactagacaacacagcacccacagaagacgacccacgacagagacaaacgtacacaaacaaaacccacagaacagcaagccaacaccgcaccaaacgacgacggcacagagcaacaacgaagaaaaggacaaaaagaacacaccatgacgaccgaagagccaaaacgaagcagaatcacaagaagaagcagcgcggcaacaaagaataagcaagcacggcagaaaacaaagcgaaccagagaaacaataagagggaacccacgaccacaaaccaccacagcgacaccaaaaagagcaaaagacgcaacggaacgaagagaagacgcaacaaaagacagacaaaa

SEQ ID NO: 506404 - DNA, 330 bp, Homo sapiens
gaggatcccggctcatttcatgtcatatgtagaacacagtgcgctacccaccacaactccgtgggctcaagagatccttccacctcagccttccaagtagtctaagaccacagggcacatgcaacaacacccaactccttctttttctttctcctactaccattcttactatgtacaggttggtcatagatataacagtataatcaaaatattttttctgttctagatcagaaaacaaatcatacagcatgggtcggccatgtcttggtctcttccatccctctttaatagtgattactgcaagagaatctccctgtcaccaaaatgcca

SEQ ID NO: 506405 - DNA, 275 bp, Homo sapiens
atcatatgcaaggcagaacctcaagggagacctacctcccagcctggggaaggtgagtgtcccagaggaggagactggaacgcaatgactgcaagagggcaagggcccaactaaactacacaccgtcttactcacggtctttggggaagaggctacaatggggacagacccccaggagccatcctgagtcaccttccgatttttaacccaggcgcaaacggcgtggtgaacaggatagcttaagaggttttatcaacccgagaaagtacttaccg

SEQ ID NO: 506406 - DNA, 286 bp, Homo sapiens
tgggcctcaccctgtcaggcgcggtccaggctcaggcccaatcccagcccgagagcgccacgacgacgctgccgcctgccacggtcgtggcagaccgtacgggcgaagcagtcaaggtggagcgggtgagcagcggtgcgctcggtgatcgcaaggctgtggatacgcctttctccgtgaatgcggtatcgagcgacgagatccagcagcgcctggcgcagaccgccaacgacgtcttcaagtacgaccccgctgtgcaggtgctgagcgacagggtaccgagctc

SEQ ID NO: 506407 - DNA, 688 bp, Homo sapiens
  misc_feature (31)..(31): n is a, c, g, or t
  misc_feature (85)..(85): n is a, c, g, or t
  misc_feature (88)..(89): n is a, c, g, or t
  misc_feature (98)..(99): n is a, c, g, or t
  misc_feature (115)..(115): n is a, c, g, or t
  misc_feature (137)..(137): n is a, c, g, or t
  misc_feature (141)..(141): n is a, c, g, or t
  misc_feature (214)..(214): n is a, c, g, or t
  misc_feature (247)..(247): n is a, c, g, or t
  misc_feature (268)..(268): n is a, c, g, or t
  misc_feature (271)..(271): n is a, c, g, or t
  misc_feature (273)..(273): n is a, c, g, or t
  misc_feature (283)..(283): n is a, c, g, or t
  misc_feature (307)..(307): n is a, c, g, or t
  misc_feature (314)..(315): n is a, c, g, or t
  misc_feature (325)..(325): n is a, c, g, or t
  misc_feature (338)..(338): n is a, c, g, or t
  misc_feature (340)..(340): n is a, c, g, or t
  misc_feature (346)..(346): n is a, c, g, or t
  misc_feature (360)..(360): n is a, c, g, or t
  misc_feature (387)..(387): n is a, c, g, or t
  misc_feature (390)..(390): n is a, c, g, or t
  misc_feature (393)..(393): n is a, c, g, or t
  misc_feature (395)..(395): n is a, c, g, or t
  misc_feature (407)..(409): n is a, c, g, or t
  misc_feature (416)..(417): n is a, c, g, or t
  misc_feature (431)..(431): n is a, c, g, or t
  misc_feature (433)..(433): n is a, c, g, or t
  misc_feature (435)..(435): n is a, c, g, or t
  misc_feature (443)..(443): n is a, c, g, or t
  misc_feature (468)..(468): n is a, c, g, or t
  misc_feature (484)..(484): n is a, c, g, or t
  misc_feature (489)..(489): n is a, c, g, or t
  misc_feature (501)..(501): n is a, c, g, or t
  misc_feature (514)..(514): n is a, c, g, or t
caggacgcgccgttcgcgccgccgccgcaantcgtgcccatccgccggggcgcggcgccccctcccggcggcgcccccagcaagntgnncagccaagnnggagaggcggctaagntgttaggaggcttccaggtggnaccngctcccgatggccagtttgctttcctaattcccaacggggccttcgcgaacagcggacctgtcatccccgtcnacaccagcaacagcggcacctcacgagagcacnaaaaaaaaaaaaaaaaccagnagnancaagctaacngcgaacaccatgatggaggccgtngcggaannaagggagaanaggccaccccacnanaaaaanaccccaacccacanatcttcccaccgaactctaaacagaanttnaanantggagaaagagnnnttttttnnataagtggtacttngngntttttaantttctaagaagttactttttgaganagagctgtattaagtnactgnccatgcacatanttgtatatatttnatatgttcatattggattgcgcctttgtattataaaagctcagatgacatttcgttttttacacgagatttcttttttatgtgatgccaaagatgtttgaaaatgctcttaaaatatcttcctttggggaagtttatttgagaaaatataataaaagaaaaaagtaaaggcaaa

SEQ ID NO: 506408 - DNA, 855 bp, Homo sapiens
  misc_feature (236)..(236): n is a, c, g, or t
  misc_feature (843)..(843): n is a, c, g, or t
taagacgggacgataaggctaggtacgaggctgggtggtgaaaaaattaattagttcaccttgctcacctgcggtgacagggacagctcaggctcttggtgactgtggcagcgggagttcccggccctccacacccgggccagaccctcggggccatgccttggtggggcctgtgtcgggcgtgggcctgcaggtgggcgcccccgacacgacttgtgcttcccttgttgccttanaaaaaacttggccttccctgcaaggccacagcaacccaacccgggggtggttcctgggggaccccaaggggggttggggggggtcaccacccaagaagacgaggcagggggggcccttggccgtgcttcctgcaggatcatgcagctggggcgcgggcggccggcggtttgggaaagccccaatccccagcccttctaatcaaaggtcactgtgcattctcccctttcacgcccgtgccccccaggggccttcccctttcttgcccccccaggggggggctcccctgttttgctccaggcgtagcgggaaggcttgggtcggagcattaagtcttcgttgtaattataattatttaagctttttgtgggccaggtttgcgcagagaaccggttctggttgcccttaggcaagtatttttcccaggtttgaaccgaaattaattcctagatcgtatttgttcgatttaatatttgccaaacacgaagagtaggtttcgaacggtacacttttttatcagcagaggagttgactaccaagtggcgtatgacgttgtaatcttagaactttccctttggtggtgtattaccctgtgttaattgcgttgtnagctttatagtt

SEQ ID NO: 506409 - DNA, 189 bp, Homo sapiens
gtattgaaaaagtagcaagaagactggatttgggcaagcatggtctacaattggttgtgaaatactgaagctatgaagaataaatgctatcaactttggattatgaaaccccatttatgattcttataaatacacttgaaatacaaatgattaaactaaatttgggtccagtgacattactttgcactg

SEQ ID NO: 506410 - DNA, 923 bp, Homo sapiens
  misc_feature (23)..(23): n is a, c, g, or t
  misc_feature (78)..(78): n is a, c, g, or t
  misc_feature (207)..(208): n is a, c, g, or t
  misc_feature (217)..(217): n is a, c, g, or t
  misc_feature (233)..(233): n is a, c, g, or t
  misc_feature (237)..(237): n is a, c, g, or t
  misc_feature (243)..(243): n is a, c, g, or t
  misc_feature (247)..(248): n is a, c, g, or t
  misc_feature (251)..(251): n is a, c, g, or t
  misc_feature (289)..(289): n is a, c, g, or t
  misc_feature (294)..(294): n is a, c, g, or t
  misc_feature (314)..(314): n is a, c, g, or t
  misc_feature (323)..(323): n is a, c, g, or t
  misc_feature (330)..(330): n is a, c, g, or t
  misc_feature (336)..(336): n is a, c, g, or t
  misc_feature (346)..(346): n is a, c, g, or t
  misc_feature (349)..(349): n is a, c, g, or t
  misc_feature (368)..(368): n is a, c, g, or t
  misc_feature (398)..(398): n is a, c, g, or t
  misc_feature (411)..(411): n is a, c, g, or t
  misc_feature (417)..(417): n is a, c, g, or t
  misc_feature (511)..(511): n is a, c, g, or t
  misc_feature (522)..(522): n is a, c, g, or t
  misc_feature (524)..(524): n is a, c, g, or t
  misc_feature (534)..(534): n is a, c, g, or t
  misc_feature (551)..(551): n is a, c, g, or t
  misc_feature (566)..(566): n is a, c, g, or t
  misc_feature (582)..(582): n is a, c, g, or t
  misc_feature (618)..(618): n is a, c, g, or t
  misc_feature (678)..(679): n is a, c, g, or t
  misc_feature (693)..(693): n is a, c, g, or t
  misc_feature (731)..(731): n is a, c, g, or t
  misc_feature (738)..(738): n is a, c, g, or t
  misc_feature (740)..(740): n is a, c, g, or t
  misc_feature (767)..(767): n is a, c, g, or t
  misc_feature (791)..(791): n is a, c, g, or t
  misc_feature (798)..(798): n is a, c, g, or t
  misc_feature (851)..(851): n is a, c, g, or t
  misc_feature (854)..(854): n is a, c, g, or t
  misc_feature (856)..(856): n is a, c, g, or t
  misc_feature (896)..(896): n is a, c, g, or t
cgctgcccggagccggccggcgngacctggcgcccaatcctgggggacccggtgccgtggcccaggggccgggccgangtcccgggggcggtgccttgcgggcccgtcccggggcggtgcctggtgggctggccccgcggttcctcccctctctgcgggcccagtcgccctttggccgggcgagctaatcgtcggctcaatgacaannaggcccganccttcccgtccaaaanctanaaaaanaaannaanaaaacccaaagcggcttctttgctgtcgccgcccccantgaancaaaaactccccggctccantaaaaaaanaactcanttaaantttccccaanaancggccctccgggacgatanctaaaaaaaaacggcgcccgcatctggaanaagctggcgaaanacttantatccgagggctcgggacttggcgccatcgaggtcatggggacccaggatccagggaacatgggaaccggcgtcccagcctcggagcagataanctgtgccaaanangatccacaantttattgccctgaaganactggcggcaccaangatgtgcaggttacanactgtaagagtcccgaagacagccgacccccaaaanagacggactgctgcaatccggaggactctgggcagctgatggtttcctatgagggtaaanntatgggctaccaantgcctccctttggctggcgcatctgtctggctcatgantttacananaagaggaaaccctttcaagctaacaangtctccctaagcaacatgataaancatatangcatgggcttgaggtacctgcagtggtggtaccggaagacccatgtggaaaanaananacctttcatcgacatgatcaattctgtacccctaagacanatttatggttgtcccttgggtggcatc

SEQ ID NO: 506411 - DNA, 278 bp, Homo sapiens
aaaaaaaggggtttttgggggggggggggttttgggaaacaaccccccccccctggggcccccttttttgggggggggggaaaggggggtttctttcccccgttggggggccggaacccccttgggggggggggttttcccttttgggggccgggccccccccccggggggggtggggggtttttccccctttaaagccctttttttttggggtttttccccccccgggggggggtgggtttttttttttggggtttaaatttttttttcccccccca

SEQ ID NO: 506412 - DNA, 199 bp, Homo sapiens
gggacatgtttctaggagaaccgcgtcatactttatctatagctttcctaggtctcagaagcatcaagtttaactgtggacattggatttggtggacattgtttctaggagataccgcgtcatacctttatctatagccttccgctaggtcttcagaagcatcaagttttaactgtggacatcggatttggtggaacat

SEQ ID NO: 506413 - DNA, 334 bp, Homo sapiens
  misc_feature (68)..(68): n is a, c, g, or t
  misc_feature (194)..(195): n is a, c, g, or t
  misc_feature (253)..(253): n is a, c, g, or t
  misc_feature (271)..(271): n is a, c, g, or t
  misc_feature (293)..(293): n is a, c, g, or t
  misc_feature (327)..(327): n is a, c, g, or t
ggcccttcccccagggtcccgtagtacccttgccatggaccccacaggacttcctgcacctggcatgntgcccttttgccatctttggggaccggtgaccctagtggctgctggggctgcccaaccttctgcccccatggtcatgttcccccatttcccagctttgcccccccattgcccccccagcccccgcnngtcccagtacatgccagctaacgatgggccccaggggtacccagactacccagaccanagcccataaagggcagcntttgggcaaaatatgtgctggncaataaatgggtcaaaaaatgagtaattttttgnctgccca

SEQ ID NO: 506414 - DNA, 938 bp, Homo sapiens
caaggtacgaggggggggcccgccccacaactttggggggaacgacgcaagtcggacagagccccaccgcgtggtgcgacgaacaagggggtgggccccacgcggggcaacacgaccaaccgacattggggagccaaccggggggagacgcaacactcaccaccgtggtgtgctgagggcgacacacccaccccgaggggggtttttctcctcagcagaagcgaggcgagaccaaccccctcacgtcggggcgtacacacgagggcagccgcccccacagggggtggtgacaagtgcatacacatccccggcgaccaggtgtgttgcccaccaccctccccaccggggggattagccgggccgcccccgcttggttttgttctcaccccgttgtagagcagccccaacatcgtgagaacagagaagtcatctttgtttgatagctgctctttctctctcgattactcgcacgaagcacgcggtgagtagttcgtcttttttctctctccacccccccctctttgtttggttgaagaacaacagtcacttcgcatagtgaactcctggtgggccgtctcgcgacgaatcttctcctcttcttccttacggaggagaaaatatgtttttcctggcgcccctccccgccccgcgctgggccgcccctccccagagagggcggggggtgtcttcttttgtctgacccccccctgatgcgccaccctggtgggcgggggccctcctctctcttttttttttctgctgggcgctcccttccctcccctgccgccgctcggggctgggagtcctgttttgttcatcgtctgtcggggagcaggttgctgtttgtgtcgcctgcgccgccccccccttgtggggggggttgtggggggcccccttaacacccccccccgtttttttttttcggggcccttttttta

SEQ ID NO: 506415 - DNA, 357 bp, Homo sapiens
  misc_feature (332)..(332): n is a, c, g, or t
tcatggcaccaatcacagtttcatagccacgtcccattcccctatgatttgggcctatggggggataggatattccagaccccaagtaaagtccatgccaccccaagacactttgtggtgcctgggacatcttagcacctcctttgacacctgggcattggacatatcataattccagtcacaactatactacaacctttattcataatcacactgatcagtgcctgatttgcactacccatccatatgtttttccttgtgggggaactaatattttctgtttattaccccaaaactccatgttttgtggacccggggtggcgggggacagnccttgggtttcacctcatgtattta

SEQ ID NO: 506416 - DNA, 856 bp, Homo sapiens
cagtcgtagctgctgccatcactatactactaagagagcagaaactcaacaccagcttcttcgaccgccgccggaggggggagatcccgattctataccaacacctagtctgatgtttgcggtccacctcgcttgaagtcttgtatgcgttatcctaccaggctttcggcatataatctcgccaatcatggtaacttatatactccggcaagataaatagacaccctatttggcataccataggtcatggctctgcagctagtgagtatcagattgggttctcctcagggtgtcttatcagtgtgatgcgagtagcactatatttgacagttaggaatagaccgtatgacaacacggtatgccactttttcagccttcccgagtagccataattcatcgctaggtccccaaccggtcgttcccacatgatatttatgctggattcgtccagaagtccagcggaaggcactctagtgaagcatggatcgtggctgcagtgcgtctgaaggcctagagaattcatcattttcttttccacgcgtagatgttgggccttgtagttgggctattcgttgttaggcaaaacttcatttcatcgtaggaaccattcgttactaccatgacactgtatcgtacgtttgtagacatcaacgttccacattatgtcctattcaattaggagcatgttatttgtgccagtcataaggaagcgctatcatttccagcgtggattatccccttatgctcagggcgtacgacccctaggacccaaacattacggcaccaaaaagttccatttcgcactaatcgatattcaatgcggcgtaaaatctaaagttgtcttccccaacaaaaa

SEQ ID NO: 506417 - DNA, 541 bp, Homo sapiens
atgttggtaggcacatcgtgtcaagtgaagtagtgttataggtatgggtttttctcccccttcaccaggtgggtggaataagttgattgtggccaatgtgtaatatttaaactgttctgtaaaataagtgtctggccattgtggtatgatttctgtgtgtgaaaggtcccaaaatcaaaatggtacatccataatcagccaccatttaacccttccttgttctaaaacaaaaaccaaagggcgctggttggtagggcaggtgggggagtatcttaatttctggaatttgggaagcagacagctttacttgtgtaaggttggaacagcagcactataccatgacattataaagccaaaaacctttactgtttctaacatttcctacgcatggctattgataagggaaggttaagttgagtattccacagaaagtggtaattatacgtcttactctcttcctccattagacaaattaggtaaataatgggagttcctaataatgggagcatacacacttattaaaagacacatagacatgatg

SEQ ID NO: 506418 - DNA, 624 bp, Homo sapiens
agcgggaggccaggacgtccccgtgacctcccccaaaatgctcgcagccccgccgtccccgggaccccccgggaacccagcggcccgctgtctccgggaccccacccagggcacccgtgcaggactacgtcgtccctgggacccctccagggcatcccagccagccagtgacagcacctggagaccccagcgcgtctacatcagccgcgagccatccgtcgccggagtaagacgactttccagggagaaacatcgcccaggcgcgaggccgggcctgccccggcccttcgctccggagtgtcctcgcgagaaacgccaactccacgacatccctagggccggcagaaacccgctctcaagacctgtggatgacccagacgccagaaaaacccgggtggccgtccactgaaagcccctaagccaaagggcatccagggaagacaccacttcaaccctataatacgaaccggggccaagcaacatgagcagcgaagagtagcacgccccagggctagacactccagatgaggccgggcaactcgaggccagcaacgggcacaagcaagcaggcacacaagaacaaagaagcgaggggtaccccccaaaggagcaaccaggtaaccg

SEQ ID NO: 506419 - DNA, 327 bp, Homo sapiens
cggcaggcatatgatctaagctgtatctgctttagggggactcaagcccagcaggactgtgtttcttgcagactcttaagaggtaccaccttgacggtcttggacaaaatccaagagttctctggattactagaaaaagactcttgttttcttcctgtactttctcccaaacaaatagaacctctttctctctctgctctgagccacttagagatggggatggactgacacaagtactcctatggccaccagctctaggacttcgctgggtcaaacctgaagccagcatagcactgggtttcacccaaggcctcacacacaatctta

SEQ ID NO: 506420 - DNA, 357 bp, Homo sapiens
cttatcaagaaacaatccaaatacccgtgctattgaacgaaatacacattctttgtttctataaactaagttctgcaactacaacatttttttgtgtaaatagtattatatcagtatggttctatacaatgagatttagggtgcattttgtaaaataattcgcctctccatacataacgtgcattttacaagtgaagcaaatgtcttggcctgacaaaccctgtgcgtgttgtacaattcagttttattacaaatcacaaatatagttaatccttagacctgcagacggttaaagagaatggctctagaagtcagtaaactctcatcagaattactttgcaggataatgtgatagcc

SEQ ID NO: 506421 - DNA, 164 bp, Homo sapiens
cccccccccccccctttggggtttaaaaaaaagggatttttttttggggcccctttcccgggccccccaatttgggttttaaacccccctggaaaagcttttcccccccttacccccggggggggggaaaaaaaagttttttttttttttttcctgggggccca

SEQ ID NO: 506422 - DNA, 986 bp, Homo sapiens
  misc_feature (27)..(27): n is a, c, g, or t
  misc_feature (77)..(77): n is a, c, g, or t
  misc_feature (103)..(103): n is a, c, g, or t
  misc_feature (120)..(120): n is a, c, g, or t
  misc_feature (135)..(135): n is a, c, g, or t
  misc_feature (195)..(195): n is a, c, g, or t
  misc_feature (199)..(199): n is a, c, g, or t
  misc_feature (220)..(220): n is a, c, g, or t
  misc_feature (555)..(556): n is a, c, g, or t
  misc_feature (670)..(670): n is a, c, g, or t
  misc_feature (672)..(672): n is a, c, g, or t
  misc_feature (834)..(834): n is a, c, g, or t
gtcaccctctgccttttctgctgcccntgcacccccctggctcgaagagaccccacccatcttgccctctgcgaggncactctatcagctctggggccttggngcctgttcgaccccttntacagccctggaccnacccgagaatagccagcagcgcagcagcctgggggctcgactctcccgtttcgagggggntttntgcaccaccccagcccgtggnagccccccggcgactccccattttcaatcgcatctctgtttctgagtgacaaagtgactgcccggtcagatcagctggatctcagcggggagccacgtctcttgcactgtggtctctgcatggaccccaggggctgtgggaacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacnncttccctgcccaaatctgtctcctagaatcttatgtgctgtgaataataggccttcactgcccctccagtttttatagacctgaggttccagtgtctcctggtaactggaaccncncctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttccctngtatttttcttcctttttttgtaatattgaaaacgacgatataattattataagtagactataatatatttagtaatatatattattaccttaaaagtctatttttgtgttttgggcatttttaaataaccattttgagtgtaaaaaaaaaa

SEQ ID NO: 506423 - DNA, 334 bp, Homo sapiens
ggatcgagctcggtacctcggaagtgttatcgtacttaagacagattggcaatgtaaagtagtaaagaaagtcttaaatgtgcttggtttgacaatgagagatgaaaaaattaaaattctccaattgagcaagggtatgcaaggatttgtatgtggtagttttatattttggttgaaagagtgagagcaaaataatttacggggttttaaagataagagctgaatgagcatgccactaatgggagaaaggggggtattttcacagaatcagtatttttccccatccggtctccacttgatgtcaatcaaaacataccatgggcggtgtagttac

SEQ ID NO: 506424 - DNA, 1017 bp, Homo sapiens
  misc_feature (27)..(27): n is a, c, g, or t
  misc_feature (77)..(77): n is a, c, g, or t
  misc_feature (103)..(103): n is a, c, g, or t
  misc_feature (120)..(120): n is a, c, g, or t
  misc_feature (135)..(135): n is a, c, g, or t
  misc_feature (195)..(195): n is a, c, g, or t
  misc_feature (199)..(199): n is a, c, g, or t
  misc_feature (220)..(220): n is a, c, g, or t
  misc_feature (555)..(556): n is a, c, g, or t
  misc_feature (669)..(669): n is a, c, g, or t
  misc_feature (701)..(701): n is a, c, g, or t
  misc_feature (703)..(703): n is a, c, g, or t
  misc_feature (865)..(865): n is a, c, g, or t
gtcaccctctgccttttctgctgcccntgcacccccctggctcgaagagaccccacccatcttgccctctgcgaggncactctatcagctctggggccttggngcctgttcgaccccttntacagccctggaccnacccgagaatagccagcagcgcagcagcctgggggctcgactctcccgtttcgagggggntttntgcaccaccccagcccgtggnagccccccggcgactccccattttcaatcgcatctctgtttctgagtgacaaagtgactgcccggtcagatcagctggatctcagcggggagccacgtctcttgcactgtggtctctgcatggaccccaggggctgtgggaacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacnncttccctgcccaaatctgtctcctagaatcttatgtgctgtgaataataggccttcactgcccctccagtttttatagacctgaggttccccccccaaaagggggtttggttncttccttgagtgtctcctggtaactggaaccncncctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttccctngtatttttcttcctttttttgtaatattgaaaacgacgatataattattataagtagactataatatatttagtaatatatattattaccttaaaagtctatttttgtgttttgggcatttttaaataaccattttgagtgtaaaaaaaaaa

SEQ ID NO: 506425 - DNA, 345 bp, Homo sapiens
tgcccaagccagtggtcgtatagggatgtggccaaacaatgacctaccgcagtgtgattatcagtgtctgtgaagaataacgcgcacggtttcgcctttacaataattcacatcaacggtatctgggagaacctggagctggcctcacattggcgtagaaagcagggacaggtgccacccacggggccctcgtgtggggacgggtgcctgagggcctgagcccctcgagcctctggatcactggatgagctgactgtgtgctgttgtctcgtctgtcccaccccgagaagggagtagaacaatgtgagttgtctgtggcgttggaaagtgcagtggttacatggg

SEQ ID NO: 506426 - DNA, 590 bp, Homo sapiens
ctcagccttctgagtagttgggactacaggcgtgagccaccatgctggctagtttttctatctgaaagcgtagattttaactcttattctgagcgtccacttaatctcccatgtactacttgtgtttttttaagtaatacagtaaattacttaaatttactctttgtaaattcaacaagcttgaatttctaaatccattaaggtggcttgatgattcactgtggtactgtggtgggaactctgctgtgcactggttgtagtgtgatccctgctcttaataagttgctattctttaatagaattaagccctgcatccaaaaaacaaaatctattactaaacaaatagatagtatcccacagtggtgaatttattgagacgttagagggagagataatttgggagccattggtatgtgttttaggacgtgaatttcataatgataatattcacacctgattaccatccaagtaacctgccccatgaagcagttctagcaattccagtcagtatttatgctttctgactgttaacggatcatttgagaaacagaagatgttccactggtgttgctatgaaaaggcttcgtgaa

SEQ ID NO: 506427 - DNA, 114 bp, Homo sapiens
atgtgcttgggccatttcacatataaggtttggtcactggtccaggaaacaggtaccagggttgagacgaataatgtatacgtgctcttaatagcacatcctggtacaatatct

SEQ ID NO: 506428 - DNA, 621 bp, Homo sapiens
ggtggagtgtttttgtttagggtggagctatgttttgttgggggttggttgggtgtttcgggggtggttgggggttgtgttgtgaggtgggggggggggtggtgggtgtgtggagtgagaggtgtggtgggtatggtttggatggaggtgttgattgttgtgggctttgggtttttgggttggatgttttgtggggtggggggttttgttgtgtttttgtatggtgggattgtggaggggcgttttgttttttttttggaagtgtgggttttttttggtatgtgaggtgtgggtgttttggggggggagatgtttgttgggtttgttagagataggttggggttgtgagattggttgggggcgaattgtttgttttgttgagcaagtggtgggggggtttttgaggggtgtgggggagtgtttttggagggtggggtttgttttttttggggagagtttttggttgttggagggagcggtggtttttgtttggtgaggtggggtgtttgttgttttttgggatatagaggggaattaaagaatataaaaaaataaaaagggggtgtgggggggatatatataaaaaaaagaaaagaaaaaggaaaaaataaattaacatgt

SEQ ID NO: 506429 - DNA, 308 bp, Homo sapiens
cggccgccggctgatcaacaagccaagcaccaaggatgagctccacgcttcgccttcctcttcattcggcgaaagcgtgaaccgccgtagctaaacacactggaaatgacatgacactcgcaatcatctggacctcgatcttcttggctggcgccttggcatgtgcaacagcaacttggtctgcctctgaggcctggcccgactccctggatgcgtcgttttccggtgcccgttttccttcggcggtcaaagccttcctggccgcattggtcttgtgcttcctggccttcaagtcctcctctgactac

SEQ ID NO: 506430 - DNA, 1283 bp, Homo sapiens
atttagtagatctttctatacctacgtcgttgacatatacttagactttattgttatggtttatctcattcggaatgcggcttcctgataggttgtatcgtccaaacttatctcttcctattgttatatactgggggagggatgttcctattttagaaggttatatggctaagtgtcgcgagatgcgatagtgccgatatttcgagatactaatattttcctgttccagaggtgtgtttattataaaatccatgcttgctcctgttgctgtgatttcattccccctaagttaatttgaacttaagcagataatgatacttttgactagtgccacttcggtatctaattaggagagatggactagcagaagacgtgcactatttcgccacgctttgctggcctcttgtccagatgattgacatccaaggcccgtgacaaattgcttgttcatggaggaaggataaaggtttctccattatctaaacgtgcgtgtatgggaacaagaactattcattcgcggtaatcttttttaattagttccagtcgtattcgatactggaacctggaattaggccaggatactatatctcaagtgtcagtcgtttacttatgcttagtatagcacggactagaaccttacatctaggggtgtactccctctgtcaaatgtctacttaggttattgttcaattaaatggtgtttttacggttaatgtgtcatgagagcccggataaggaagtctcttaatgttaagtctgtacttaaagtatgtgttctgcacgtggacgtctcaactgtaaattttcagccactgcaataaataacaacgatagtaagcaacactagaagcggatagatgactatggattgtggaagagctagacaacatgtaacagtgttgtgggcagacacaaggaactatactagtaaatcacgctcaattatgttaccttttgtggcttacgttctattgtagatctattatgctatcagcttgacaactctttttctagttaagtgtacctaatttatggaactgggtgctactcctgtcttatgtgtgtcttggttttgtccttggctacacgaaaaatctgttcgcagggcaacactatgtcttgataatttagatttactctccaatgagactcaatggctgggccgtggtagactcatagttcctcttgttctttattaaattcatcctgctaattagactttctagtgacattgtaacatgtagtttacactgaattgcaattatacatgcagagaactacta

SEQ ID NO: 506431 - DNA, 189 bp, Homo sapiens
tctagcaggatccccggtgatcctgtacagcaatggccaggccgtcagcgccagctccccgcggtccagatcctgaattcggcttgctctccatcttctgctctctccaggccatgctcccagctcgtaccttgtgagctcccccttcccctacgggctccacggtgacctgaacggggctcctaggca

SEQ ID NO: 506432 - DNA, 385 bp, Homo sapiens
agccaggatcagaaagcgtaaataaagcaggtgtccgcttttagcaggaagtcatttaggtcaagttactctatctcaattaacaaaaactagagtggcttggccgggtgcagtggctcatgcctgtaatctcagcactttgggaagctgaggcccgtagatcacctgaggtcaggagtttgaggccagcctggccaacatggtgaaaccccatctctactaaaaatacaaaaaattagccttgagagatgtattggctaaattcaaggattccccactttgtgcttttaattccactcgctgatagtctcagcttgaagtcaagcctctttgaaaaataggcttttttttttaagtgaaaggcactttattttgagtaatatac

SEQ ID NO: 506433 - DNA, 130 bp, Homo sapiens
actcggcttaactccaggtagggtgagcagcgcttctccactgtgatccgtttatggggttcaggttcacatccggtccagcaggtcaagggcctggagtctgactggggaaaagcttggcccaagccac

SEQ ID NO: 506434 - DNA, 286 bp, Homo sapiens
ctgcgaacgcctggcgtgtgtctccctacccccacatatcctcatcactccgtaaccctgcacatcctgcgtcactccctacccccacatatacctcatcacctccgtacccgccgcaacactcgtgcgtcacctccctacccccacatatacctcatcacctccgtacacccgcacacaactgcgtcagctccctacccccgcacacagctgcgtcaccatccgtacccccgaacacacctccgtcacctccgtacccccgcaggagtcgaccttgatcatcaga

SEQ ID NO: 506435 - DNA, 396 bp, Homo sapiens
ctaggctcaaggggtcaagtactaccagcgctgcaccctagcgattcggtgtagaatagtgtctgccatttaccgggcctgcatgcacctctaggactgtctctcgatgtaacaggattcaccctggtgaggtcatccagtttgtacagcaggacctccccacccaggaactcctgcaggtcttctctgaggtactccctggcttggccatcagaccccggattgtggccattgacctgctggagcatcctccttcaaagtggtcagccagggttctgggttgcaggaggtacaaggagtactatccacctagtcatgggaccatgggctggggtatggttccaacaaagggctcagttctggaggaatctcagacaagtccatggtccgagcgga

SEQ ID NO: 506436 - DNA, 777 bp, Homo sapiens
tgcacgggtgctgctggctgtggaggagctgggctctgcctccctgtgcatggcgcgtccctctcgggctctggcctgtgtgagtgtggctgagttgcttgtctccggaaatgtaccaatctgtgccgtccttgggggtatatgtcctcggggggtatacggctctgtgtcctgctccgacatcagggccccaggagctgccagcaggtaccagcctgccctgccacacgagtgtgcctgcatggactgtccggcggatgcccagggtaggagacgacacggacatcgtggaacggaccggaggaaggtatgtgcagttgcatccttttcagcagacgccctgagaactgggaggtcaagagtaggaacaaacggtcagatctggtgcttggagctttctcatgcaggtgttaatggggctggggtcagcctaggggtgtgatcttgaatccactggaagccttgctggggtctggctctctcttggtgcgtgggcgggtgtgacgggagccctgcatcaatagcagcactgggggggcctcctatggatactcatcctctgcacgtcacgcgtgggtgcatgctctgaggaccatggagaccatccctgccgcagacccgggccatgctctgaggaccaggagaccatccctgcagcagcctgggcctatgctctgaggatgtgggactgaggacccccattgtctctgagtgtagggtggtgacttctttgcacagactggccagggtcccccaggggccagtacaggtatcccg

SEQ ID NO: 506437 - DNA, 130 bp, Homo sapiens
aagaacagtgaaacgatcaaagaacttttcttataaccctgcaatcagcatactcagccaggaaaacaaaacaataaccttaactgccatatagagagaagactgtgttcgggggagctggcatagacta

SEQ ID NO: 506438 - DNA, 324 bp, Homo sapiens
ggtactctagaggaccctccatatgtgtgccagtgtgatgacatggcggcagcagcagagtataaagagcatgcatcaacaggcctcatgctgcagcagcatgggtatactgaggtagaagtagcataggatgttttcagctatgtattgaggacccaggaacaggaaaagatgcagaagacaaattgccaccaaattaatgtgaattcgtgatcgctgctctgaataataaggagattaaactccatgaagcactttactcaaatgccaaagtccctcaaattataggtatagaaaggtgcgagttggaaaggaccgtggaaa

SEQ ID NO: 506439 - DNA, 396 bp, Homo sapiens
tccggcaagttcgtggtgctgatcctgctggtgctgcaactggtcgcttcaggaggcacattcccctggcagaccacgccggaaccgctgcacgcgctgcatcagatccagcccatggggcacgtcgtcgacggcatgcggatcctgatctacggtgcggatctgagccggatcgtgccgattatcctgggcttggtgggctacaccctgttcggcttgctgctttcctacctggcggcacggaaacacaagttctggaccctgaagacgctgcagccggagatcgcggtatgagcggggaggccaacaccatgaagcgcccggaacggaccatgatcacccggcaaaagctgttcgaggcttccatgcagctgatcggcgagcgcggccccgccg

SEQ ID NO: 506440 - DNA, 230 bp, Homo sapiens
attgactgaatctttcagctggttttattttattgggtttaggttttaaagaaaactggcccccaaattcagtggcacttagtacaagtggcttcatttgggttcggtcgggtctgctggggctccaggcatgtgccactgtaccaagcagaaatttcttttttcacagttctggaactgggaagtccaagatcagggctcctgcccttggacctgaacctggatcttgg

SEQ ID NO: 506441 - DNA, 1373 bp, Homo sapiens
tccatcaaaatagttcattggtgtcaaaaaaatcccagtttgaggaacccttaaacaataagtcacacaagaagaaatgccccagtggggctttccatagcagagaacagcacctcctgttatgtttctatcccagaaggcactgctagtggtgataactaacatactgataggaacatagaggatacctcgtatcccgaggacacggcacactcaagcacagcggaaacgacacccacacaagcgtaacagcacgatcagcgggacaacacacacgcagagacggcattcaccacacaagcatgggaggccgcccctaccccgcggccagccccaaaccagccagcaaaacaatcacaacacaccagacacacaccaagagcacaggcacaccccacaacaccacaccacaaccacagcaacacaacaccaacaacacagaacaaagacagcagccagcagagagagcgccgtaggccgacgacagcacaagcgagcagacgacaacacacgagaacagacacgaagagagcgacgtacacgagcgacggtagacaccaaccaagcacggacacaaaggaagagaggagccggacggcacaagaagagacagacaggagacgcgcgcacgggcacaggcgcgcgccagcccggggcgacagacaacgacaaaggagaggcagaaacccgaaaacacacgaaagaaaccagaagacaaacggagaaaccaacaccagcagaagcaaaaaacaaaacaaacaaagagagaagcgaagagaccacaaagaagaaacgaaacaaaaatcaacagaacggtgggcaccaaaagaaaagaaaggcacgaacacgaacgacgcacaaaggacagcgacaacagagacaaaaacacaaaagacgagaagtaagacaaccaggccacgggcccaccatgaacgcgcgcgaccaacgagcgaccgccgcaacagacgcggaaggccgggggggagccgcaccaaccagccacagtcaagcacaggcgacagggccgaacagagccaaggcagactcaccgcacacagagcaacgcggcaacagcacctgagacgcacgaacagccaacaccgacaacaccacgaccggacgcacggcgagcgaggcggtcggcggagcaggccagacggacgggaagcagggagggacggacggccgcgcgccccgcgcggcgcggcggacggcgaggacgggctcgaccgcccgcacacagagcgcggcagactacgagagagcggcgcagacgggcgagccgacagagcagcggccgaaagcgtcaaggaagcacccgcccgaccgcgagcagacagaggacgcgccgacaggaccgagacaggccggcg

SEQ ID NO: 506442 - DNA, 303 bp, Homo sapiens
acgctactgttattatactccctcactatccatgtgtgaaatctaagtatttggtattccttcagtacttaagacttatcaaagactagtactttcaggaagccttaatttttttttttttcgcctctttcattttctctgttttagctccacattaattacctagctttagctgaagaagcacttatgtttgtccccatccctcctgtggactgactcttcaggcttcagaagcagcttctgcgacttgccaaacatcatacaggttcttttaaaatgtgtttatcacgtaggtccttgctc

SEQ ID NO: 506443 - DNA, 884 bp, Homo sapiens
aaagccatcttggcattgttcctcatccgcctccttgcgcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaacctggggacgcaggaggctgacaatgaggtagacgaagacacgagcgaacgaaacggtggggacggaacgcacggacgcgacggccacgaaccgacacgggtgactggtgacggaacgacggactgcgaccactgacacgactgacggaagctgagtcagctacgggcaagcgggcagctgaagatgatgaggatgacgatgtcgataccaagaagcagaagaccgacgaggatgactagacagcaaaacaaggaaacagttaaactaaaaaaaaaaaggccgccttgacctattcaccctccacttcccgtctcagaatctaaacgtggtcaccttcgagtagacgaggcctgccgcccaccgtgggcagtgccacccgcagatgacacgcgctctccaacagccaaaccaaaccatgacgaaattgcaacacgggggagcgacaaaacgaaccaagaatttccaagggtccctgcctgtttttctttaaaagtactttaacaaggaaatttggccgggaattgtattgaacatttacatatttcgtaccatcttggtaaggtcagccattttaactgatccggattaccaag

SEQ ID NO: 506444 - DNA, 365 bp, Homo sapiens
aatcatatgaaatgagctggtcttgaatgacgctgatgcctgcggaatgactgctggattcaccagtagaacatggacaaagaagcctgctcctcagaactacatgggatccctgttcctcataacctagacagacctggtcctcctcactgggtcctcatcctgatcacagggccctggtcctagaccaatgggaccgtaaaccgatcactgagctctggtcctactactatgatccctgtacctgatcactataattctacccttgatcacttgagccttagtcctgatcactgagtcctactcctagtaaatggccctggacctcatcactcagccctgatcctcatcactcagacccggta

SEQ ID NO: 506445 - DNA, 304 bp, Homo sapiens
gggatgtcacgcacggtcacgtgcatcgcgcaggatgatggactcgctgttgtggtccaggcacgaggtgacacactccgaccctatggcatagccatcagggcactggagtttgaggttgctgttgagctcgtgtggaaccgagcactggccttgcatctcctggcagacatggatggagccgttccaggtgccatctttccggcatggaatgacattgctcccaagtccctgggaggcatcatggtcttcacacttgatcctacaatcactgccacttggatgatgggcatggggtaccgag

SEQ ID NO: 506446 - DNA, 457 bp, Homo sapiens
acgggcacagagaattttatttctatactaattactacatagaactaacgtctaagatcaaactaaaaatgccttcctctactttgaaacaatagtcttctctcataaacattttattcaaatatttcccagcgacaggctcgtgtgcacttaaccaggaagtgagaccggatatgatcatattgtgaaagcagagtataatgaaagaacacaattggaattatctgaagcattattaaaatttcatctgacaatccaattcccttggaaacgacaatttaatcacggaagtaatataaggaatttcaaaagcataattcttcattttcttgtgtggcagtgtccccagtcttctatgcgcatatcttttcctgtagccaggctggctcatctgaaacacaagctttcaccaacccgcctagtgtataccgggagcagggttcagccatcattttca

SEQ ID NO: 506447 - DNA, 685 bp, Homo sapiens
  misc_feature (397)..(397): n is a, c, g, or t
  misc_feature (509)..(509): n is a, c, g, or t
agcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgngtgacagagcgaaactccgtctcaaaaaaaaaaaaattaacttggcgtggtggtgggcgcctgtaatcccagctactcaggaggctgaggcaggagaatcactagaagctgngaggcagaggttgcagtgagctgagattgtgccagtgccctcctgggcaacaagagtgaaactttgtttcaccataatataaattaagtgttctttaatatgttgttgaatgaataaattggttcagtcaccaatttattggattaaggatgggtttatcaatataggtccctacc

SEQ ID NO: 506448 - DNA, 121 bp, Homo sapiens
ggtgccatctcgacggctccccccgatgtctgcgacaggtgcatgtgccctcaactgctcctctgtgcctaggccttacgcatttgctgactgactccgcccccatgcttctggggccact

SEQ ID NO: 506449 - DNA, 124 bp, Homo sapiens
catattctgtagacgtctctgtgaacttgcgcattctaggacatttcatataatggcatcatataacatgtggccttttgaaacatgatactattcactatgcctaacaattttaagttacatt

SEQ ID NO: 506450 - DNA, 145 bp, Homo sapiens
gcccaatcgagccgtctcagtcatgattcgacgcctgccctgtctatgctctggacgcagaggagctcgacggaggatcattctgatatcgctaagcgtcatgatgccagacttctcgtcaatgatctctgcagagtgtgatctc

SEQ ID NO: 506451 - DNA, 123 bp, Homo sapiens
cttaagagttcagctttgtacttcccctatctttgctctccctccccatcactacacatctcataatgcttggcttatggtaagacagttaagtactcagtaaataatgaatgaatgaatatg

SEQ ID NO: 506452 - DNA, 549 bp, Homo sapiens
gcacgaggagaccaccattttagggactgtcaaactcactactgtgttcctttgtcctgaacaacgttgagtttctttcacagtatcttaacttactgaggaaaactcctcatgcttataagtgtgcagggcctgttcctaaacttgcttgggggggacacactaataactggattacctgactgacaaacgtggaaggctaactcgtggatagtgtttacaaaagtacaaaagcactacttgcaaggaaaatgctctgattctctgatgaggcatttgtgaaggattccagagcctttcccaaagtgagaccatttctggggtatttgtaccaggtcagggtttttgtgttgtgttcaaataagtttgactaaaactaggatggctgacagcttttgaatacctgctttaatgtttataaaatttttattgaggtataattaacatattagtaaaatgcacagaggttaaataattttacctgctttaattgtgaaacagattttattgccaatcagaatttgaaagcatgtgtttaacacatggata

SEQ ID NO: 506453 - DNA, 213 bp, Homo sapiens
ttcgcacctgtaaggttcccacaccgtgatcccaagatagatgttcacattttagagtgttctttcgtgggacggacgtggctacgctagaggacgtgaactcaggacccagcttttggactaacgacacttagcttgattgacgcctagactttaggggactagtcggtttacattctgttaggacgtgttaatgacagggtccaaatttca

SEQ ID NO: 506454 - DNA, 246 bp, Homo sapiens
ccctaatcgccaagcccttggtgtacctgatcccaggcacaccgggctgaaacgggatttgagactattcaagcatcaatcggctgcgcgcattgggctgttgctccaggctgcagcgttaattgcctggcggttcctgggctcggaaaaccgtcttcacaaaacagcggcaacagttcaccgcgtaccaggtattcacgggccaaccaggtcggcaggtgagcgatgcccgcgattagggatagt

SEQ ID NO: 506455 - DNA, 458 bp, Homo sapiens
  misc_feature (5)..(5): n is a, c, g, or t
  misc_feature (14)..(14): n is a, c, g, or t
  misc_feature (54)..(54): n is a, c, g, or t
  misc_feature (181)..(181): n is a, c, g, or t
  misc_feature (183)..(183): n is a, c, g, or t
tatgnaatttaaanactccacccctcctatgtggttttaataaacacattaatnatttaatgaatatcacatccccattgtcctggatgtacccacagtttatcattcacttactgaaggatattgagtttgccattgagtttttggtgattaagaataaagcttctggcctggccgcggntntcacgcctgtaatcccagtgctttgggaggccaaggcaggcagatcacctgaggtcaggagttcaacaccagcctgacaaacatggagaaagcctgtctgttataaaaatacagaattagccgggcgtggtggtgcatgcctgtaatcccagctacttgggaggctgaggcaggagaatcgcttgaacccgggaggtggaggttgccgtgagccaaagtcatgttgttgcactccagcctgggcaacaagagagaaactctgtcttaaaaaaaaa

SEQ ID NO: 506456 - DNA, 352 bp, Homo sapiens
accggctgcagtctgcattcttcctgacactctgcgctgtggggattgcgagctagcactgtggtagaagagactgtttaagaggaaccatcacaatctgagctctaagcacggtctaaagggctcgtctcgctaaaagtgcctcagctttcttaagatagaatgcacgagagtgttctgaactccccaggaacgtatgagctggggacccttgagaaacagccgcttctagtagagggaggagggagtgcgcgggcagacaatggcaggtctgtgtctggtatcccgggaagctcctgggatggctagagtgcccccctccccttctcctccccaccacaaggtcccagag

SEQ ID NO: 506457 - DNA, 131 bp, Homo sapiens
agatctccatcctatccattgggccagtccgtcctccatcgcgtcgccatccatctcctccgacgcgctccctccattctcctccatccttctccatcctcgcgctcccaggatgtcggagggggatcctc

SEQ ID NO: 506458 - DNA, 416 bp, Homo sapiens
  misc_feature (4)..(5): n is a, c, g, or t
  misc_feature (128)..(128): n is a, c, g, or t
cccnncccccccccccttgttgtgggggggccccctcttctccctcctctcccccggggggggggggggccctttttttttgtaatattttggggggcccaattttttttttttggcccccccccgantttttttttttttttttttttgggggggggggggggggccccccccccccctttttttttccccccccttatggtggggggggggtttttttttccccggggggggggggggggcccgggggtttttttttccttttttttgtccccctttttttttggggggcccccccttctccataaaaaacattagaagaaccagataacataaaatataagcgataaaggaatggaatagaacacccccataagatggtttcaagaaaacaacatggcatccataaaatattc

SEQ ID NO: 506459 - DNA, 290 bp, Homo sapiens
  misc_feature (50)..(50): n is a, c, g, or t
  misc_feature (72)..(72): n is a, c, g, or t
  misc_feature (93)..(93): n is a, c, g, or t
  misc_feature (98)..(98): n is a, c, g, or t
  misc_feature (119)..(119): n is a, c, g, or t
  misc_feature (132)..(132): n is a, c, g, or t
  misc_feature (185)..(186): n is a, c, g, or t
  misc_feature (196)..(197): n is a, c, g, or t
  misc_feature (200)..(200): n is a, c, g, or t
ggagactgtgtggttagtggcctcaggatgtgatagaaacatccagtgtnaaaagaagtgaatggagtgcgncaggaacgaggggaagattgngctgncacagaaggcctggccgttgntgcactaacttgnagctcagggcatctagagggactgggagggagctaacttggctggctgcttgnncttgcatagnntgnaaagggctaccctggggctctgaccacactgtagtatgtgtggagggtgccctcccgtctcccacaacttctgctataacaataaactgt

SEQ ID NO: 506460 - DNA, 146 bp, Homo sapiens
gctatgaatgtatttgcttctaaaacctcccaaagtgaatttaattttaaaactacaagttgtaagtattttgaaattgggaaacatttattttaaaagcaatcaggtagtgttgctttttacagcataataaatatatgtttcca

SEQ ID NO: 506461 - DNA, 86 bp, Homo sapiens
  misc_feature (32)..(32): n is a, c, g, or t
  misc_feature (38)..(38): n is a, c, g, or t
gggctgcaggaattcggcacgaggaactttgncaaatncttccttcaccaatctcatgaggagagggaacatgctgagcaaactga

SEQ ID NO: 506462 - DNA, 1497 bp, Homo sapiens
  misc_feature (205)..(205): n is a, c, g, or t
caaaaatgtggggttgggaacgacaccccagtagtgtttcgtagagagaggagaaagagaattatggggggaatatagaaaaataggtgggaagaagagggcgcacaaccccgtggccctataaaaaagggttgccgccaagtatatttaaagagaggaaagaataagtagtggggggagaaaagggaacccgccccttgtctgnggtgtcctacaccacccgacgggggagatctccccccaacacggggggtgcaccacccgccacgagagaagtgtggggccgaattactcgtccgcaataaggtgttgttccatcaccacaagaaggtgttttccgcctgaggttgggttttttggaaaaaagagtgggtaaggagtttctctccttgcgcctgtcgaagatgtttttggccccacccgcaggaaattggtaggtggtagaagagatgttgcaccacgtcttgttatgaggagaaagaaattgttctcacagcaggcctgcggagatgtttatctcctcgtaggaaggaaaatggggttgtctcaccgccgcggtattaaaaaagaatcaccgtcggccctcctcggagactcatagaaccttgttccccacctcgggccaccatcgggagatttctttattaccccccgcgtggagcccccacacaaattgtgtgggtgtccccacacgtgggtccacacaaaaaaagttgtgcgcaccagaacccacacatgagagtttgagatagcgctcccaccgcgtgtagagatggtctcacagaagactcatcccgcacgtggggtgtacacacgtgtgcgtctgcgcgtcctcgtgtgttctgtgtgtgttgtgggtgttttatacctataaataacacggccccaccacacatacacgcagatatccgcgcaaagacaccctctcttattatgtgcgctcacagacacacccacacacagggtctcgccccacacatatctccgctgagaagaagaagagagtgagtagtgtgagaattatccacagtgagcacctctcgcagcagagaggggtgtcacagcaccacacatagtgagacacttgagaaaggagatagaggtgttccacacatataaatgtggagatgttccacagcagccacgccacattgtggagataaagagcacacatatagagaaaagaggctctgtccacacttctatgtttaatcctctctctccacatcgagatgttctttcgcttatagagaaaagtataaaaatggctcgagaagaagccccacagtttgagaattgggagaagctcactggaggctttactggtgaaaggccacgctagtttctggagaaagccccctcggggaacgcaagacaccggtgctataaagttgaaccgcagactgatggataatgtgaccccccgtcccacgaaatctgtttttaagattccagaccttcccaatagtggcccaataaaaagtgctatttggtgat

SEQ ID NO: 506463 - DNA, 889 bp, Homo sapiens
caatggttgcttaacgactgccaaacaaccgcctgggcccaacagccggatacaccccccatcaacgagaacgggcaacaccacacgggaaaaaacgccgtggagtggccaaagcagaggactcttaggcccatcgagacagtcttggccactcaaaacggggacaagaccccccaccttgggagcgctagcggcctcgccccgggagtaggctaactccgggcattagaattgcagcaggcccccccacacgtgtttagatcactacacgggtatgcatctcgcgatatagaacagcaagtgcaacccccccttttttcccccttaaaaaccctgtccgaaagaagtcctaacaaccactggagctattttcatcaccattcttcaaatactacaacactttccgtccacaattatcccccatgaattaccaattttggggcaccaccaaccacattcagcgagctctctctcttaagaggaagtcccccaccctcacgtgaggaacaagacagtcccgacgatttatacacagccgctgtggacacaatcgcccacccccaaaaatactttcttgtaatatgtggcctgcacccatcatgaccattcgtacacataactcattactcgtttcctccccgcaaccctgtctcttctcaccacaaagaaggttgatttgtataatatcttcttgtgtgtccggacaaactatgtcttccaatagaaggagaatattctccaccccacttggtatttgttttttaaccgtactctccccgccccgtttgtccacagaaaacacccccttctcctccccgttctttctaaattccgtcgagaccaacccagaaaatttgcaaattttttaaaaaaacccccggaaacagac

SEQ ID NO: 506464 - DNA, 727 bp, Homo sapiens
  misc_feature (62)..(62): n is a, c, g, or t
  misc_feature (70)..(70): n is a, c, g, or t
  misc_feature (76)..(76): n is a, c, g, or t
  misc_feature (94)..(94): n is a, c, g, or t
  misc_feature (98)..(98): n is a, c, g, or t
  misc_feature (100)..(100): n is a, c, g, or t
  misc_feature (120)..(120): n is a, c, g, or t
  misc_feature (124)..(124): n is a, c, g, or t
  misc_feature (130)..(130): n is a, c, g, or t
  misc_feature (139)..(139): n is a, c, g, or t
  misc_feature (169)..(169): n is a, c, g, or t
  misc_feature (176)..(176): n is a, c, g, or t
  misc_feature (185)..(185): n is a, c, g, or t
  misc_feature (194)..(194): n is a, c, g, or t
  misc_feature (200)..(202): n is a, c, g, or t
  misc_feature (204)..(206): n is a, c, g, or t
  misc_feature (211)..(211): n is a, c, g, or t
  misc_feature (214)..(214): n is a, c, g, or t
  misc_feature (218)..(218): n is a, c, g, or t
  misc_feature (223)..(223): n is a, c, g, or t
  misc_feature (225)..(225): n is a, c, g, or t
  misc_feature (232)..(232): n is a, c, g, or t
  misc_feature (239)..(240): n is a, c, g, or t
  misc_feature (257)..(258): n is a, c, g, or t
  misc_feature (261)..(262): n is a, c, g, or t
  misc_feature (276)..(277): n is a, c, g, or t
gtctgtgccaaccaaacgatagccccatccaagccagctgagaacctaggaaggagtagtangaatatgnttgatnagattggatctcccaagnttantngaaaggagatgaacgaaaancttnctgctntctgtccgntaaagagctcctcatctgatcttgcagctngaccctntgagacttnagagctgcntcccannncnnnaagcnagngctnattgngntaggacnatattcnnagcccctaagctctgtnnatnntgcataagaagcannaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaagtctcttttttgtaatttgtttttgcaaatcattgtgaggccactttttctttctttctttctttctttctttctttctttctttctttcgttctttcgttctttcgttctttcgttctttcgttctttcgttctttctttcttccttccttctctttcttcttttgctttccttctttcatctctttttgtaatttgttgttgcaaatcattgtgaggccacttttctttccccttccttccttcctttttttctgttttttttttttttcccagagtcttgctc

SEQ ID NO: 506465 - DNA, 256 bp, Homo sapiens
agaaacttagctctttcataagcatgggaagctttgttttctgaaaccatcaagaccagcctggccaacacggtgaaacccttgtctactaaaaatacaaaaattagccgggcatggtggcaggtgcctgtgatccaagctactgaagaggctgaggcgggagaattgcttgaacctgggaagtggaggttgcagtgagccaacatcacaccactgcactccatccagcctggatgacagagcaagactctgtctc

SEQ ID NO: 506466 - DNA, 757 bp, Homo sapiens
gccccctctcacgccaccccggccccaacgggctgcaggtgctgctgatgcgctgggatctggattgagtgataaaaaggaatggagagatgacccctaccccctcatcccccagttttgaaaaggtctaatcaagtgagtctggtgtgaggatgctgagggagggagccatggaaggtgccagaaggaaggttgcgagggggcacgttgttgtggccggtggctttgaagctggtccagaagtggctgtgagctgccgcggctgcgcatgccccttgcgcccagatgtgatgcagtggtaagttgttgtgtgatgtccatgtgatatgcgtgtccgtcatgtctgtctagtgtctgggtttggcccaagactgggctgtagttacattaatgcccagcagacaagcccatgccactcagccctcctggaccaggccttgcttgactctctgagctggggaggtgggaggccagtgagagctctgacatctgtaagatctaaccggtgcctgggccccctcccctcagagcccatgggtaacgaaccacatagacaggagagaacgggcgtcagggtgtgccacagatccacaaatgaagaacaaggtttcgtggaagacacggacggacactcaagcatctgtgcccaggaggggaaccaatgaaggctggactttgctagcgctcagatgactgagacccttcctgtttcttgtgactgatttgttgctgggaaaaagaggggactgatgaaata

SEQ ID NO: 506467 - DNA, 115 bp, Homo sapiens
ttttctaagcactcacacagaactaactaatactaacatctcagacgctcagtgatgattagaagccgtctgagcatactcctgcccgccactcatccttgtcctcatacgccct

SEQ ID NO: 506468 - DNA, 130 bp, Homo sapiens
gatgtgatctagaggatcccagtccgggtccccactccttattgctggtgagatggccctatctgtgctcttctgtctgcagtgtgcacgggcttgtctaaccgggaataaaggtgatggatggtatggc

SEQ ID NO: 506469 - DNA, 483 bp, Homo sapiens
tatgttaaaaaactatatagtatctgttttcctaatcatgttccttaatagatgaacattttaaagattttagaattaataagagattctcctcccttttcaatgatgtcaatatcctaggcaacatgttatagcattttaaattacattatgagataatttttctttagattcatgtaacttaggaattgccacacatataaacataagtaagaaacaaataagagtaattttcagcagagggttatataacttttttagatctgctgtcatcctgatcttgaaaattaagatggcccctagaatgcctgaaatatagaaaggtatatttggtttggaaagaagggacatgataaacagaggaacttatttaacaagtatctattatctattgatttagatgctattcgtacattcattgttcattaactgtattgttatcacattgctgtaaaggactgcccaagactgggttattttcga

SEQ ID NO: 506470 - DNA, 420 bp, Homo sapiens
gcgcagttgtcggcttgtagagctcgcgagagagccctgtgaccagaacttgggaccttttcgcgtttgtgctccgcgtagagctcctcctcggcgggagcgcctctgcgacagcgcccgggccggagcccccagagcacaggccgcgtttgaaggatgacctctaggaagaaagtgttgctgaagggtatcaatctgggagaatctggagtcgggaagacattacttatgaaccaggatgtgaataagaaattcagcaatcagtacaaaggcacaataggagctgactttctgaccaaggaggtgaaggtggatgacaggctagtcacagatctgacgtaatccttcagaccttggccgtgggctccttgtggtctgtctgtgcacccacatgagcccgcgagtatggcagcaggaccg

SEQ ID NO: 506471 - DNA, 1839 bp, Homo sapiens
  misc_feature (520)..(520): n is a, c, g, or t
  misc_feature (1367)..(1367): n is a, c, g, or t
  misc_feature (1837)..(1838): n is a, c, g, or t
atcacgttgtgagtccaggtgcgcgaagctgaggtaaccagtgtcctgatacggtgcttgcgtacgggggactctttgcctagatgacctcagatgctgtgagagtgtcatcatgcacattaaaagagacgcgcgcggttcggcaccctgcgacgacgattctgagagcaagactcgcgagactgagatgtcgcggagtgctcagtggactcggactctacacaaagcatgatgagatcctacagcgcagcctcgcatatccaggattgacggcacgcgcgaactcgatgactcccacttcaaagggttagaaccaacccttgcacacataaagcagacaccattcggcacaggaacaacggctttgatgtcgtggctgatctctttccggaaagaacaggttaccagaggagcagtcatgttcgagagaagacatgattgtttaccaaattcccagtgactggagaaatctcggattcacaagccaaaaaggaggaatgttccgcacagacaggagttnacaagacagataatcagagataagaggcataactacaaacagagaacaaaaacagggcccggacaggaacaagggcgctagttgagagaggaggagaagcgccacaaagaggggaaagtacgcgccacaagataggagacaaacacagggagcagacagcagtcgatagagtctaggcgagcaacggggagaccaccgagacgcgaacagccgttaagagcagagaggcagcgccacaaaaactgtagtgcgacgggacagacacaaagaagagcgacagcggacacccacccaccgaggaggaacaaccatcaacagccacacacacaaagacatagtccaccagcgaccacgagagaagaggagacaagcacggggcgacacaagccaccacgacagagcacaaagagagaaaaaacgaggaggagacagaacacgagaattagagacataacaccgggagcacagccagcgccgagagagcaacgcccagcagtaacatcagccacctaactaacaaggagcagaggagaagatgacagccgagcagcatagcaatgagactactaccccaggcaaaggcacaacgacgaagacggtgagaacccacagacgggatcactatcggacagagcgcacgagaatatatcacgacaacaaaaacgacgcgtgtcgatcgaaaaagagtcttcatgtggtgtgcatcccacagaccaaactgatggattgttctacgaggaaatcactgctagataatagtaccacacatcgcataagtgttctaacagagaatttccacgaacacagaaaacctgctctcacaacgtgtccaaaatgattctctacntaccatggtgctacttcccaaaatattctctagatacgaaagggccaccaacgagtaccacgagcacttcgaagtcgcaaggagaatactcacctcccccaagtactgttctaaagaacgggaatcccaacaaatccgctggttggaaacgaaagagatgctccgccaacagattctcagtaagagacaaaggaacggaggatccacgttgaaaacaagtgacataagcgaaacaagagtaagaggaagaatgatggaacaagagaccaatgcacgatgaaagacgaccgctaccaaagcaagcatgacgaacaatctgatgacaattgaagtcatgacttagacgcgacagagaagacagcactggacctgagatggccgactctgaagacggaagcgatcataggaatgatgagtagactgcatgtcgtgatatagatgcttgttgcttactaacacgtactatatanng

SEQ ID NO: 506472 - DNA, 184 bp, Homo sapiens
  misc_feature (164)..(164): n is a, c, g, or t
gctgtctctgggtaatagagagggagacgtaggtttacaagtcaatcttttggaatttggtactagcctgagccaggtggtgggtcactgtggctcccagatgccacacgggagctctgggcaaagctgtccacatggtctgttggctcagctaaattcctggnttgccatcattgaaatcacc

SEQ ID NO: 506473 - DNA, 155 bp, Homo sapiens
ccttcaggcctcccccacatccggcagataaggacacactacaaagcagcaaacagcccagcaaggccagactagaggaatattacctacatactacagagactatcaagagtccacgtgtagaacagagactagccaagcagccctactaccta

SEQ ID NO: 506474 - DNA, 319 bp, Homo sapiens
atagacgggtttgcccgtgtacgccacggactggatcttgactctccgtgatctcatgactctgccgtgcctcggcctcccaaagagctgggattacacggcgtgaggcaccgtcgcccagccaatatcaacgtatcatttggaaatgacctctctcgtgcagcacagatacagctcttacctacggggcatatgtgactgcccctgtaggccaggtggctacatattcccacccacatgggccttgtttggggcaccctcctcgcaggtttaaacagaaatctctgtggccacaacatttccagcgtgtccgcgcgca

SEQ ID NO: 506475 - DNA, 1258 bp, Homo sapiens
  misc_feature (171)..(171): n is a, c, g, or t
  misc_feature (323)..(323): n is a, c, g, or t
  misc_feature (341)..(341): n is a, c, g, or t
agcggcggttgccggtctggcggcagccatcaggatatgccaagatgggtgcattacaatgctacatccatggagtctatcgagaaagaagcatctctgatgtcatgcgctttcttcgttgagggtcctgatgcatggctcgcttccgcgcaatgcatctcgtgctctccnacgatgggctccccgcccctaccctggcctgcataaggctgcgcctgactcggcgctcacgtagggcgcaagctcaaggttagcgttagtatctacggattccgtggtacgcgccgtgtgtggccagacaaagaaccgcccaatgttgcctnaaaggtcgcaacactttngacctggctatagccgtggctcctatcgatggttgtttaacgcaagctcaacatacgttatggcctcccgcagagccaacctttcagatcgcacgtttgcctatgtagcgtagcagcagcctatgcgactgccataacctagttgggggagctactcggagagcttcccttgaaattcttttacattgggttcgtgttgaagaattccgacagtacccaaacttgtgttcgcatggttaatccctcgatttgattcccactatcgcataagaagtcgtaatcgaagcagatgcaatactcccttgtacaaccccaggttgcgatcagcctaaaaacccagggtcctaccacacgacatcagtgggagcaatcgcgctatggcgacttgcatcactccttgccagagaccgcaaagaaggccgtgtggcctctgggaaggggggccccacatagcttcccactcaacacttactgtgggttcggtcttctccgcccggtgcctcagttcttgagcagcaaactggcgccaaagtaaacatcttctcgccttccccacacagtttacccggcgtaatctaataaggttaagaacggttcttggtacccaacttgcacttacgtggtacattaaaccaccaatttttagcgacccaggcccaactgaattcaagaaaccaaattgttccctcccaggtgcatgtgaatttcccgcgcactattaaagggggcgcatgaatccctttccccggcgtggggggccccccctggttgtccccagcctttttggcttccccgcttgtccgtgagcagagggttgagattcctccgccacctttggggggtagaagccaggtgggccaatacagcactggttttccccggggttgtgtaaccatcttctgattcccgggcccaaa

SEQ ID NO: 506476 - DNA, 292 bp, Homo sapiens
  misc_feature (28)..(28): n is a, c, g, or t
  misc_feature (38)..(38): n is a, c, g, or t
  misc_feature (54)..(54): n is a, c, g, or t
  misc_feature (101)..(101): n is a, c, g, or t
  misc_feature (123)..(123): n is a, c, g, or t
  misc_feature (129)..(129): n is a, c, g, or t
  misc_feature (162)..(162): n is a, c, g, or t
  misc_feature (177)..(177): n is a, c, g, or t
  misc_feature (191)..(191): n is a, c, g, or t
  misc_feature (226)..(226): n is a, c, g, or t
  misc_feature (257)..(257): n is a, c, g, or t
  misc_feature (277)..(277): n is a, c, g, or t
  misc_feature (284)..(287): n is a, c, g, or t
ctggctttggcatgatttatgattcccnggattatgcnaagaaaaatgaacccnaacatagacttgcaagacatgccctgtatgagaagaaaaagacctcnagaaagcaacgaaaggaacgcnagaacngaatgaagaaagtcagggggactgcaaaggccnatgttggtgctggcnaaaagtgagctggngattggatcacagccgaaggagtaaaggtgctgcnatgatgttagctgtggccactgtggattttncgcaagaacattaataaacnaaaaccnnnntgtgt

SEQ ID NO: 506477 - DNA, 189 bp, Homo sapiens
accaggagagctggcgccatcatcgagaggggagaggacgcagcgcaccatcgactcgggagtcttgtcatgatgggcgccagagaaaagaccgaaaggaagagcgagaggagctgccgaggcttccgcatcttcgacagaagcagacggtacatcgacccggagagctgctgagatttcaggcctccg

SEQ ID NO: 506478 - DNA, 1582 bp, Homo sapiens
cttgctttcgccgcgcactccgccgtccatggagcagcgccgcgtcaccgacttcttcgcgcgccgtcgacccgggacctacaggaaaatcgcgtctggtcccaagacaggacggatggaaacacgacggccagtgagcgagcataataagacagactcgactattagggagcaagtggcagcaacgaacagcgtggagataccgcgtacagctagaggcacccaacgaaggagcatacacaagaagaagggacgacccaaaaaacacagacaaaaaacaaaaaaaaaaacaaaccacaaacaacaaacaacaaaaaaaaaaaaacaaacaaacacaaaacacaacacacaaacaaacacacaacaaacaacgaaaagaaggagaaaccagaacaccagaaaccagagaaggagacgcacaatgaacgaacgagaagagcaaacacaacaaaggacagcaaaaacaagagacaaagaaaaaacagaagaagagacggagcagaacaagaaaaacaaaacacaagcgaaagaaaagccaacgaggcaagaaaggagagaaaagagacgaagacgcgcacaacgacgcacacaccgcgcagaagaaaacacaaaagaccgaccaaaaggaccgcagacgacagagagccacacagcgacagcacgcacgcaaacacaagacacaggcaaggccagcggagaccgaaacgcaaccccccgacagaggaacgacaagacaaaccagcgaaaagcaacagcgacaagcgaaacacgagacgaaagacgccacaagacaacagcggagggacacgacgacgacgagacgacagaagacaacaacaggcgaaagaaaccaccgcaacaaccgcgcagcggagagaggcaggcgcgaagcagcgacaaagaacgacgacaacacaagaacagaaacaagagagacacgaggaccgaacgagcagcgaagaagagagagcacaacagcacgacgcatcagcaaacgaaacgcgacgcaaaacaagacgagaagaagaaaacgaaaaagaaaaaataaacaacacgcgccaacgcacaaggacgacgacacaaggagaggcaggcactgcaccaaaacgaccgaccaccaccacagcagccacaagcaacacatgcgaggacaagcaacaacaaggcaccacaacaaagaacagaaggacaagaacaacgcaccgaaggcagcaacggagaagcgcaacaccgagagacggacacagacagaaagagaccagaggcgacacggggaggaaacagaagcggaagaacgaaaggacagaaaacagcaaggacgccacaggacgcaacacacacagaccaagcaaacagagcccacacaaccacacaggagcacaacacaacgaacggaagagaccggaaaagagccagagacgagagacaacagacaacacgccagccaaaacacaaacaacaaaaaacacacaacgagaaagaggacagaaaacaaagcaaaaaccacacgtgacaggaagaacaacaaacaaagaaagaaacacacacacaacaggcaaaagaaagaacgcgagcggcgacg

SEQ ID NO: 506479 - DNA, 601 bp, Homo sapiens
atgagtaaaacttggcaagttcgtgtctttgcataagatagcttggggtattccgggtctttgtaattccatattagttttaggactgttttttctatctctgtgaaggaatgtcacagaatgcagtctacatattgcatagaatctgtagattgcattgggtagcatggacattttaacaatattgattcttccaattcatgaacatgaaatatctttccattttttgaggtcttcttcaatctcttttatcagtgtttcctaattctgattatagagatctttcacatctttgatcaagttgattcctacgtatttcactttatttgtggctgttgtaaatgggattactttttgcatttccttctcagattgttcagtcagcatacaggaatgatactgattttggtatgttgattttacatcttgcaactttactaaatttgtttatcagttctaacagttttgatggcgtctctggatttttccaaatataagatcatatatctgcaaacaaggataatttgacttatcttcctgtttggatgcctttatttctttctgttgctgattgtctagctaggactcagtactatattga

SEQ ID NO: 506480 - DNA, 258 bp, Homo sapiens
  misc_feature (100)..(100): n is a, c, g, or t
  misc_feature (243)..(243): n is a, c, g, or t
gagtctgaatgtcgggcggacgtagcgtatcgatgggcagtgaggcggcgcatatgcatctaggctataaatattcgaagtatacgtacgcggtaatgtnaacaacggtacctctagaatatagctagcatgcgaaattaaaagcgctgatatcgatcgcgcgcagatctgtcatgatgatcattgcaattggatccatatatagggccggggtaataataacctcaggtcgacgtcccatgnccattcgaattcgta

SEQ ID NO: 506481 - DNA, 219 bp, Homo sapiens
  misc_feature (1)..(1): n is a, c, g, or t
ntgcacgaggccaaaggaaagcctgtagagtggctcacaaccgtaatcccagcaacttgggaggctgagatgggaagatcacttgaggccgggagttcaagaccagcttgggcaacatagcgagatcccatctctacaaaaaataagtttagccaaggtgtggtggtgtgtgcatgtggttctagctactggaaagctgaggtgtgaggatcacttggg

SEQ ID NO: 506482 - DNA, 189 bp, Homo sapiens
tccccattttttggtaaggtttctaggaggtgtgttaggtggccatcctgcagcatattggcttaaaatggcctctccttttatgtggtctctttggggccgattgggaaaaagaaaaatcaatagggcaactgttttgatactgaatattgacaagggtctttttgaaataaaaaaccagtccctcca

SEQ ID NO: 506483 - DNA, 406 bp, Homo sapiens
cactcatgccgtttcctcctcccccctcatcccaatactatttccactcttccagagtctccaattatcagcatcaattgagcagggtcgcggtgggagtggtcgcattgcgctgtctgccatgatggtgtgttgcatgttgtttggatgcttgactagttgtatctgacgggagaagtttgtgttgtaccagcgttgtccttggaaagatttaagtaatgcaaaagtttgtccttttttttttttttttttttttaatctactgacatgttgttctagtatacccaaagaattgtagtagatatcatctgcttctctgtccagactattgatttttctatatgtttcaattcctcttgatacatttaatcttcataaatttttttatcttttataaaaaaaaaaa

SEQ ID NO: 506484 - DNA, 612 bp, Homo sapiens
tggaaacggggttcttagtttatcacccagggccaagatgtggcatggggcgtgtagatcacacattacatctggcagcttatgacctcccagggctcaaggcagatcctcccacctcagcctcctgatgtacgctggggaccaccggtgttgtttgccaccatagcccagctgattggttgtatcggttttgcgcaagagaccagggcctctgccatgtgtttcgccccagggtgtggccttttgaactctccgtggaactctcaaggccaactccacgctgtgccttggggccctcccaaaaaagtgcgtggagatttaacggggtgttcaacccacgtggtctcctatagccttttctttacttattctctcgcgtgggtggtaccgtgaagtagactcacgattccctaacataatggaatatcaatatccacacggccttatatggacccttatccccagctttatgtgaaatactccctcttatgggttcgtagaaaacagcgaacccctcttaagttttctcctttgggggggacaacccactatcatacttcctaacgcttgggacatgtgaactccgggtgtggcgcaaaaaaacgccccttt

SEQ ID NO: 506485 - DNA, 931 bp, Homo sapiens
  misc_feature (97)..(97): n is a, c, g, or t
  misc_feature (179)..(179): n is a, c, g, or t
  misc_feature (928)..(928): n is a, c, g, or t
  misc_feature (931)..(931): n is a, c, g, or t
tttttttttctagggagaaggtgcttaattctgggatctgcgtaccaggctggctggggtgctggagtgggaaggggaatccaaggagcaaaccaanaaggtcctagggccagcctaggcctccacggcccggccgttgatgacgcggattgtggcggatgacgtccgggatgtggctntcagattgttgtgcccgtggcccccgatgtccggagtggtgcattttctcattggcccgtgtgatgttcgcacgggaagcgctcctacggggagtgggggggcgcataagagctgccttgttgagggtgctccagcatcatgcagctggccagagggtggccgtggggttggcgatgtctaatgggggatactcctgggccggtgtcctcgtaggctgtttcaaaacaccgagtacacatggccatagtgtggccccagccaaaggccgtgggcccccgaccagtcccgcggcagaccattgttgacgatgttgccatagaagatgcgcatcaccatgacactcaaactgttggggccgggacccagctgcatggtggtgttatccacagtcatgttctcgaaggtgactgaggggacagggggtgcacctcccctgcaagagtgggggaaaaggccattggcaagttacagaatgtgggactttgagcacggcggcatagtttgggcccgtcccctggcgccagtgagaaggaaatcgggaatgggaggaaattgccatggggaaagactaagggatcaagaaacgcggacgtatgccggggtggaacagcctgtgccgggaaaaggttatgttgtccgggcacccggaagccaagataggcaacgcgcggccagttaataacggcactgagacacgaacgggcaggagccaaaggacaagccagaagaatggcctggcgtgcggatnggn

SEQ ID NO: 506486 - DNA, 563 bp, Homo sapiens
ctcaacgcagttcaacttcattataaagactatatttttcatttaattgatactccaggtcatgtggattttacttatgaagtttcacgttcattagctgctactgaaggtgctttattactagtggatgcaactcaaggaattgaagctcaaacacttgctaatgtttatctagcgatagaaaataatttagaaataattacaataataaacaaaatagatttgccagcagctgatgttgacagagttaaagaaaaaatagaaaatgctattggtattccgacagatgatgcgattttaatttctgctaaaaatggtacaaatattgaagctgttttagaagcaattattaataaaattccagctccaaaagtggttgaaaatgaaaaagaattaaaagctctagttttgattcttattttgatattacagaggagtaattattttagtaagaattggttcaggtctattaagggggggacgaaattaagttcatggcaaatgggaagaagtttggtgggatgaattagcggaagaactccaaagagcttaaaaaaaaaaaa

SEQ ID NO: 506487 - DNA, 757 bp, Homo sapiens
  misc_feature (97)..(97): n is a, c, g, or t
  misc_feature (179)..(179): n is a, c, g, or t
  misc_feature (648)..(648): n is a, c, g, or t
tttttttttctagggagaaggtgcttaattctgggatctgcgtaccaggctggctggggtgctggagtgggaaggggaatccaaggagcaaaccaanaaggtcctagggccagcctaggcctccacggcccggccgttgatgacgcggattgtggcggatgacgtccgggatgtggctntcagattgttgtgcccgtggcccccgatgtccggagtggtgcatttgtaggacacaggcaggctcggcacacaccaggccctgccaccccccgctgtctcctgtgactgtgcaggactgggagatttgccacaggagggaatggtggcaccagcataagggccaaaaagagtggggccagactccagtaccatcctcccctgttgggggctggggctcagtgcattgaggcggggctacaggaggctgcatgggggaagactggggcgtgggcaacaagggtagggtgcagaggggaacctcactttctcattggtccatggttgccaggacagccttacggatggaggtggcataggagtgcagcctaaaggatgggacgccagccttcagtccctgtggcccggagggctgccaggggcttgcggggccaggggagcccctcacttgaggtgtccagatcatgcagntggcacaggtgccggggttgcaaagtcctatgggaacccggcgggtcccggactgttcacgcgtaccttggctgtggccccccatgtggcccgcatcggaattgtcttc

SEQ ID NO: 506488 - DNA, 200 bp, Homo sapiens
  misc_feature (83)..(83): n is a, c, g, or t
aaatgtaggctatgggggtactgtaattgttgcagtgcgtactatgtaagggtttgaaatctgtaccaacaggtccttggacngctgcctgagcttgtgctgtgctaggaaacagagctttagaagatgcagacagactttctgaattggatgaagctgtacttgagactacactcaaaactgcatcaacaatattttag

SEQ ID NO: 506489 - DNA, 363 bp, Homo sapiens
  misc_feature (8)..(8): n is a, c, g, or t
  misc_feature (26)..(26): n is a, c, g, or t
  misc_feature (43)..(43): n is a, c, g, or t
  misc_feature (48)..(48): n is a, c, g, or t
  misc_feature (70)..(70): n is a, c, g, or t
  misc_feature (97)..(97): n is a, c, g, or t
  misc_feature (166)..(166): n is a, c, g, or t
  misc_feature (361)..(361): n is a, c, g, or t
tggccccntgacccttcccctgtccngaacctacgttgatganttggnccaggagcagatattatgatanaggtttggtctgtatttatgcattttnaattcagagagttaaatccatggctcctcacagtacgtttactgtctccacataggtgcatggtggccnttggtgtacccctggccctggactggaagactgtcatttgaggaggttaaaatgcatgcagggaggataccgggatggcaccatttaagctctgggtagccagctccagctctggattatcctggagagccaacaccttaactagtttgatgtggttttccgttgctttatgagcaaagtggttctcatagagtnat

SEQ ID NO: 506490 - DNA, 81 bp, Homo sapiens
gcccaaaagaacccgacagctttctatctctgtgccagtacttatagttcgggcagaatgaacactgaagctttctttgga

SEQ ID NO: 506491 - DNA, 797 bp, Homo sapiens
  misc_feature (97)..(97): n is a, c, g, or t
  misc_feature (179)..(179): n is a, c, g, or t
  misc_feature (688)..(688): n is a, c, g, or t
tttttttttctagggagaaggtgcttaattctgggatctgcgtaccaggctggctggggtgctggagtgggaaggggaatccaaggagcaaaccaanaaggtcctagggccagcctaggcctccacggcccggccgttgatgacgcggattgtggcggatgacgtccgggatgtggctntcagattgttgtgcccgtggcccccgatgtccggagtggtgcatttgtaggacacaggcaggctcggcacacaccaggccctgccaccccccgctgtctcctgtgactgtgcaggactgggagatttgccacaggagggaatggtggcaccagcataagggccaaaaagagtggggccagactccagtatacacactcctcttccccgtgtgggcgcgtggtggtctccaggtgcatgtgaagggcgggcatacagggaaggcttggcagggtgagaaacgtgggggcgggcgcacgccacgggtctaggggtgtgcgaggtggacaccctcacatttcctcatgttggtccatgtgggatgtgcccaggacagccttacggatggaggtggcataggagtgcagcctaaaggatgggacgccagccttcagtccctgtggcccggagggctgccaggggcttgcggggccaggggagcccctcacttgaggtgtccagatcatgcagntggcacaggtgccggggttgcaaagtcctatgggaacccggcgggtcccggactgttcacgcgtaccttggctgtggccccccatgtggcccgcatcggaattgtcttc

SEQ ID NO: 506492 - DNA, 186 bp, Homo sapiens
cgtcggagctgccattcctaatccaatccctggccctgttgactttgttggcagctcctcctgacactctcacttggtctccacgaacaagcggactcctcgctggtcctcatcctgcctccatggctgcacctgctcttctttctggccatcaatgtcggggtgcccagcggctcagtccttagc

SEQ ID NO: 506493 - DNA, 134 bp, Homo sapiens
tctctccacactggtttaagttggttttagtcactggcataagtattataatagagctacttagctgtgtgttttaatacccttctgttaaacaatttgcaggcaaacttaatggccttttctaacatagttca

SEQ ID NO: 506494 - DNA, 110 bp, Homo sapiens
tattatgggcacagaaattagtagtcaacatctcaaaactgaaaaggagaagaaggatcaatggcatgttatgatgtgaattaaatcttgaatttttttcttgtgccagt

SEQ ID NO: 506495 - DNA, 1088 bp, Homo sapiens
  misc_feature (321)..(321): n is a, c, g, or t
  misc_feature (529)..(529): n is a, c, g, or t
taaagatatcccgttgacctcatgactcgtgcataatcggaacaatacgggtctcgcaagaatgatgtaaactatcatagctgaggtggcggaagtgtaatgaaaaactgaatatcgtgacagaggtggatgtcaatgaccgtgtgtgcatggagaaagcgtgtgatagtgagagaggaaagcagttaaggtgtccacttgctgtcatgatttgctttggattagcgaagagagtgccagattgatctaaggatgggtcctagtagtgaaataattgtagtacaatacaaggtatatgatcgggttggacagtgatggcangagagtgcgcaacgctggcaaggaaagtcagaagcatgtgtttctaaggagacaataggggtgcgtaacgctcgtagtcaatacggatcctacgagaaggtgaagtgggttctgcagatcatagtgccgtcaacttggaatgccatgtgcaacacgcgtgtttgcgtgccaagtagagtaagtggtagggtacgtccatgtactctgntagggaaagtatagtcgcacatagtacaatggttgcatggtctagtctttcaccagggcaaagagggagtagctcgtttcattccaaggttgccctcgtacgcgatcccgtatgcgttcaagaggattccatcgctcgtaccaggggattgctccgaccgcttcgtttggctgcaaacaggcgaaataagacaagctcctgggcccaattgggttgtggtaacccttcaacgcgctagagaaaagcgccgttgataaggaaacctatgcgacaggcgcaagaaatcctcccttggcgttgggcaccacattctgtgcaaggggaaaacggtagccaccaaccaaaggggataatggaattcacaagaggcccaaggaactgggttcgcccacgtctaccgccctgtacaagcgttctgtggcaagagcactacccgggcgaccccaaactgtgggaaattctttatgtgcaacaccaaatattagcccaaggcccttttgggaaaaggagcgccaatagactaaggaagggacacacagtgtacggacacacacctctg

SEQ ID NO: 506496 - DNA, 449 bp, Homo sapiens
cccccaaggcccgagggttttttcccccgggggcggggtttcctccccccccccccccggggggggggttaaaaaaccccaaaaggggggtttttttccccccttgttttggccccaaaaaaccccccccccctttggggcgggtttttttgggggggaaggaaaaaatatttcccccccccccttttggttttgggggggggtttaccggggtttttggggttttttccccccccccccgggggcttttttttttttttttttagggggaggggggggttaaattgggccccccctttaaggggagggttttaaaaagggccctttttgggtttccccccagcccctttgggggggcccccttttttccccccctttttaccccccctttttcccccccttttttttttgggggggggtttttaaaggggggggttttttttttttta

SEQ ID NO: 506497 - DNA, 694 bp, Homo sapiens
  misc_feature (86)..(86): n is a, c, g, or t
  misc_feature (123)..(123): n is a, c, g, or t
  misc_feature (129)..(129): n is a, c, g, or t
cactgtggacgatgagtcagtgcttaggggcgccaggacgtgggcgtgcaggacgccagagctgggtcagagctcgagccagcggngcccggagagattcggagatgcagtgcggctcggatngcctgngagcttggggctggcagcgtgcctgagtgctcggtgtgtgctggaattgtctgtgttgtgacaatgagggacggtgtggcagcgtgcccttgtggcccacctggtgcctggcactgaacccccactccccacagctcgcgtgctcactggctgctcccttgtggtgcatgcccctgtgccctggcccttgccctgtgctgtgccctagtgcctgtgtggattgcctgctcatggcttgggctcgttggagcagaggtcagagttcccaaccccgtcttgacggctcttgaccatgggaaaagaaccgggccaagtgcggaattctacagttccttttgcctgtgggaattgttcaaagggccacggcatcacccacaaggaatccagggtgttcccattacgcccgtcccgttgcttcaacggagagaaggcgggacaacaatgtttcctttaaaagaaggctcggttgggatgccttgtgttccccgtattcattcgaacggacagtgagacggatccctggccaaggaattgacggctcttggagattggtgagaggagaaca

SEQ ID NO: 506498 - DNA, 1016 bp, Homo sapiens
ggcgcgaatccgtagactactctaccatgctcagctgtaacgttgcattattccgtgtgcttgtgcactgatccagtccctgagtcctgctctgagtacgtgtacttccgtgtagttcctattgtcttgactgttggctaggccctcggtcttacctatcaagatggcgatcatgttatcactcttgcgcgtcgaacggatcgcagtccatggatccttgctattagatatactactttcgtgtaagtatactgctccggagcatgtgaaccaataagcaatactaccagtcaatatctcatcagttaataactcataactggctatatgcagataagaactaggaagtagcaccctctttcacgttctgatgtccgcagaggttagcccaagggcacccctctgagcatccggatctgcttcttctcagcatgactagaaatagtatgccgcccatctcaatcatatagccaagatctctccctcgactagaacgtaagcgcttctcctcactctctcaagtcttatccatcataggcaggcagtgtgaggtggattaagaccaaatgccagctagggcaaaaatcttagcatactcgctcaattacccacataggactgaataatagcagttctaccgtacaagcctaacgataaccgattcttaatttaactatttatattatcctaaaatactacctgcattcctacgtactcaagtttaaactccagcaccacgatccttactactatctcgcagctgaaaaagctaacatgactaaacaaccttgattccatccaccctcctctcctaggagggctgcccccgttaccggcttttgccaaatgggcccttatcggagaattcccaacaaacatatgcttatatcccaccattataggcaacatcaccttcttaacttatatttactacgctatctatcaactcataaactattcccatatttaacacgtaaaataatgcagttgaaatacaaaaccaaccattcttccga

SEQ ID NO: 506499 - DNA, 332 bp, Homo sapiens
gtcatcccggagggtactgtcctccaatggcagcactgactatgaccgtggacaactaaagatcgaggaggaaggaaagcgagactcacgaatctgggaagcatgtaaacagagcaccccatgccgaaagggctgcaggctgtctttggtttgggaaccaggaaagaagggatctggggacagaatcaccctactcctatagcctcactagactctgtattttcctgaagacacagagcagagctagcgaaggagggcgggcaggtctcacaacttgctggacgcaatcccctcttggtgtgtgtataacctgactctgacagccaaggaaa

SEQ ID NO: 506500 - DNA, 1694 bp, Homo sapiens
atggctccaggacgtttcttagaaatagtggcaggcaacaggtgtggacagctcatgcctgctaatcataacctatcagactactaagcacaggtgtggtaggctcacgcctgctgattataatcttcagcttactaagacagagtccatgcagcagtgctctcactgggaccattctacctttacatcagcatgcttttatatgcaacgacacctgctatccacacaggcggcgcaagcacaaatgtcatcttaactagcgtgacatccaacatcgagcgcaatacttgtactgcagcatacatggcaatagaagctctcacacgcgctactactggacagaacccaactacttcatattcgctacacactctgctggcggcactaacactgctagtcgtgcacttcaatagacgcgcttaaagccaacaattacgccacgtctcctctcgcgcccgtcgctagcgcgcgctcgccaaccacgccctcacaccaccaccgctcgcttcacctaggcgccacttcccagccacctccaaccaaccgagcccatctacaacgcgcccacacttcgcactgcgttccttaaggagcctattcaatcctctttccgacgccaagcaactatacgacgtattgctacttggctatccgcacgccatcccttccaagtggtcactaccatcgactgcggacacgcacacgtacacaacccgagccaaacagcaccttatctcagcagccgctagctcatcccccccttgacatctaaacaacagctacatgacgccaacctacacctccacacgcccgcaaacgaatcacaaacccctcaacacactcccgcctcaacccgtatctcccattaccattgacaaacacacacataatccacacccacacagaagaactatcgacatacacctcaacttacgccacaactcacaactaccatccaccatctactacgcacacccaccttcctccaagcaacaacaacaccacaaatcaccacggacacacctcatctacaccaaactccacattccacagctataacaggagcattcatatcgaacccctcaacctagccagtagtcgacctactgcctcacatcaacttatcgaccaacacacaactctggcgatccactcgaacaacgcaaccactctctcaccatcgagtgctatatcctaaccacctatagttccacaatacgcacccattccacatttgtccacacacatccccatttcacaatcccgaccattatcacagcaattagcacaccacctaaatatttcatcctttaccccctattagatacacaccatatcctcacacacacccgtccatcaccaccaccgacagcgacattaaaagcccatccagcaacggggacatctaatcgacaaacccacagagcagatgacaagacacaactgaagcacgcaaaagactagtcctaaccaccataaactcatccctcggtcggcgtcctgaatccaatcgattaatgctcagcatcagcgaccgaatacgattacaataccatcaccataacacaggctcatctcacaccacgcatctaacctcgaagcggacgcacaatcttaatcatccaacacccgcacaccatgagaccatatcgtaggcgcatccaccatatgacgagcagcgaggcgcccaagat

SEQ ID NO: 506501 - DNA, 1060 bp, Homo sapiens
cccagccccaaagcaacagggagagagtcacctcccccatccctctgcatggagtacctttcagccttcaaccccaatggcctgctaaggtcagtatccactgtgagctcggagttaagccgtagggtctggaactcagctcctccacctcagcgacccttccgtgtctgtgatcataagcggacagtccggaaaggactgacagctgccagcctccaagaactgctagataaggtcctggagaccttgctgctacgtggagtgctaacactggtcctggaggaggatgggactgctgtggacagtgaggacttcttccagctgctggaggacgacacgtgcttgatggtgcttgagcagggccagagctggagccccaagagtgggatgttgtcatacggcctaggacgggagaagccaaaacacagcaaggacatcgcccgcatcaccttcgatgtgtacaagcaaaatccccgagacctctttggcagcctcaacgtgaaagctacattctatggactctactccatgagctgtgatttccaaggagttggccctaaaagagtactcagggagctcctccgttggacttcctcgctgctgcaaggcctgggccatatgctgctgggcatctcctccacccttcgccatgtggtggagggggctgatcgatggcagtggcacgggcagagacacctccactcctaatgagatcatgctttgagcctgtgctgaaagactggttccatgtgacacaggagggtagtaaaggcaccatcaggcttggggtctgcagtgtaccctaggtaaccaagctgactccatcctaacagatctgcacactgccttgttcctctggcctgtacatcttcctgaagaatgctacctgtcttccctccactcctgccttccacataccctgcagaaccacagccttgtcccctgcatcctgatcccaccgtaatcgctgcttcatctaggttcttactgacgcctacccctaagatcctgcataccaacggccactgtccctagctttactacaagataactttcccct

SEQ ID NO: 506502 - DNA, 214 bp, Homo sapiens
ggagttcaagaccatcatgggcaatatagtgagaaccccccaccgtataaaactgaaaagctcactgaatggtactagctcttcctatataaatcccagttctagtgttctttcctgttccttgctgaagattgtatttactgtgtggcattgtcctgagggctggtataactacgtagtactttcctaaccctgaggcactgtttgcactctg

SEQ ID NO: 506503 - DNA, 150 bp, Homo sapiens
ctcctaaaaaattaaaatggtaagaaaattgaaaacctcatatagaacaactgtaaatcaagaaaaaggaaatctccctgaaagtaagcaaagttaaaagacaagaaagacgaggtgatggaaaataaggaaaaaaacttttaaaactta

SEQ ID NO: 506504 - DNA, 744 bp, Homo sapiens
agcggggggtcggagtcggctggggatggagccgctcgggccgagccctccaccgcccaccatcaccgagtccggcccaggctcctagcgcggccgccggaaggggcgggtcagcgggcgggcatttcctgccggtgcctagggccgacggggacgctggcactggtggggagctgttggggggtcccgcatctagggctctcctttcctgcctccggcccccgcgaggggcgcgcgcctctccccgccctccagcagtcctggtagggcccgggcgcgtccgcgctctgcagcgggaggtcctcgtcgcccctcgtctccagccaggtactcactgggctcctgcctgccgcctccggcccaggacgcgcagcgtcggtatgggccccgccgcctccccgcaccccggcgctccagggatgtggcaagacccggctttgagcacctcccgggcgccggccccgaggccgacctagctctgcacgtgggccgcggggctctgccgttgaaaggagagcctctaactaggagcacgcacgggaccctggcgggcccctccgcctggctcagatgcctggcatctcaggccttggcacagctagcaggcccctggcaggccgtggacccagcagggctgttttagtgcagattggccctgaatctcaagcccactaattgttccagtctctccatgagacccagatccctgaaagttagtggaagggaggcgccagggttgagtga

SEQ ID NO: 506505 - DNA, 230 bp, Homo sapiens
acagaagttagaggagagcagaaccacggttcagcagtcttcaacctggcaaggaatagatcatatcctattttcctttcaggacttcatacaatccccaggatagcacctttgtatgagctgatccattaactaaaccaaagctaacattcaacactgccgttcaagctaccatcactcagtttttcctctgcactgtgtcagtaacacgcatcctgcaaagagtacag

SEQ ID NO: 506506 - DNA, 674 bp, Homo sapiens
tcatctagacactggtgatgccagtgaaattttgcacgttggaggtataaggtatctgtcacactgtctggaaatacaggttaccaggacacatactagtttcttggttcggtagaataaaggaaactctaagccacgctatgacacattttcaagggcacatctcgaaaccagatagtactcattcctagattgaatttgactctagatgtggatgtgggggacttgcagatggttgaagttcatgtggtataacaatgtgatcaacccaactttaacctagagtgggagcatccaaggattagtacgtggatgacaaagtgttggcaaaacagttcaacttctgtagtccagaaaccgtcagggaggaagttctgctcgaccctgcatcaccgtgttaggagactactgtctatttgaccaatgaattgacttctaagtaaaatctagctggctgataccaaaaataacaactctaaataaaaattcctagctatgataacacaatcgtgttgtggccgcccgttggcccccctgagaagaagttctttgtaaacaccgtcgcgtgttgtcccccgggtcccaacccggtgtttccctgccacgtgggccactaccggtttcccaggaagaaccggcgcgctcgacacgcccggggttttcccccgttctac

SEQ ID NO: 506507 - DNA, 205 bp, Homo sapiens
gtcagtttaataacataaatatcatcttctctctatcgctacgcgacacaacttatgtgtattttgctctctagtctagtttttcttcattgtgctatctaccccttgcttggtttccaaagtgcagttagaatgactataaattttaacctaccagaggcggaagccaagaccaaagccgattcctatatgccaccccaggagc

SEQ ID NO: 506508 - DNA, 319 bp, Homo sapiens
tgccttcttttgctccagtcaaagtgctgaatgtagttaggctcttcttctccactcttcgttcctagccgcacttcttgtatagctatgccttcttgctcttctcctcttctctgctctcatttatacaacgtggctgagctgatactttaggaacgatcactggcattaatcatctgtattctttcactgtgcttagctgtgagtcctttctttggtaagacattgagaggtattcctgttttagaagatattcgaatttgtttgggctttggttgatacttgataagctgtggatggttatataaatttgagtatg

SEQ ID NO: 506509 - DNA, 100 bp, Homo sapiens
gttgtacttttgtaaatgattttttaaatggaattttgcccataatacattgtaaaactgtatgataatcatgtgggaaaataatttttgaaatatccca

SEQ ID NO: 506510 - DNA, 714 bp, Homo sapiens
  misc_feature (318)..(318): n is a, c, g, or t
  misc_feature (347)..(347): n is a, c, g, or t
  misc_feature (468)..(468): n is a, c, g, or t
  misc_feature (534)..(534): n is a, c, g, or t
  misc_feature (581)..(581): n is a, c, g, or t
  misc_feature (590)..(590): n is a, c, g, or t
  misc_feature (592)..(592): n is a, c, g, or t
  misc_feature (707)..(707): n is a, c, g, or t
cgcctgcagtgcatcggaagccggatggggtacgagaggctttctctcaccagggtgattgtgcatgaatccggtccccaacgggctcaggttttgtcaaatgaccagcatattcaagatgcgctgggcgtctaaagaaatcggcatagaatcattaggcacattattaaaggtttttaccgggggaaaccagcaaaatacacccaaacgccgcgagtaagcaataccacaaagtttcatattttaaatgggccaatactaaaacaatttctctcacaaggtccagggtctataccttatacactgggaacatcattncaaacgaggcgccctttacccataggggnccacttttaagttaaaaaagtaatgaaaaccgagaaagcatttccccatgtgtgcgaacccttatgggtccacaacccctctacttcacgaaaactaccaccaaacaacccaaactgggtncctcccccttcattttcgctcactgatattatacattcccattttattaaacataaccgatcatantaatatataaagttccaccacaaacaatttgaaggtcatccaaattnaacccattntnactgtactaacaaccttctatttctacctattctatttatttatattatctcttccccatattttagttcgtcctttcctttttttacactttaatctatactaattatatctanattgata

SEQ ID NO: 506511 - DNA, 339 bp, Homo sapiens
  misc_feature (243)..(243): n is a, c, g, or t
  misc_feature (339)..(339): n is a, c, g, or t
tctcaacctcccagggtggctgagactacagggtgctggccactatgcccaattaatattgggaattttcgtatacgtggattccagaggggtgacagtgaaaggggggaccatccagtggcaggaaaacaagcttaagacgcccacggattctacattatgctcctacctccgggcagcctctccaggcccagaactttctccagtcagcctctacagaccaagctcatgactcacaagggnctatttagggccataccctaggtcacggcagtctccggagatgagcctaatggcccaaaaaaggctccaaaggcacagctccatcgttacaatggn

SEQ ID NO: 506512 - DNA, 586 bp, Homo sapiens
  misc_feature (472)..(472): n is a, c, g, or t
  misc_feature (545)..(545): n is a, c, g, or t
gtctttgcattttttattaagcgaaggacaaagaaatgtggcgatgcgcgtaaagaagtcgaggcggaatagactgggtgatggccttacacggacgaaaacgagaaccagatgaatatgctggtgattttcattggccttatataattctcatggtaggctgggaagcttttaattgtgaagttataagcctcatgccttttgacttgccgtaacaagttttttaccctactaggcatagctggcatgtttatagggagccgtgcagaacttatctacattagttgggagaactgaggtaacagctctcaggagctattgtgttgccttgggcctgagagtcacgagctcaacacgtgcagggggaggcatgaattcgctcttcttctcagagagggggcatgtatacgcatggtatgtgaatgttttagcattcaacactctgtgaacgtatgtatcatggcatttcatntctgtttagcatgccggctgtagaccatcgaatactgtggcatatttagcgaagtggttcacttactgccgtntgtgtcatgcggacattcataagctgagatggggaacaggt

SEQ ID NO: 506513 - DNA, 179 bp, Homo sapiens
tatcacctgtgattgggacgttactcctacagcctgagctctggtactcccctccccttgatgattatctctggaaatcacagaacgttagtacttattagcagtagcgaggtgcagagcatgaagtttgcccagcgtctggccatgcagaagtctcacggagatctcacaggaaaggg

SEQ ID NO: 506514 - DNA, 107 bp, Homo sapiens
agccaggtgtgtaggtccaggctcagatttatgcctctctggtcctcctcagccttcatggagcacttgcattctttcagcttggaacttctctgttctgcactact

SEQ ID NO: 506515 - DNA, 890 bp, Homo sapiens
tggacttttggtcatttaattgtaacccaagaaattttttccaaaataaaaaatgtattggtaccttattggtccaacacaaatattttcctattggtaaaaccctagggggattcaccaaatacttcattagctgtatttttacattgcactatatgaactcgtgcctcgcgagtgctaatagtcataagtgggttaaatctctaaaaaatccatatggcaaagtgtcacttgtaaaaaaaatacacacagcctataaaaagtggataaacactccatttataatcctaatctacaaatagatcataaacacagccaaaatataaacgtgattaatttttccaatacgtgtattcaacagcgtgattgttaccatagtggtagtctgcacattaattcacaaacagtgaggaaaatttaaccaaaactattgcaagtgaaaagtccgaggcttttacactctattagtgcaagtgggcttaaaaggtgtgaccttttttttttcttcaaaccattgattggttggggccccaccactacctatctctcttggggatgctccgtgaccaggtcggggaaatattcctctcacccaggaagcgaattcttgacggctgtgttgcaccaacacccttggtctacaacacgagttccaactctacaaggggtaaaccccagctctattgttttggttccttcacaaagggttctcacgataactgctatttaacagccgcacccttgttcctctatacataatttgtctcggcgccaaaataaattccctttaaaaggtcggacaaaatcaagaaacggccaacaaaaattttttgtccgaccagaagttggaattctctcggtggcctgaaaaatggttaataaaaagctgg

SEQ ID NO: 506516 - DNA, 762 bp, Homo sapiens
gtatttttagaaggcaaggaaccaattatgctgtattccataagtacttctctaaatgttcttgttctcgtaattcttggctaagacccctttaacatggttatcgctagtacaacggaatcccttaatgggaacactcatggtggctggctagctagtttctaccaggacctttatttgcctcttataggaaggctaacttcttagatcatgtcatccaatgggaacactcctctttcttagccttacttcggagtcttgcctataactaaacgctagagcaacacacatctgaaaggcggttcgtgatccacggtcctgaaattttcatccttgaatgtcctttgtagtaaatctgaaatgtttcattttaagctaacacaagatcataaatttccaatgattagccgtgggactccctgcaatgaatggtgttatgctgacttgaagcccaatgtggatcgctcattatctttcaaaaagtggccagcagatgacttatactgagtcacagcgatgatccctctatgccctgacacattgagtttagtgtagtcattttacttattttaatcattagctaactttgtctaagtatagtttctagatcagtgagtagtgtaatcgattataaaggatatttatccaatccaaggcgattgcattttggaattattattattttctctctgtctgaagtattcagttgtaaacataccaataacatatctcttaaacactctccgttttagccaccattta

SEQ ID NO: 506517 - DNA, 752 bp, Homo sapiens
gaggcaatggtggtcttggcaacagaatgctcagcccctcgtggcaggacttgacaagggcaagcttgaccaggaagctgccatcagggatcttcccctgcccgaaaagctaggctccagctgcaggcgggctccaaccctctgctcctggccttgggcaaagggcactcagcgcctcgcttggcccgtgccttgtggcaatgcgaggtccttccttatccccaccatgggggtccatgctctcctatttattctcgcccagtcaaccctctacaagacacttgtccctgggtgccacacttcctcctctccctcgcttgtgtacttccttgtcccctttttaatttcatggggcaggggagggggaggggcacaggcaaagaagagattcaccagtgtcctggggtaaggggggggttccacaagtcaatcatgggtctactcctctttccgtggctggggggtagacttaattacagagagacattcagcaaaaaaaaaacaaaacaaaacaaaaaaacatagtgtgcggccgccagggcctaggaaaaagtttttcacaccccaccgttgggcgccagggccccagtagagagaagtgaacatgggccacaacgtgcccacagagacaaccgggcccgaacatggccgggtttcccacaaaaaaaagccggggacacggacgctggacacaccaagggtcgaggcacacggctccaacggacaagaagattacgcggccgtagaagtgt

SEQ ID NO: 506518 - DNA, 546 bp, Homo sapiens
  misc_feature (408)..(408): n is a, c, g, or t
acagttatagaacacatggcacttaaaccccttattaatgctcagctatatactatttatacacaagtgataacccagatttgtaacattagttttaaaaagggaaagttttgttctgtatattttgttcccttttacagaataaaagaattacatatgaaaacccctttaacccatggcccttgatgtgatgtggcaggagggcagtggtggagctggccctgcctgctgcagtcacgtgtaaacaggattattattagtgttttaggcaggtaatggactaggcccacttttaattttgtcagattcacacaggcccctatgagctttcagactccagctgtgaagagactctgtttgcttgggtttgtttgttcgcagtctctttctgccagggcctgggcaggntgctggaaggcagcttgtggaggccgttggttccgcccactcattccttttggggcacggctttttccttcccagttaagatgccatgggcggggggattccatcccgcagacatgaaataaaagctttgcaaaggca

SEQ ID NO: 506519 - DNA, 841 bp, Homo sapiens
  misc_feature (287)..(287): n is a, c, g, or t
  misc_feature (447)..(447): n is a, c, g, or t
  misc_feature (450)..(450): n is a, c, g, or t
  misc_feature (454)..(454): n is a, c, g, or t
  misc_feature (480)..(480): n is a, c, g, or t
  misc_feature (638)..(638): n is a, c, g, or t
  misc_feature (665)..(665): n is a, c, g, or t
  misc_feature (725)..(725): n is a, c, g, or t
  misc_feature (833)..(833): n is a, c, g, or t
  misc_feature (835)..(835): n is a, c, g, or t
gagctcactgtaaccttgaactcctgggctcaagtgatcttcctgcttcaactttctgagtagctgggactacaggcatgcaccaccatgcacagctgcaggacaagttcgagcatcttaaaatgattcagcaggaggagataaggaagctcgaggaagagaaaaaacaactggaaggagaaatcatagatttttataaaatgaaagctgcctctgaagcactgcagactcagctgagcactgatacaaagaaagacaaacatcctgatccatatgaattcctcttnttaagaaaaataaagcatccaggattcaatgaagaactgactatcaccttgttaatcattcagaaacatgttgcaggcttaagccatttttgatatagatactgaaacaattacttgctaagagcaaacttgaaggtatggataaggccctgagtcatcntcntganctgaatgatagttaagctgaatgtangtataaaatatgattttctaaccacttgctcgccaacaaggaaaacttttaagtagagcagaacctgaatagacaagacatttctttcttttggtagaaaatgatttaccatcactgtctagttaattgtagactaggtaattttaactttgtgattnattgccggagacattttcttctgtacngtaaagtgtgtgtcagaaaaattagcgattttggaggattaggggactttgataaattgnctgcattctggcagtatgaactgcatattaattttctctctttcaagaacatttttatttattaattccttacaaatactccctaaactttggaacagctctcattgncnggattc

SEQ ID NO: 506520 - DNA, 242 bp, Homo sapiens
tatcaaggcaggagcagacagctttatttagtcagtcattgttttaaagcctttttttccaaaataaatattttacagatattttttttttttaaagattcttttcactgttaagtatgcttattccatgttcttccaagtagacagctgaagatttggtatcacaggtttttaatgactattcacatttcaatagcaagtgggaagtgaggttaagaaaggggattaaactccacacctgc

SEQ ID NO: 506521 - DNA, 642 bp, Homo sapiens
  misc_feature (582)..(582): n is a, c, g, or t
caccacaatgcctggctaattttgtgtttttagtagaggcagggtttttccatgttggtcaggctggtcttgaactcctgacctcaggtgatccacctgcctcggcctcccaaagtgctgcgattacagctgtgagccaccatgcctgaacgcttgttcgtttttgcagcagacggaatagtggtgttgtaggttaggcctgcatttattttttgcagataaatggagaagggaggaatggtggaaaagattacacaagtggctaaaggactgacttaaggtttttatctgcaaattttacaactagagggagaaaacctccctaaatatgtttattgtaaacatttaggacatattgaagagtataaagaaataaacaatataaaatcacttatagttccattacttagatgaactacttcatcactcttaatattttggtgtatggccagccatactcttccttttttatacatgcatacagacttttgcacttttatataagacacattgaagtggcattatactgtacatgcttcctataagtggatttccaggctacacacaaacttttaaagcgtnttctttactgtcacaatttacaaatataccaaaacaaccaaacacgctacacaaaaccct

SEQ ID NO: 506522 - DNA, 110 bp, Homo sapiens
aagctcaacacccactacctaaaaacatccccaaacatcatcacactagcaactcctacacacccaataggaccaatctatcaccctattagaactggctatgagaggag

SEQ ID NO: 506523 - DNA, 131 bp, Homo sapiens
  misc_feature (73)..(73): n is a, c, g, or t
ctccgcttaactgcgtcggataaagcagactagtgaggttagttgagccaataaatgacgtgaagtcctgtgnaagccctgtgcgttacaaacaatgttgagcctgtagatgccgtcggaaatggtgaagg

SEQ ID NO: 506524 - DNA, 1017 bp, Homo sapiens
aaaaaaaaaagaaatgcttttggtgtaattattttcccttcctttggacttaccttgcttatggaataaatcatagatactctgcttccttgccagaaactctcatggcaagaagtatgggagtttatgtggtgaggaagggctgagtgttctctgatgtcagtcatgctgaagttgttttctttgtcctggttaaggggtggtgaaccaaactattgcattttatttttccattcttaaagtctctgtatgtgaggaccccatggttgccccaagacaatattctttgacagaacaaataaatgcatcagtggcatttacatttgagcaagaggtgagatactggatttgatggtagaatattaacatatgtggctttttgagataggatcgagctttgtaaagaattggtaagtcatgatgatgggtgtggtagacttaaatgtttaaaaatgagttaatttttctaattcttagagaattgttaaaataaagatgcttggtatttcctttagtcttcacctacaagaaatttagtatgctctccacttagaaaacctatcttgattcatagacttaattatgccatcttggctatttctgagagttcgagggccctctgtttcttgtctctttcttttctgtgtagaaaccctgaagggtccataaggatcatgacatctctcaataagttgcggaaagtaaagcgggcgcgggtggtcatgctgtaatcccagcatttggaggccgagggggcagatcacgaggtcaggagatcgagaccatcttggtaacatggtggaacgcatcttattaaaatacaaaattagtggggcggggggggtgttggaaatccagtattagaaggttaagaaggaatgggtgaaccagggttggctggtgagtgagtaggacagagccggtggagaaaagggatccttaaaaaaaaaaaaggggggtaatattgggccttgtccttttaagcgagagataaaaggggaagaaaattggattgtc

SEQ ID NO: 506525 - DNA, 144 bp, Homo sapiens
ctgatccgcttaagggaacaaagcaaaagacgacaatggctaaattcgtgatccgcccagccactgccgccgactgcagtgacatactgcggctagatcaaggtagctggctacaatatgaactacattggcaatcacacaagt

SEQ ID NO: 506526 - DNA, 144 bp, Homo sapiens
ggttgaggagcagacatcattccctgccctggaattgatttggagccctgaagaagggaccactcatgggaccacagccactgtgccctgctgttacctgctgtgcccctgcatatgcccctgagcctggggctgccacgtgct

SEQ ID NO: 506527 - DNA, 574 bp, Homo sapiens
  misc_feature (24)..(24): n is a, c, g, or t
tttgctgcatacccctgcgcttcntacagggactttgagtctaacaaatgcttcccctgcccagatcaaggctgcccacagatgggtcactatgctgatagtttgccaacaatacaagtgtggagccacagaagttcttcctgaacacaggagaagccaagaactttgcacgctggaggtaccgtgtttccttgacattctctggaaggacggtcacaggccaagtcaaagtgtctctgtttggaagtaacggcaatactcgccagtgtgatatcttcaggggaattatcaagcccggtgtacgcattccaatgagtttgatgccaagcttgatgtgggaacaattgagaaagtcaagtttctttggaataaccacgtggtaaacccaagtttccccaaagtggcgcagccaagatcactgtgcaaaagggggaggagcggacagagcacaacttctgtagtgaagagaccgtgagagaagacatcctgctcactctcttgccttgtaaaacctcagacacaatgtgacctcttggtaacaccaataaaatcatcagctgcacctaaaaaaaaa

SEQ ID NO: 506528 - DNA, 346 bp, Homo sapiens
agcgacacaaagcttacaagacagcaaagacaacagcaaagctgggcccagcagccatcacctaaagaactcttcactcgttacattggagcaggtgatctctctggaaccaggaaccatcacctaaagaactcttcactcgttacattggagcaggtgatctctctggaaccaggaaccacagaacactgaaggacacggagctggtggctaaggattcaaggcctgcagtgaaaatgtaacatttccctccaagtgcttatttctgctataaactggtttagttttgcaatgaacaactagatttctacctgatattcacgttaataaacttttctttaataaa

SEQ ID NO: 506529 - DNA, 231 bp, Homo sapiens
ccctctattccgaaaaataagcttgtatcgtatgtactctgagtccctagtaaataatgtcttggcctagagaaccacagaaaggactagatattcatacatgcgagagcaacactgagactgcatgttactctggcataatgtatagaaaaaagtccgcaaagaactgccagaaccaggcctgtaaccaagtttaccaggtacatctagtttctctcacaagtttcagaa

SEQ ID NO: 506530 - DNA, 260 bp, Homo sapiens
ggttaaaccggggggggaattcccttttttcccaaaaaaaggtcccccttcccccgccccccggccctttttccccctccccagggtttaccaatttttttaattttttttcggggcccccccccccccccccccttttttttaaatgggcccttttttaacccccccccggtggggccccctttccgggtttttttttaaaggggtccccgggccccccccttttgcctttttaaaaagccccccttttttggggttta

SEQ ID NO: 506531 - DNA, 133 bp, Homo sapiens
atagaagtattctggtctcaagccatgtagacaagtccgggtcatctcagcagccaccgcacaacacccctggtgaaagacacgccctcctcccctctggtcacacaacgagaacatcttccagtctgcctct

SEQ ID NO: 506532 - DNA, 361 bp, Homo sapiens
catatgatatatcatttcatcccttcctcattaggatgcatcgggacgcgttatctatgggctcaggcctctgagcttctgtcatagttgttcctggtctttaatagggtccatccaactcacagacctaattaaaggaggaaatgggacataagtccaataagtaaaattttgagttgcttttacagtaggggggcttaccggcacatgttagtaccaccatcatagccaccattaggttactagttgttattgatttgttctgtgctctcagattgtcctctgccatctgtgccagtttcctgatttgtccccatgttggagggtctgcctggtgagtattctcggtcttttcctttgt

SEQ ID NO: 506533 - DNA, 178 bp, Homo sapiens
atgcatagttgaggactacggatatgtttaatggatgggaggcttagtggaaaggctgatagctggtgggttccgtggggcctgctgtgtgggtcaggatggaggtcctgggtgggctaacgcgtgagccccagcactaggtgggaaggctgctgaggtctctcccacccctgaggag

SEQ ID NO: 506534 - DNA, 129 bp, Homo sapiens
tgagcttacttctctgatcgcttttctctgatcggtatctctgatcgctctttctctgatcgccttttctctgatcgctctctgatcgcttttctctgatcgctcccccccccccccgtattcgaggcc

SEQ ID NO: 506535 - DNA, 153 bp, Homo sapiens
gcaatcctattctagagtccactatcaacaatatgaggttggcgaccctctcatgtatgtatcaggacatccctgatagtgcagccgccattaaaggttcgtttgttcaacgattaaagtcctcacgtcttgcacttgacactctttgtggag

SEQ ID NO: 506536 - DNA, 181 bp, Homo sapiens
  misc_feature (170)..(170): n is a, c, g, or t
  misc_feature (181)..(181): n is a, c, g, or t
attcactcaaccggctgcttctgcatttattgccttttttctttttctctgcttctaaggggtggtggccaccactgtttagaatgaccctgggaacagtgaacgtagagaatgtttttagcagagtttgtgaccaaagtcagagtggatcatggtggtttggcagcagngttggtgaatn

SEQ ID NO: 506537 - DNA, 323 bp, Homo sapiens
atcgtagtgtgtggtaggtagagtgaagtctggtgggctctccaggtgcatagaggggcggcggcagtgtatggagatttctgaggcagcgatttgaaagacgtgtgttggaggaagctgtcatcgtggtggtggggaccggaatgagctcagttccacgacagttatgttcgagggcggccggaacattgtgggaggcattaagggtcatggtgtggacaatgtcgtgggctggaactcgggtttcctggtctgggaacctaacaaggtggccccacgactggaggctgtgactgatgaccacattcggatgcacaaggtgc

SEQ ID NO: 506538 - DNA, 379 bp, Homo sapiens
agtgaggaaaggtgcctcacgcctgcaaccaggagcagggggccaacgtcctgggggcaattgggtaacagcgctcagaactcaaactgaccctacctttgaccagctatttcccttctgatctaacagcagcctctgtgagcacgcagggcacacgcacaggaggttcactctcttaagagctaaaaacgacaggccgtccaagtgtccacaaacatcagacaccaaaacaaagggaggtgagccaatgcggcggctcacaaaactaccagaaagatctgtcggctctgtgtgtactgacataaaaaatactgcagacataaataaaaaagcaagctgcccccacgatatgcaattgacaagaaaagaggataggaca

SEQ ID NO: 506539 - DNA, 654 bp, Homo sapiens
aattcggccattatggtcgagtgatgtgagcacgaccagtttgcgacatttgagacccgatggatcggcagggctgactcgtatgaaccgactagatagacaacggtaccgtacatgcctaagcgctccatgagcgtccctccaggagctgcccactagaacgaagaggatgagcatcctgaatatggtaggacactgatcgccaacagggataaagcggttaaatgcattagcagcataagttctagacacatacgtattactctcataatgaggatcagaaacgtgagctcaccatagcgtactagaacacgaccgaacagaatacactcaagcactagttatcaacattcaactgggagcctacgttaccctaatacaagtctcagtacacttagaggctgccttcaccattttcgacggcatctacggcttaacattaattgttgccacagaatcccatgccctaaacgacaatgcgtcaattttcgtcagtatcgtgctaatcacggaagtaatacttcacttaacattcacagatctagctggtgttataactagtcgactgatactagcgtttcgtagaagcgccttgactagcccccgaagaactcatctattggcgagggcctctgtcggcccgcttggcccagc

SEQ ID NO: 506540 - DNA, 233 bp, Homo sapiens
attactcacagttacccccaataaccaactccaggtgctgcctctgacccctcctgtggtggtgacccatggggtgcagattgtgcactccagcggagaagctgtttcaagaagtaccggtccggcagacatccgcacctaaccaccacccccggcccagaatcacacacactcatatttcccagccgcttcctcatgtaggcctgccttccccggaccacagacacgctgct

SEQ ID NO: 506541 - DNA, 323 bp, Homo sapiens
cccttcggagcaggacctcgctcctgtatcggtgcgatcctggcccgcataggagctcttcctcatcatggcctgtgctgctgcagaggttcgacctggaggtgccagacgatgggcagctgccctccctggcaggcatccccaaggtggtctttctgatcgcctctttcaacgtgccgctcatggtgcgccaggtcgggagggcagcccaggctgcgggtaggccctaacggctgtaactcacagcccctgtccaccctatgtggccccagaacacagattacgacatacaaccccgcacccttctccgccattcttcccta

SEQ ID NO: 506542 - DNA, 495 bp, Homo sapiens
  misc_feature (137)..(137): n is a, c, g, or t
  misc_feature (165)..(165): n is a, c, g, or t
aagtccttcctagaggttaatgaagaaggctcagaagctgctgctgtctccaggaatgattgccaatttagttagggatggctgtgcctgtatccctccaagtttattggtcggacccatcccatttttcctttccntatccaggaaaccagggaggaacctggntacaattcctattccatgggacggagtcatgccatccctggaaaccaatgaaccaccaagtggacatgattccgaagaacctttaagttactttattggaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcactgtgtttgtgtgctgttgtttaaaataaaagtacctattgaacatga

SEQ ID NO: 506543 - DNA, 152 bp, Homo sapiens
ttttttaaaaaaaggggggaaattttttcccaaagggggttttttttgttttttggggggggttcccccttttaaaaaaccaaggggggggtttcctaaaggggggtttttaagggatgggcccttaaaaaaaccccttttttcccgggcca

SEQ ID NO: 506544 - DNA, 176 bp, Homo sapiens
  misc_feature (115)..(115): n is a, c, g, or t
attccttcctccaccagtacacaggatctttcaagaagccccattgcggagaccacacagtgttatttggagggagccttggctcctttcatggcaatgcccagaaatggaagcngattagatattgttcatgaaaatctaaaaatgggatcagatggtgagagttaccagcttac

SEQ ID NO: 506545 - DNA, 423 bp, Homo sapiens
ctaacatgccaggtcccctggcagcctagaaatggtgagagtgccgggtccgacatcccgagaaggggaaggggctgattggaaccggtgggaagtggctgtggcgggactccggcctccccgcagtcagctccacaatctgcgcctggagttctttcccatctcggcctcagtctccttcagccataagatggcgaatgcgctgactgcgggaccctgggcgacctgtctcctccatgcgctgtgactgtgccctggcctggagccctctctgggccgctctgcacccgcatggccgcgtctctccgagattgtgcagggaccacgggaggggcgtcaggggagaatcctgactccggatgcgggttcatgaatgggaagagctttggtccagtgaggtttccagtccctcttttcttctgt

SEQ ID NO: 506546 - DNA, 440 bp, Homo sapiens
  misc_feature (39)..(39): n is a, c, g, or t
  misc_feature (168)..(168): n is a, c, g, or t
  misc_feature (385)..(385): n is a, c, g, or t
  misc_feature (421)..(421): n is a, c, g, or t
cctgaggacccgacggctcacggaacttgcataaagttntggggtcatccacatatagcatgtatcagcacctcattcctttttataactgaagagcactccgctgtatagattatttttttccattcatcaaatgatgggcaactgggttgcttccaaatttttttngtgagacagagttttactctcgtggccaggctggagtgcaatgacatgatcttggctcactgcaacctctgcctccaaagctcaagcaatcctcccacctttctacctccctcgtagctgggactgcaggcatgtgattcccaagcctgtctaaatttggtggctgtagtagtacttttcgtagagatgaggtttcatcatgtggcctaggttattngtattacttctactgtatataaagaaaagttccgtngaagccgtcgggtaccgag

SEQ ID NO: 506547 - DNA, 445 bp, Homo sapiens
agtcaagtatgtcttatcggcagatgaaaacggactaatacagtaaatggtacaggagtgggatgttctgaaaagatacctgaaaatgtggaaacgactttggaactgggtaataggcagaggttggaacagttttgagggctcagaaaaagacaggaaaatgtggaaaagcttggacctttctagagacctgtcgacatggctttgccaaaaactgctgactactgatctggacagaggggaatgcacatcacgtgtgggacgggacacagactgctgcagaacatggacaagcagagggaactgcacactcacgtgtgggacgggaccagaggacgctgcagacaatggaccgggcagacgggacatgcaccttcagctgctgtgacgggacccgagcgagcagcacgggaacagacaggggactccctctagacgtcgaccc

SEQ ID NO: 506548 - DNA, 748 bp, Homo sapiens
  misc_feature (166)..(166): n is a, c, g, or t
cttaattcgaaggttaatgcgtgtccaacaaaggcaagattaaagaagcctggatttcacgtgtcaaagccagaaaagccattaccatttgtctacatgaaactttgatcctgaaagcatgggctgatactaagaccaaaggtcgatacgggcgtaatactctagnatggtatagtagaaacagtgatgcagcgactatgcgtgggtgttataaaactgatcaaactctaggcgtttgctgcagtgtctaggacatgctgatgactcagagtgactatgagaagtatcggtgacgagtgtttggatctaatggtctcagcaaggaatgttgggttagaaaagtattataactcatcatcaatcatgatatagtatgactggcatcctcaagctgtatgccattatttttaggttcataatatgagcatctaagtgataaaacctttagattccatattgtgctcagaagattgcgtttcttctgcagatctctagtaaaaaaagatctcttccatattcagctgacagaatagcatgttcattttagttttcagcactgaacataagtgggtcaacataaatgtttatactaaatactgacttcaacataatacaaagcactttctttatctttcagaaactgaatatacacagcaagttttttttcaaaatattttcataggctaaggattaaaaacgattttaattatacacatatggtcacaattttgccttaaaaagattgttg

SEQ ID NO: 506549 - DNA, 976 bp, Homo sapiens
gatccgagccctgtggtgagatctgtgagctgcgcctgacgtgtggcaccatgatcagctcaggtgggacgcccggggcttccgccagctctgcgccgcccgcgcatgaagtagggcatgacgttgtgtggtaccgctggctgttgttgactgtctggggtgctgggggggcggtcgtcttgcgtctgagtcattcgtgggcctcttcgaactgcagtcatgcattccatcctcttgaacatcgctggtcggctgtgtggactgattgatggctggctcgttcccagtcggtcgagtcatgcgcatgacccgtgaccacgcgtgctgggacaagcagccaatcgtactttgcatacaggggtgtgcttgttacgggactcatctggctcgtgggcagaaaatgggcggatgcgactcctccgtagtgccaggatcctaggcgagtcaatgacgtttcacgcgaggctgtgattgacgtgagaacgctctggcgtaagaccctgtgaagggggagctgtgaagtggcttggcgtcgacccctccactcgccctgtctctctcattctagagtctctgtagtagggttccaaggtgatggcttgacacgtgttcctccgcttgatggcaccagcctgagagagaggtgtctaatgcggcgtgtcgctaacccgtggaagtcgtcatgctccgtcttgttccagatcttgggtagacgacccaggatggcactgggctcgtcgttgtgaggggtctcgcggctgctggacgttgaggcatagctgcttggttgttgtgttgtacctaggcagggcctagtcttcttgtggggggccttccatccaaagcccatgacgggctgcttgtcccttttgacttgggagggttccctggagttgggccctgttagggggggtttggaccgtccttgcttggggggtccgctttttcgtggcctcgctcaggtcttattcccagg

SEQ ID NO: 506550 - DNA, 768 bp, Homo sapiens
ggcctgtggcagtcttatgcactattttttttttaccacacagcttcttggttgacaagagtgtatgcacaataataacgagggatgacagatagaacacgcacgcggtgcctttggtagagcaccgtaagggttcggcaaaagtgagcacaattgcctgcggatatattaacactacattacagacaaagactaatgctggcctcctaaatgattcggataccactatgtaaagtactcctataccattattcctcgccagctgttaactagcagcattgtacttgtatgttccactttatatatggacatactacacacggtcatgccttgcacaaaccgttagttatggtctcttataattcgacagttaacaatataatgatattgtcttgttaagcttggcgtgccctatataacatgtagtacaaaattgttctggttataacttgaagatatggggttagctttacactggggtactctcaaatttacgctatcaatgcagtagtgcaagagcataatcatcagtctatattgattatcgggaggctatcattggtcgaatcgcctcgtgcgcttcttttaaactcatcggtctagtctatccaccctggagttacactcaatttcgtatatatcgctttctaaacatgtgcacatatatcaaagttacggagtaatacggaatggctggctcacttggttgtattgccactgtaataaacatattggatctgtttcgggtctagaagacacgacaacacg

SEQ ID NO: 506551 - DNA, 114 bp, Homo sapiens
ttacgagatgacaacctccctgagaatgaagacagtccagggagccaggcgtgggtcatgcctgtggtctcagctactggggaggctggggtgagaggactgcctcagcccggg

SEQ ID NO: 506552 - DNA, 955 bp, Homo sapiens
  misc_feature (12)..(12): n is a, c, g, or t
  misc_feature (71)..(71): n is a, c, g, or t
  misc_feature (98)..(98): n is a, c, g, or t
  misc_feature (109)..(109): n is a, c, g, or t
  misc_feature (152)..(152): n is a, c, g, or t
  misc_feature (157)..(158): n is a, c, g, or t
  misc_feature (179)..(179): n is a, c, g, or t
  misc_feature (182)..(182): n is a, c, g, or t
  misc_feature (195)..(195): n is a, c, g, or t
  misc_feature (201)..(201): n is a, c, g, or t
  misc_feature (228)..(228): n is a, c, g, or t
  misc_feature (240)..(240): n is a, c, g, or t
  misc_feature (248)..(248): n is a, c, g, or t
  misc_feature (322)..(323): n is a, c, g, or t
  misc_feature (329)..(329): n is a, c, g, or t
  misc_feature (332)..(332): n is a, c, g, or t
  misc_feature (349)..(349): n is a, c, g, or t
  misc_feature (351)..(351): n is a, c, g, or t
  misc_feature (360)..(360): n is a, c, g, or t
  misc_feature (365)..(365): n is a, c, g, or t
  misc_feature (370)..(370): n is a, c, g, or t
  misc_feature (379)..(379): n is a, c, g, or t
  misc_feature (430)..(430): n is a, c, g, or t
  misc_feature (433)..(433): n is a, c, g, or t
  misc_feature (436)..(436): n is a, c, g, or t
  misc_feature (441)..(441): n is a, c, g, or t
  misc_feature (446)..(446): n is a, c, g, or t
  misc_feature (448)..(448): n is a, c, g, or t
  misc_feature (462)..(462): n is a, c, g, or t
  misc_feature (469)..(469): n is a, c, g, or t
  misc_feature (476)..(476): n is a, c, g, or t
  misc_feature (480)..(480): n is a, c, g, or t
  misc_feature (491)..(491): n is a, c, g, or t
  misc_feature (498)..(499): n is a, c, g, or t
  misc_feature (512)..(512): n is a, c, g, or t
  misc_feature (537)..(537): n is a, c, g, or t
  misc_feature (575)..(575): n is a, c, g, or t
  misc_feature (587)..(587): n is a, c, g, or t
  misc_feature (621)..(621): n is a, c, g, or t
  misc_feature (626)..(626): n is a, c, g, or t
  misc_feature (671)..(671): n is a, c, g, or t
  misc_feature (687)..(687): n is a, c, g, or t
  misc_feature (790)..(790): n is a, c, g, or t
  misc_feature (928)..(928): n is a, c, g, or t
ctcggtgccccncccacccgtttctccccccccgcccgctccgtacccccccccccttccccgcctccccntcccccccccccccccccccccccctncccccctttgncccctgtcccccccttcccccttgctgccttcccgtctgtggnctatnntcccgccccttcacaccccanccnccccccccgcccncttccnccgcccccttcctgccccccgtccctncccccctgaccntgtcgacncccccccccccgggggcccccatgtcccctccccccctggccccctgccccccttcccctgtccctgcctggcnncccccnccncctgtctggcgcccccncnggccccccnccccncggcncctcccctncctgggtcccccccccccccccccccccctccccccccccccccccccgcntgnctngcggnccccncngcgcctggcgcccnccccccncctttgnctgnccacccccctnccccccnnccccgggccgccntcccccccccccctgcccgtgtccnggctcccccccccccccgggcccccctcccccccccgncttccccccccncccccccgccccgctgggctgccccgccgggccntcttncgcgtgtccccctccttctggcttctcgcgccgcggcccccctcntccacctcctcggccngccacccatctcccgcctggtggctctgctagtcaggggacttggaacagagaaagaggactcttgctttgagctcctccacagagctgttggacactttganttgaggaaaaatggcaccatgccacgagaggtggccagagacccgcagctatgtgaaaaactgactgttctgtgctcagctccaggaactctaaaaacactcgctcgctatgccgtgcgccgtagcctggggactccngtatctccccgatgcagtgaagggcct

SEQ ID NO: 506553 - DNA, 936 bp, Homo sapiens
  misc_feature (40)..(40): n is a, c, g, or t
  misc_feature (84)..(84): n is a, c, g, or t
  misc_feature (107)..(107): n is a, c, g, or t
  misc_feature (111)..(111): n is a, c, g, or t
  misc_feature (155)..(155): n is a, c, g, or t
  misc_feature (159)..(159): n is a, c, g, or t
  misc_feature (168)..(169): n is a, c, g, or t
  misc_feature (172)..(173): n is a, c, g, or t
  misc_feature (198)..(198): n is a, c, g, or t
  misc_feature (207)..(207): n is a, c, g, or t
  misc_feature (231)..(231): n is a, c, g, or t
  misc_feature (243)..(243): n is a, c, g, or t
  misc_feature (253)..(253): n is a, c, g, or t
  misc_feature (258)..(258): n is a, c, g, or t
  misc_feature (279)..(279): n is a, c, g, or t
  misc_feature (281)..(281): n is a, c, g, or t
  misc_feature (288)..(288): n is a, c, g, or t
  misc_feature (324)..(325): n is a, c, g, or t
  misc_feature (334)..(334): n is a, c, g, or t
  misc_feature (341)..(341): n is a, c, g, or t
  misc_feature (343)..(343): n is a, c, g, or t
  misc_feature (363)..(364): n is a, c, g, or t
  misc_feature (369)..(369): n is a, c, g, or t
  misc_feature (386)..(386): n is a, c, g, or t
  misc_feature (393)..(393): n is a, c, g, or t
  misc_feature (397)..(397): n is a, c, g, or t
  misc_feature (419)..(419): n is a, c, g, or t
  misc_feature (445)..(445): n is a, c, g, or t
  misc_feature (450)..(450): n is a, c, g, or t
  misc_feature (457)..(457): n is a, c, g, or t
  misc_feature (521)..(521): n is a, c, g, or t
ttcctccggaagtgcggcacccagaggcggtcctgtagcngggccggcttggggcttggttctatgtccctgcgggtcggtgcnagggcgaagaggaacccgtgggnctcnggggatcccggggggccggaccagtgttccctagttgtgggagnagangcgtgggcnnatnncgggcgggcagggcctgaagtgcangtgcgggcngtggaccctggcgggggctgggangacaggcgtggngtcccggcantgaancgggttctagaggcgcaggancnggtaggngaggccggtggccctgggcccggagtctgcaggccnngctcctgtnctgccgntnagggacccggttaccaaccnncatgncgctcagtttgcccatntgtcccngtgntaacacacagttctcgggagangttccccattcccagaggagtagtgngaaangcgtgcncctctagtcttaaacttggcgtttgtattagttgggtttcctggtgtctctttagcaagtgaantttctggttccctccttcactgtgtgacctgcctagtcctcctgggtcgcatttacagaagtttatacgagacctagtttccagggaagaactcactgattccgcgagggagatggcttaatggatgatggtcgtcagccttaaggatacttcagtcttaactgtgtgttacaaagtttgaaagggagggttccctatgaataagaagcacacttgaaagaacagcatctgggtctaatctctcactgggtgcttcagaggaggaaccacaggtccccaggtgaagatccccggttttccttgctcagggaaataataattctactccctagaatgcccaggattggcaagactaggtgatagtaaaaggtttggacgaactttcagaaggtgaagggaattcagttaaaagacg

SEQ ID NO: 506554 - DNA, 858 bp, Homo sapiens
  misc_feature (76)..(76): n is a, c, g, or t
  misc_feature (91)..(91): n is a, c, g, or t
ctacaccacactacaatatataaatctgcatgatgtttatatatccgcgacgcaaaagcttgagtggcagccgcanccactagattcatgnagctatatacgaatgtcacagaagctgcaaagagtccaaatggattggtggtagtttctatatttataaaagtatctgattcatcaaacccatttcttaatcgaatgctcaacagagatactattacaagaataacatataaaaatgatgcatatttactacaggggcttaatatataggaactatatccaaagacctgtagtttgatcactcaagatgggtatatgactattccaccctgctatgagacaacaagtccgaccataatgaacaaactccgtctatatatccaacatgcacattctttccttgctcttgctcacatacaaccactcaccccatatctttattatcctgattgaccccttcaggccccgaccactatactaaatcacctgccccctcccgtacatctcacttcatccgccggttaaggacttgtcctaacaccccaccccaaaatttcatgaacccccccatatgaacggatccctacacagtgaacaatgtgttgaacatcgtctacactatcgttatctcacctctcggtccgtctcgtaaccacgaagtaacacgcccctcaccctaatttcttataatcaccaacccccgtaactttatagtcatcgcacatcaactaaccgatactcctctactttacacaagaccacaaaacgcatccatcacaacactctatatccatccctccgctgctcttatcatttttctttatcacccacgtctcacgtaatacccgcacgcgcacg

SEQ ID NO: 506555 - DNA, 1128 bp, Homo sapiens
  misc_feature (12)..(12): n is a, c, g, or t
gtccggctgcgngcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctggggggggagtcgtcgccgccgccgccaccgttaccgccgcgcgcgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggcttttttttttttaaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggatttttgggagtccgaaggtatccatctgcagaaattgaggcccaaattggaatttggattcaagtggattctaaatactttgcttatcttgaagagagaagcttcataaggaataaacaagttgaatagagaaaacactgatggataataggcatttaaggggtcttttaatgtgtatctgctgtgaaacatttcaagatttattgattatatttttcactttccccatcacactcacacgcacgctcacactttttatttgccataatgaaccgtccagcccctgtggagatctcctatgagaacatgcgttttctgataactcacaaccctaccaatgctactctaaaaaagttcacagaggaacttaagaagtatggagtgacgactttggttcgagtttgtgatgctacatat

SEQ ID NO: 506556 - DNA, 883 bp, Homo sapiens
  misc_feature (12)..(12): n is a, c, g, or t
gtccggctgcgngcgcagcggtggtggtggcggcgcgatcggccgggctgtaaccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggcttttttttttttaaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggatttttgggagtccgaaggtatccatctgcagaaattgaggcccaaattggaatttggattcaagtggattctaaatactttgcttatcttgaagagagaagcttcataaggaataaacaagttgaatagagaaaacactgatggataataggcatttaaggggtcttttaatgtgtatctgctgtgaaacatttcaagatttattgattatatttttcactttccccatcacactcacacgcacgctcacactttttatttgccataatgaaccgtccagcccctgtggagatctcctatgagaacatgcgttttctgataactcacaaccctaccaatgctactctaaaaaagttcacagaggaacttaagaagtatggagtgacgactttggttcgagtttgtgatgctacatat

SEQ ID NO: 506557 - DNA, 752 bp, Homo sapiens
gggtaagctaaaatataaaaaaaaattttaaaaaaaaaaaaaaaaaaaaaaaaaaaaaaagaaaaaaaaaaaaaaaaaaaaaaaaaaaaaaaaaaaaaaaaaaaaaaaaaaaaaaggaaaaaaaaaaaaaaaaaaaaaaaaaaaaacttttgggcccctttgccccatccaattttaaattgggcaaactttttgcaggggcccaaatttgggcctaattggccaaattccccctatagggggccgtttacaatttaattggccgccttttaaaaactttgaaactggaaaaacccggggtttcccaaattaaatccctttgaaaaaaatccccttttccccagttggcaaatattcaaaaagcccccaaccaatcccctttccaaaaatttgccaaccctaatgggcaattgaaaattgtaacctttaatttttggaaaaaattccggaaaaatttgtgaaaaaccacctatattttaacccattgggccaaaatggggaaaacccttttaaactaaaagaatttcccccaaaaagggttaaattttttccaaattggaacaagagagcccttttaaaaaacacggacttcaacgttcaaagggcaaaaaaccgttttaaagggcaatggcccccttcggaaccttccccttaacaagttcttttggggctaagtgccccaaaagccttaaatggacaccctaaaggggccccccgttttaaaatctttccggggaaccccccctttgcct

SEQ ID NO: 506558 - DNA, 173 bp, Homo sapiens
tgctgggattacaggcatgagccaccccaggcccagctggaattttgtaacttagaaaaaaaaagttacagtgttggtccttacccattatgtgcccagtgaggtctacctggccaggtagacctagcatgatctttctggctccactcagtgtctaaggcaccctgcttcct

SEQ ID NO: 506559 - DNA, 221 bp, Homo sapiens
  misc_feature (182)..(182): n is a, c, g, or t
tccaggtcatactaaatatttattttcgggcaaacggacttcggagtaattctggacccaggaggggaagcggtatagggtccaaatggcggagacatcttagggtcaaaaacgctaccaagaaaacgaaatcaccttggaaacacacaaggacctcaagaggcagtacacccctgtgccangcaatctccaaagagctggaggagggctctcgagtcgcc

SEQ ID NO: 506560 - DNA, 238 bp, Homo sapiens
caaatgtaatatccctcagagatatattttaggcacaccaaacagagttatagtcgagattaaatggcattttaaaaatcttggagatcagactgtctgcctactatttacactattccatacaaccgacgaaagaagagttctctaattatttcctaaaattatgacagtccacattttagaatcctgacgtgcctgttcgttcatttatagatgaattatcttatgaaaacagggc

SEQ ID NO: 506561 - DNA, 955 bp, Homo sapiens
gcttgattatgcttcttaaatcagtactgttttcatgtgagctaacatttgccttctgagaacaagtttggatattaacttccatttaggccaggcacggtggctcacgcctgtaatcccaacactttggggaggccaagacgagtggatcacgaggtcaggagttcaagaccagcctgggcaagatgctgaaaccctgtctctactaaaaataaaaaaattagctgggctacttgggaggctgaggctggagaatcgcttgaacccgggaggtggaggttgcagtgagccgagattgcccagcctaggtgacagagcgaggctccacctcaaaaaaaaaaaaaaaaaaaaaaaaaaaaaaaaaaaaaaaaaaaaaaagggggggggggcaaattccccgaggggggccccagtgtttgccggtgtaccccatttttttttagcaaggggggcccccatataggggagggtgtaattataagcgacgggcgccggggcgcggggttaaaccaaggtcgtgggcggggacgacacggtccgcgcgggcacacttttgtgagagggaacctcattcgtgtgtgcgggcgctgccattttgtcgccccccctcccagaggaaattttaggggtccagggtacaatttacacttggcgcttcttgcggcgtcttcacccccgtctatttccttgcgggctgagaaaaattccgccacgggttgttctttcgcacgacctttccgaccgcgtctactatacaaacagaacaagatatcacaacccgagtgatactacagtgaagtatgtagatgcgtaaatcaatgaagcctacaggaagatggtactgagactatagtaactcagctattaaacacgcaagaaaaatagcaagggaggacagcacaaaacatctcgctataaacaagagacggacgatcaatgacatatctattaccat

SEQ ID NO: 506562 - DNA, 425 bp, Homo sapiens
acggctgcgggggcgtcggctccgatcggcgcttcggccgcgcatggcgcgtcggcggtcgaaagcacgccggcggcgcctgccgcgggtgccagcgggccgcatgtctggagcggtgcgattcagtcggcaccgtcgtccgcgagcgaggccgcggttcagtcgatgccgggcagccaggtttcgggtgtgcacgacccggcaggcgcggcgcctgccacgggcgcgtcgcaaccgcgcccgtcgagcctgcagcaattgctggcgctgaagaatcgcgtgctgatggaattgcagaagcacggcatcggcaagcaggctacgacgaccggcgtcgcgcctgcgcccgctccggtgcccgccgcaccgcgtccggcagcgaatgacacgagtgcgccggccgctgcgtcgacggcaggcgaacc

SEQ ID NO: 506563 - DNA, 787 bp, Homo sapiens
tagggaacttgcccccggtggtgtgaggtgcaggtggagcacccagacaagcgcctccaacatgctctgtctgtgcctgtacgtgccggtccatcgtgggaagcccaaacacgatattccagatacttatgaagtacgaaagggggctccctgccgaagctgatatgtccaataatacaatgcatcaggtgtcttacaatcccactcccaggaattctccacctaccagccagttgagaacgcacagaaaactgtgtcacacaggcttggaagataaaggaccctataaatggcgaagcctaagacttatgaaaagaaattttgtccatataatcctcacaaaagaatcatgagaggaaaaagaaggcatagaagcgctgggggatgttacaaacagtgtttggtgacacaacacaagaaattgaatggcgaccgcattttagaacagccgcaagcgagagactcaatcgccagctccccagtagagagaggacctcggggaccgtcaacaagactacttcatagaccacggcagggcaagaaaaacaaaatctcctccaaagagtcgactgttgactatacaaaaacggggaaccatagtgaaaccagtcgtaagtggggaaacacgccatgattgtgaagaagaaacataaccaacactcttttcacaaccctctggatgataaaaacagatatcccccgaaaaataactcactacaatgttgaaaacaattcaacggaaacatatcgaagcttcgtgtgaaaatctaaggggcaccatgaatct

SEQ ID NO: 506564 - DNA, 266 bp, Homo sapiens
gctcgacgagggagacagggagagagaacggccagctccacctcagacagcctagagaccgacaccaaggctctggctctgcatcaactgggccctggtatcctggaggccctgaccggtggtgtaggaggaggaacacgcgcggtggcactggttcatgtccgggagggggagataagatagaagatgaaaagcgtcggcgctggcaccggtccctttgagacgggctgattgacggcacgtttcctccttccctttggtcgacg

SEQ ID NO: 506565 - DNA, 444 bp, Homo sapiens
aggcagcgcctcgatctcggcgtgaacaatgtcttctactgcacaggtcgagcaagcgatcgcctctcgcgggctcggggttcgatagcgctgtcaggctcctgtcggaacacttccgttggccgacagagaaaagcttggagtttggcctgctcggagttttttcagaaaaacacctatgaacttggcgtcgacttcacctcaaaaaaaaggcggggggcggacaataagtcgtgggtcaaggcgaccggaagaaatggcgacaccgtttatgaaattgacttgaaagcagctgctatcagcgtggtgccagcttctgaattaacaacaaaacgagagcggctagccaacaaaacgttcaagacggaacacttcaatcccaaggccgtgaatgaggctgcccttggcccgaaaaaccaggcgggcttatcgacgccgcccatc

SEQ ID NO: 506566 - DNA, 456 bp, Homo sapiens
agcggggtcccggcagcggctcggggcgggcggaggaggggccgagggcggggcggccgcagcctccgccattcccgggccggggggaccgcacagcgaggaactcgagcacgagcgcaccgcgacaccgcaacaaataaccacgaccaacaccgcacgcacaacaaatagcacaaaaaacaaccacatacacacaaaccaccacaaacaaccaccaaacaacaaaaaaccaacacccacacaaacgcacagaaagcggcacaaaacaacaacacagaagaagcaccgctaagagagcagagaaagaacgacaggagaaaaacaaaaagagagcggagaaacgcagaagcgtagacaaggaaaaaaaagcaaccgggaagcagaaagaaggaaggacaacgcgacacacgacacaaaccaaaaagaaaaggacacaaaggacacaacaaaaaaaaa

SEQ ID NO: 506567 - DNA, 403 bp, Homo sapiens
attggaaattatgagacactcttggcagggggactgggggctcaggagagtactacccaccagggggagcttctggggaccttggatgcgcactgtttcaggcagttgcctcggtttgggccgccgagggaacaggccttcgctgaatttttctacagtcagcttcctctttttagcaggctatcgtgccagcagctttttctaaaactagactttggcttgcgctcagaagcccgagtgggtggcaagcgccgaattcccaagtttggttcgagcgctttgaaggccagaggtgctgttccggggatgctggcaggcgcctctggccagggactagggacgtggccacctgaggtgtatactacttgacacctcaggtgtatactacttggggatccgttca

SEQ ID NO: 506568 - DNA, 166 bp, Homo sapiens
caacttctcattcttatttcacatataaagtaatatgcctcatatccccctcacacagtaagacaccttacaataaaaattatcttatttgttgttatatttaacttctcatatagcacattgtcttgtccaatgtagagactcagatttgtagaagcaagggaag

SEQ ID NO: 506569 - DNA, 204 bp, Homo sapiens
tccgcgactcttacctcatcctcatgctgttcactggacctcttaacaccagctcccatctcattctcaccctcacccttttggccagctggctaccattctcccacttgacacgacaaggaaaccaaggccctgcacgacagggcctgaccttctgtggcgccatgtgaccctggtaccagtacagggtctctgacttctgca

SEQ ID NO: 506570 - DNA, 218 bp, Homo sapiens
gaatttgcgtatttatgtgccaaggagaagaatcctcatacagtagctgaaaagttagtacagaccttgtgcacttgaatagcacaaattagttttggaccagatgcacaaaaaagcttcagcaggtaaccttatcagatgatgtgatccatctagaattgatgaatgagccaggatatctacagcagtcctggaggatcaagccagtcctttaaaga

SEQ ID NO: 506571 - DNA, 330 bp, Homo sapiens
cacgaggggaaatgttcgccgagatcaagatggacctcggcgatcgcggcgcgcagggcaaccacaccgacgtggtgacgctggacgcgacgctgctgggcatcgaaaccaccgacagccagcatgtggccagcgtgcgcttcagcggcatgatccgcgagaacgagggcgaggccgcccagccgttcgccgaggtgtggaacctggccaagccggccagcggcgccggcggctgggtgctggcggggatccagcaggaatcctgagttcgccgatgaactgctgattgagccaaagcgcgggtgcggcgtgatgtgcccggcgctggct

SEQ ID NO: 506572 - DNA, 207 bp, Homo sapiens
  misc_feature (36)..(36): n is a, c, g, or t
  misc_feature (49)..(49): n is a, c, g, or t
  misc_feature (79)..(79): n is a, c, g, or t
agccatatttgaaccaaaaacatatctataacaaantaatattgaaaanctaagcatgtataactgatgttgttagaantcaattttaggaggcttttttagtttgcttaaatggcaaggactagtgaactggtgctgtgtcattatttcctatatctgatacggtaacagtggttttaatcaaccataataagcattaaatctcta

SEQ ID NO: 506573 - DNA, 835 bp, Homo sapiens
  misc_feature (396)..(396): n is a, c, g, or t
  misc_feature (466)..(466): n is a, c, g, or t
  misc_feature (560)..(562): n is a, c, g, or t
gctcctgacaagtggggattgcgggcgcccgccaccacgccctggctaattttttgtttagtagaggtggagtttcaccatgttggccgggctggtcttgaacccctgacctcaggtgaccaccccctcccagcctcccaaagtgctgggattacaggcgtgagccaccacacccagcttacgcctggttaactcttaatgaccaaaatcaaagtatggatgaaaaagacgagaatctgggaagtcacattgctgaggtctgagagtcatgactccactgtcaccggggaggcccagcagagggcagcacctggatgatgagacccagttcaggaggcgcagcacagagcggtcaccatccttccccggttcaccgggaagcttgctccccctccntctgtattcctggcaaatgacaacgggcaaagcgaagcgtgggccaaggacggaggaggcggtgccgcgngtctgccgtggtcacaagccacagaagtttgcttcactcctgccagaaaccggcaggacagtagaattctcttttaaagcacgtgttgaccagnnngtgtataacatgagattacacccgttactgcaaacgacaaaatataacttgttaaaatgaagcttccaatgaaccagacgggataaacacagcaaaaacatcccgggggcagtctattgtgcgggggggcgaaacaagcgcgtatcaagcaggcgcgcggtgcacacaagggttccgcgaccgagtttttgtgtcacaggggggagaatccgcgggccccataaggagggacatacatgccaaggccggtgtacccgctttgactgcggaaag

SEQ ID NO: 506574 - DNA, 198 bp, Homo sapiens
cgaaaacaaaatcgaacataggtataaaaggtaaaatatatgatacaaggtacacagaaccgtgaggtatacacggaatacacacaatgcatgtaagtagttagcctaggcatagccctaaaggatgacggcctgatagtagagccatttctcaaaatacagtatatatggtatacccagtttaaccacctaatttca

SEQ ID NO: 506575 - DNA, 322 bp, Homo sapiens
cggcgacgctagagagatccccttcattcaggccaagtatcagtatctcagtggagtagatacattaaattaaccaccgcagcattatgatttatcgcatcaattcattcactcatgtatttatggaacctctgtcttgtatttcatctgctgaactaatataaagagctctcagataattatctagctgcgtggaacattacatccaaattcctctctttaagaatagttttggacatgggctgggaagaaagtcttagcatgttcaaaacagaattcttgatttccaccacccatcacctgccacatttgcctgaatgaa

SEQ ID NO: 506576 - DNA, 150 bp, Homo sapiens
cagtcatctagagatccctgtggagacggggtccaaaaactccgtggggcgataatccttccgcctcagcctcctgagtagctagaatgactttttctttttctcttttggagatggagtctggctctgtcacccagccgggagtgcagt

SEQ ID NO: 506577 - DNA, 769 bp, Homo sapiens
  misc_feature (97)..(97): n is a, c, g, or t
acccgccccgcccgcgcgtcggcccccacagtcgcctgggggtggcccggagagtcgaggtgctcatagtggagccctggctcccgggcggacgganccgcacggtagtagatgggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcggcttcgggctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcaggggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttaccatctttaacctggcctggcgacactctggtcctgctgacgctgcc

SEQ ID NO: 506578 - DNA, 727 bp, Homo sapiens
cgagcaggtggggcgggtcgtggcgggggcagggtcccctccggaggcgccctgggttagagtctgggcgtggacgcgcccctcataggggtcattggggcatagaggcatagagccggcttctccagcttgggattcacgtgtttttcaaagggctaacggaaatgctgagatctaaaagcatgtttattgctgccaaggcctgatgatgaaacttcaagtcaaattacttcgggctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaccgtacagagtggatttgcagggcagtggcatggagcccctcttccccgcgccgttctgggaggttatctacggcagccaccttcaggggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttaccatctttaacctggcctggcgacactctggtcctgctgacgctgcc

SEQ ID NO: 506579 - DNA, 599 bp, Homo sapiens
aaacgcgaaatggaagtagtttgtatttatttttacttcggtccccaatccaaatattcgaagcggtgcacacgaataagaacattttacttaacacaagggttggcttactttgcccaagaaaataacatctgtcaagtaggaccttccttatcaaaacctgaacgccccttcgctctaaaaagtatccctactcccctatcctcaaccggactaactcatccacctcacttgcacttctctcctctcccttcccgcaccactgccaatgtctaccgccgcacttccgtctcgctaccacttcccccaccccccaatcacccccccttcatttcctccccctcctcactcgcgcacaaattttcccgttcaccatcctcaactattatcacggtcgcactcttcccactctcacccgtccggccaaccacccgccttcacaaatataaagcctcttcctactcccccactcttctttttctaacctctctttcccattgccccctcatcctcccactatttccacacacttccttgcaacttcactttcttctccctctccctctctctcccttcccctcttctacctactcctactc

SEQ ID NO: 506580 - DNA, 618 bp, Homo sapiens
  misc_feature (97)..(97): n is a, c, g, or t
acccgccccgcccgcgcgtcggcccccacagtcgcctgggggtggcccggagagtcgaggtgctcatagtggagccctggctcccgggcggacgganccgcacggtagtagatgggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcgggtaccgtacagagtggatttgcagggcagtggcatggagcccctcttccccgcgccgttctgggaggttatctacggcagccaccttcaggggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggcacaccaaaatgaagacagccaccaatatttaccatctttaacctggcctggcgacactctggtcctgctgacgctgcc

SEQ ID NO: 506581 - DNA, 139 bp, Homo sapiens
tgcgaagagtgtgcggagcaatgatgtgggcttaggatgttcaaactgtcattttatttgtacgatgatagataccaggagtagcgcgactgaagagcagtagattaggcgtaggtagaaggagagcctaaagagcggg

SEQ ID NO: 506582 - DNA, 664 bp, Homo sapiens
cattgcatatgtgctaactctggagatcccaggatggtcgatagggatagtactaaccattttagatgcagccgcagaaccgtctttgctctctggaatggatacctgattgggcggaaaggaagcatgcattgtagcatagcaagatgccattgtgggagacaaaagtggctacttcccatgtgcagtccttgtgcagccccgacagtcctacagcgtcaagctgatcatgaacggcttagagctttccgaagatatgactgaccttctaacactcggatgggccggctcatctgcgaattggagaactatactattgtgagcaacatgaagacattgtcctacgataagcctgcgcagattaaccaagcgaacctggcgccgtagctttgatagagcatgtaggccgaatcggtccggcgctttggactcgtgcatgcttaagcctgcccagctaatccgagcgtactaggtcagagcaccttggaccgagtcgcatcacatgcgctgctcgccgtcaacagcccggtgtcttgaagatcccggatggtcctgaatagcctcaggtaaaccgcttgttgcaactcgcttaatccgattggcactgaccgatggcctgcccaaagggccctccaccatggccacgccttgcagcctttttggt

SEQ ID NO: 506583 - DNA, 330 bp, Homo sapiens
acaatggagcgcggaacaatcacttttgatgaacatttatttagtaattgttttgatctgaattatccctaatttctagtatggttactcatactataacatagtatactagtacttctatttgtataactacttaataaatttatgtacattttctaaaggacaatgtatctttttactatactagaatcttataacaattctttatagtacgatgttaatattatacaagccataattttctgcaaattcatcacttatttatcttttactacataaagtatttaaatatttatttagtcaaagataaataagtgattgttccccgct

SEQ ID NO: 506584 - DNA, 477 bp, Homo sapiens
  misc_feature (4)..(4): n is a, c, g, or t
  misc_feature (48)..(48): n is a, c, g, or t
  misc_feature (69)..(69): n is a, c, g, or t
  misc_feature (105)..(105): n is a, c, g, or t
  misc_feature (294)..(294): n is a, c, g, or t
  misc_feature (345)..(345): n is a, c, g, or t
tgcnggaatttccgcgcgaggtgctctcttggaaaaaagtccgacaantgtaagaaccagatggggtantgtaatccagagagggtggaaattcctaagaaagantccaaaaagaaatgctagagctgaaaaacacggtaacagaaatgaagaatgcctttgatgggctcattagcaacctaggacacagctgaggaaggaatctctgcgcttgagaatatgtcactagaaacttccaaaactgagaagcaaagaggaaaaaagaccgaggagtgtgggggaaagagcagaatntccaagaactgcgggacatctacaaaacctataacatgcacagtgagagtnccagaaagagaagaaaaagacaaaggaacacaaaccatgtttaaagtaataatgacttagaatttccccgaattaatgtcagacacagatccaggaagctcagagaacacaagtaggttacatgcaaaaaaa

SEQ ID NO: 506585 - DNA, 527 bp, Homo sapiens
gaagaggggtcatcctggaggctcttagcgatgcaccataactcgccaggtggcagcgtgtttgagtgtgccggcctttcggagtcagtgacgtttctgtactctcttccgtcagaaccctgaggtctgtcttgtgctcagagtgggtcttttgctcatggacatgatttggtaacacacacgggggttgtttggaaatattgttacatggagttgtttttttttctaaatgttaacacattccattatgtaaacttgaagaaaatcctattttttaatgtcatcactgatctcatcagaagaaaaagtgagaaactgtcaaattagcagtagtagagaaaagttttccaaaattctaattttctcttgaaagcttggattttatcattggtaacaaatactgtcagttactttctgtgaagtgagggacgcagtgtgttcattttcaagtcaatttctgccagataccaaattcttaataaccaaagttggtcagttgttctttcaaataaaaatggcattccatg

SEQ ID NO: 506586 - DNA, 163 bp, Homo sapiens
aatctcaggcaaaaacagctttccgacattctttgaggacatggtggtggcaccaagcaggcacgtccgggtggcatcaagggtgttggcaggcaggctcctctgacttggtttccaccacacccatcagtcaattctaggcaggatggttcggcttttccaa

SEQ ID NO: 506587 - DNA, 281 bp, Homo sapiens
aagttttctataaactccatccaggtgatgcggatcacttgagtgccaggagttcaatgactagcctggtcaacatgctgaaaccccgtctctactaaacacacacacacacacacacacacacacacacacacacacacaatagggaaggaaacttgatttgggaagggcggtctaacataaagctttgggtgaaggatttatgtgtgtgtgtatatagccatatactctatctgtgtgtgtcattacaagctatcaccattgtcgtgaggggcatcgca

SEQ ID NO: 506588 - DNA, 124 bp, Homo sapiens
tctagaggatccgctagtttagagtatgggcagtactattgaccagctgatggggctcgacatgggcttagggagtcataagtggagtcgtaaagaggtatctttactataaaaagctattgtg

SEQ ID NO: 506589 - DNA, 202 bp, Homo sapiens
tctaatgtttgctggcaaaacaaagggacagaagagcaggatattcaaaaggcagaaccaaatcttccactgccgtcatgatgaacattaaatgttctatttcagagcagagcaggggatacatggatgcttcctggagtggagggggaaggggacaagggagtcacctggtacactttattaacctgagcacaaacatcag

SEQ ID NO: 506590 - DNA, 155 bp, Homo sapiens
cacgcttgatgcttatgagagcggcaagctggtgaattcggcggtttcgaccaccggtaaactggccgatttatctgcgcaatcggccccgatttatgtcggcggaggttttgccggaggtgaggtcggcgcatgctatggcaccttgcgcgagg

SEQ ID NO: 506591 - DNA, 587 bp, Homo sapiens
  misc_feature (16)..(16): n is a, c, g, or t
  misc_feature (496)..(496): n is a, c, g, or t
tatagaggatcccgtnacggtaccaacacgtagtagtaagagacttgtggtgtctgctgctctgaattcagttccgaggctgtgagttgaactctgtacaaatgtctggatgatctggggaatattggttgggtgtgtgtaaattcgtccacaaagaaggagtggtctctggcggggtgagtggaatgacttctagctcctcttgggcagcccaggcaacgcctatcgcataggtgatcactcccttcagatgggcagccatggctgggatccggacgtcgtcgtaggacctcccgtcggtgatgaggatcattaacttcctcttgttgggcttggacttcttgaagagctgctccagggcgaagttgatggcagcccccgtgctggtgccaccactccagtagcccaccctcttgatggcgttgaggatgtcaggcttgctgctgtacttgtcgaacccaaactccagccgctgttcgtaggtgtactgcacggncccgatgcgcgtgtccgtgtcggaaatctcaaactctttggtgaggttggcacaaactggaggacggtgcggaagttgcccgtccccacac

SEQ ID NO: 506592 - DNA, 160 bp, Homo sapiens
gcaatacggggaaatcgtcgagtagactgacgagaaattggtatctgtagctttaaggtgccacatatccatattaaatgcattcttatctgaaattaaatctaacttatagcaggagtaagtctttactgcttacagtagagaagtacttgagatctgt

SEQ ID NO: 506593 - DNA, 100 bp, Homo sapiens
cgcatcagagcttcacagtggccagagtacccctacaaatagagccagtgctgagcaatcagacgtattcagatgcatttagccactttagatgctatgc

SEQ ID NO: 506594 - DNA, 449 bp, Homo sapiens
gatccccagatgcacttcgtagacttaaccttttaaagacattaccatttgttgcgcctggcacagttgtgctcatgcctatcatcccatactactttggtaggctgcggttgcggatgagcagagatcgtgccattgcactccagcctgggcaacaagaacaaaactccatttctgaaataaaaaaatcatatagaatagttcaaatgttatgctggcttattaacaatgcttagtacgtatgtactcagcgtaagacagatttctttcaaccatactcattttacctatcgggcactagatttaagatctctacaaatattgaaactttttaacatctttaatagcaacagatatttgaagctctcatgattaattatctcttatcaatgatccatggtaaggtcagtaatatttgaaatgctaaccagttcccacttttttcaaaa

SEQ ID NO: 506595 - DNA, 880 bp, Homo sapiens
  misc_feature (880)..(880): n is a, c, g, or t
tcaatataatctatgtcataatttagttttcaccaatatttatcattcattgatgccctccgtctggatagattaagagactggagtggtgtttggtgccagcctattcctgctgctttcattgacagtcttcatcattgtgagcgtaacagcctacattgcctaggccctgctctctgtagaccatcatctttaggatatacaagggtagtgatccaatgctatccaaatattaaatgaatgccacctatttagggcaatatctggaatctagagttgtcttatctaaggagttggttaacaatacctacaatatattcttttttttcatgtaaacttgtattatttaggatctgttgctcttattctaagatggtgaaatagaaaattttctaaaggagcaaatatttcattattatttgtacttattactaatacaggcgtaactagcatatgggtcatacacaataaaaattcattgtaaagtaattccaatgcgtgttttaaacggttatttttatgtgtgttggtaaactaatatcatatgagttatatactaactaaatttatcgagtaacaggctatttaattcatatttttattctattgaatctatttttttatctgactgtgatttctaccgtatttcttcttgtatttgcgttcgtttttactataataatcactcctgtattaatttctatagtacttaaaaacttctatgttcacccgtccttacggttgttctctcctatttcacattaataatttattctctatcacatactctttatatatacgatttttcttttaatataacatatcatctatttcaatatatttattctaacgtctatctgagactcataagtaatatcan

SEQ ID NO: 506596 - DNA, 898 bp, Homo sapiens
gaggatccagacccgggagaaggaccagagctggaggagctgggtgtggggtgcgttagggctaggatggggaggcctagatttgggtgcaagtacggtctgacttgacgcttgtgttgtgctgaacgggacagccctgggtctaggggagagagtccctgagatgtgagacccgaacttaccccggtcccagccaccatcccaagatccccacagggcacggccaaatacacaggtacaccgacagcaaccatggactgcaagaacaaccgaagagtacgaatacgaacagtgacaggcctagagcagacgacactgggcgccaacagcactggcggaaccaggccccaaaacacaccaccagcgagcacatggacccaatggacaacgtggtggacctcacaggagcagcgaaccgtcccacagcaaacgacaacccgaatagaaaaaaaaccacaaagggcaggaaccccgaacgaacagatgcaccagacaagacaggatgaccgcaaaagaagagggcacgacgaacccaaaaaacacgagacaagaaaataggcacaaacagcaaaagcgtagacaccaaccaggagagcacgcgaacgaccaaggaacacggaaaggacacaaaagcccgaggagaacaccgcagacgcaagagatggaccccatacaccaagggagaacgcagaacaaaagccaaggaccaagaatccagaaccacggacgcaaaaaaagaccacacgcaaggccggcggacccgagcacaaaaaaacgagacacaccaaacatacccggaaactaacaacacatcccagaacgtaacacaccgcagaaaaaacacacacagaggacccaagcagccggcaccaacaaacggccaccaccccagacacaa

SEQ ID NO: 506597 - DNA, 936 bp, Homo sapiens
  misc_feature (45)..(45): n is a, c, g, or t
  misc_feature (76)..(76): n is a, c, g, or t
  misc_feature (85)..(85): n is a, c, g, or t
  misc_feature (89)..(89): n is a, c, g, or t
  misc_feature (105)..(105): n is a, c, g, or t
  misc_feature (110)..(110): n is a, c, g, or t
  misc_feature (126)..(126): n is a, c, g, or t
  misc_feature (185)..(185): n is a, c, g, or t
  misc_feature (196)..(196): n is a, c, g, or t
  misc_feature (200)..(200): n is a, c, g, or t
  misc_feature (214)..(214): n is a, c, g, or t
  misc_feature (234)..(236): n is a, c, g, or t
  misc_feature (239)..(239): n is a, c, g, or t
  misc_feature (243)..(243): n is a, c, g, or t
  misc_feature (246)..(247): n is a, c, g, or t
  misc_feature (249)..(249): n is a, c, g, or t
  misc_feature (252)..(252): n is a, c, g, or t
  misc_feature (260)..(262): n is a, c, g, or t
  misc_feature (323)..(323): n is a, c, g, or t
  misc_feature (331)..(331): n is a, c, g, or t
  misc_feature (430)..(430): n is a, c, g, or t
  misc_feature (444)..(444): n is a, c, g, or t
  misc_feature (447)..(447): n is a, c, g, or t
  misc_feature (451)..(451): n is a, c, g, or t
  misc_feature (466)..(466): n is a, c, g, or t
  misc_feature (485)..(485): n is a, c, g, or t
  misc_feature (511)..(512): n is a, c, g, or t
  misc_feature (521)..(521): n is a, c, g, or t
  misc_feature (524)..(524): n is a, c, g, or t
  misc_feature (671)..(671): n is a, c, g, or t
  misc_feature (824)..(824): n is a, c, g, or t
  misc_feature (826)..(826): n is a, c, g, or t
  misc_feature (831)..(831): n is a, c, g, or t
  misc_feature (864)..(865): n is a, c, g, or t
  misc_feature (894)..(894): n is a, c, g, or t
ctactcttctggctacacactttatcagctttagaactgaaagtncctccactcatgggtcacaatcacaatttcnagggttaanaacnatctattcttaaatgntacantgttttagagcatcangtcactgcagttattcagttctgggagactgtcgatttattttagcatttacatatganatttatttaanaganacacaaagcaagcnaacaggtaaagatgcttatnnnggntgtnganntngtnaggttttnnnttgttttttaagataataaccaaaataaccaaaaattattatgatccggtacaggaaaaanaggaagantcaagtgaatactagagctgcaagtgtttcttagaattgaaacaaaaattgtttttttccaacttgttcaaattttgtctaagtgcaggtgagaaaaanagtaaatatattangtnaacnaattatttttttaanagtgcaatttatgtttaanataacaaataaacaacaacaacaaannacgcaaaangcnaaccagatccccaaaggcaaaatgtgtagagagacaagggtggtgatggaatgacctactttgtgatgtttttacgctttacaaaaagcagatttggtattcagaaaagcctgcaaatacaacattgcttaagagaacctgtaaacncgtttggaatacaatgcaacacaagtcagcaaggacaggggtaggtccaaaggagccagctagggggaaaggtgacagaaaaggagagggaaggatggagacagacatcgcctgtggtctctaagggggccatgtgtttaatttataaggttncnccccncaggagttctgatgtgatctatcgttcataaannacatttctcctcttgcaaagtagaatagnctttaagtttcccaatgactttttgagtttatagggctcttt

SEQ ID NO: 506598 - DNA, 908 bp, Homo sapiens
ggaagaagcccaaaaactctgggagcaatataaggaagaacgcaaaagaggctctgccagcagaaaagaaacagaacactggctcaaagaaagagcaataaaaataagagtggaagaaccagtttcatcagaggtggtggccatagaggaggtgaaggattcaatatgcgtggtgaaattacagaggaggagcccctgaaaatcgtggggatatacataggaggggcaaaaatgcaacagagaggtggtggaggatggaggaagtggtggcatcggatatacgatagccctcgtgacccatgatattccgtggccgtggtaagttaactcaagcagaggggaatagaaaagaggtggaaatgcccgaacagacggggaacgtaccaacgcaggaaccctctcagcaggcacaggaggaacccaaatcgtgtgctacaaatacactccaatcttcagggctacacacacagacgccagcgacgcggtccaaaaccttggcgcgtcagacagcccatgggcgtcacgggattaatcaccgaaggactctatcgacataccccaaataaaacagaaaaagtataccatattgctccacagacccttcacaaagaagttgccggtttgctatgacgtagcgctcacctaataaaaaatgccagaagaggaagtgccggcgggtacctatacagaacagcatggggggatgaaacgcggccataacacccgaccacgcaactagcagggtacacagcgaaccggaagaaaacccagcagtgcacgaaacggaaggggccagaatcagggccacaacccccgcacatcacacagagcacacccacccagaacctggctccacgagcaacaacgaacgccccccacacaaacggggagaggacaaaaacataact

SEQ ID NO: 506599 - DNA, 259 bp, Homo sapiens
atacctcaagggttctcttgtttatcgaggtttttgggcttgtggtttcggcagccagttctggtgactcagtccccagctatagttccagtaagaactaaaaaacgtttcacacctcctatttatcaccctaaatttaaacagaaagggggtttatgcacatcccgaaagcaggattggttatcccccagaaaatcggaccgtccatacatctgcctgtacagctggtatattgatgcctatgtccccctagggttat

SEQ ID NO: 506600 - DNA, 466 bp, Homo sapiens
tgacatagaagccatgagagaaataaacattgtaatgacatatatcgttgaactaggtgtgatgttagctgttgatgctgtaattgctgaactttacaaggccagtcttatacctgtgaccaccccttgtaagaaatggcacaggtaaggacttaacatgttacacgttttttaaaaaaaatttaattggcatgtgtgatttctgttttacccttggatcgacagccaagtgtcagaattaacagatactagcccaatcatcaagtcttagaatcatgtgtatcttactgctaaaacctttgaaaggaattatgaccataatggttggtcattgagttctacatgtggtcgtcatgtcagttctacatggcctgctaaacactggattcataatgattcgtgaacactgtccttagccatggctcaaagggtgcctaaagtttccgtcaatccggtatgagagtca

SEQ ID NO: 506601 - DNA, 184 bp, Homo sapiens
  misc_feature (28)..(28): n is a, c, g, or t
agcatcagtagtagtgtgtgctcatcgngcagctgacgctcagccatcactctccgacattgctgaggttgcaccccacggcggctcgatgtgaacgccagattgccgatctctcaccactgatcagagcgcgctccatcaccaggccgggctgcttctcctcgccatcactctggatggctca

SEQ ID NO: 506602 - DNA, 451 bp, Homo sapiens
gagaagtttattctctctgatgagcaaagaaggtggtttcttgaaatggaatctactctgggtgaagatggtgtgaacattgttgaaatgacaacagaagatagagaatgttacataaacttagttgagaaagaggcgtcagtatttgagaggagtgactccaattttgaatgctgttctacttaggtaaaatgctatcaaacagcatcgcatgctacagataaatcttttgtgaaaggaagagtcaatcaatgtggcaagatttgttgttgtcctattttacgaaattggcacagccacgccagcctttggcaaccaccattctgatcagtcagcagccattgacatcaaggcaagatgccctccatcagcaaagaaattatgactcactgaaagctcaggtgattttagcatgtatttggtaataaattattttttgattaaaaaaaaa

SEQ ID NO: 506603 - DNA, 124 bp, Homo sapiens
gtggcgaacacgtagtggccggacacgtataggagtacctgagatgtagcagaaatggacacgtggacatgtttggagcagaaggtgtcctgcctggagagaggtaggtgtgtgtgtgtgtgtg

SEQ ID NO: 506604 - DNA, 175 bp, Homo sapiens
actcccagtgcggagtcttagactatcgtgtgttcagattttttaaagtcactttcgtagctcaatatattgtgtcaactggagtttttacaactcaggtgagttttagctttattggggagggggtgatctaaaacaccctttacgccggcttctattgacttggcttatcgag

SEQ ID NO: 506605 - DNA, 528 bp, Homo sapiens
tagatggttgcttcatctatgtggcgggcgcggattgcgtctggcgcgctttaatacccaggtggggactgccgacaagcactacttcattggcctggccagtccggctgcggcgggtgtggtagccggtatagtctgggcattcagcgactacggtatccagggttccaagatgtcgttcctggtggccttgatggttgcggcggccggcatgctgatggtcagcaatatcaagtacaacagcttcaaggagctggatctcaaagggcgtgtgccgtttgtggctatcctggcagtggtgctggtgtttgccgtggtcttcagtgatccgccgcgaatcctgctgctggctttccttgtgtatgccgcgtccggcccggtgcagtaccttctgcatcttcgtcagcgcaaaacgttgccttaatgtaatttcccccatactccgcagtctatgggtgcatctgtcctccaaagctgcggagttgccatgttactcaagtttcccaaagcgtcagattgccaagaatc

SEQ ID NO: 506606 - DNA, 209 bp, Homo sapiens
tgatcttgaggttccgtcagtatttccatgcaggctgagctcctgtcggcgtggaggtcggacacgtggcggaatggtctgcagcaccagacaccattgccaccagtgcctcaggaccgaggttgcctgtgaccagcaccttgtataggtcccggtagggctggcctgtggcttccctgggcacgtcttcgcccagtgcgcaatggtgg

SEQ ID NO: 506607 - DNA, 583 bp, Homo sapiens
agcggtgggggagcctggtgccccatcgggtaccgcacggctgccgcggctggcttaccctgccgcgagcgcctgtgacagcggcgccgctgatgctcgtctgacccggctccgggcctctgccgacctcaggggcaggaaagagtcgcccggcgggatgggcggtgaggctgggtgcgcggcggccgtgggtgccgagggccgcgtgaagagcctgggtctggtgttcgaggacgagcgcaagggctgctattccagcggcgagacagtggccgggcacgtgcgtgctggaggcgtcctgagccggtggccctgatgcgcgctgcgacactgtgaggcccaggggctgcgccaactgcgcctggggcccagagcacctgaccccgaagcctctggccagccgccgatgagcctgggctgtcatatctcggaaggtggacgtacctgaacgtgcgcctcagccatgcgggagcccccgagcggtgaaggcatcattttattacatgcctggaagaacatgaatttccatttcgctttcaacttccatcatgaacctatggtcaccatcgtctactgggaaata

SEQ ID NO: 506608 - DNA, 948 bp, Homo sapiens
gacagcctccaggcaggcagccacattatggggcactgtacccacctgggtccagtggacatgggcaacagccttaccaccgcccaataaatgacttcagcttggggaatcttgctctttgatgactcctgccttgacccgttctcttcctggcatgcacatgctctggcccagcagctggagcaattcaacatggagagcccatcaaccagcctggtgctggatccccctgccttttctgaaggtcctggatttttagggagtgagggatcaatgagtggcccccaggaccctcacgtcctcaaccaccagaacttgacccactgttcccgccatggctcaggacctaatatcatactcacaggagactcttccccaggtttctctaaggagattgcagcagccctggctggagtgcctggctttgaggtgtcagcatctgggttggagctgggcctggggctagaagatgagctgcgcatggagccactgggcctggaaggactaactatgctgagtgacccctgtgccctgctgcctgaccctgctgtggaggactcattccgtagtgatcggctacagtgaggggacctcactgcatccttcttcatggcctgtcccatcagtcttcatccctttcccctggcagtagagactactctctgcccccagatcctttttcttatatgaatgaaggatctaaactgaggaaggaaggggttggcaggggccctgaatgtgtatgtctgtgggctgggcgatccagggggctaaagcttgtactttgaaccgctgctggggcgaccctgtggacagcgtcaggaacttggcagggccaagggggacacacctattttcctggtgagaacgcgggttctaaattttttcacctagaagggggttcgcggcgccctagggagatatgggaatcctcacacctcggtataa

SEQ ID NO: 506609 - DNA, 271 bp, Homo sapiens
tgattggcatgtgactgtcctgtatgaccagatgaggaaattgaggctcaacgagggcctcaggtcacacagcaatggtgcgaaggcagctagtcccgagagcttgtggttggtttgcttctctcttgcctgggctacatgtgagtgacgcagtgggcagcccccgccctatcttcctgggtggcactggtgttggctctggtgggatgctcttgattcctgtgtaatttcctggagcagccctgcaccatgctagctcaaaatgcctttt

SEQ ID NO: 506610 - DNA, 387 bp, Homo sapiens
  misc_feature (12)..(12): n is a, c, g, or t
  misc_feature (32)..(32): n is a, c, g, or t
  misc_feature (82)..(82): n is a, c, g, or t
cccgacttttcnaaaaatttgattaaatggtnttatagtataatattgggaccccccataccgttagccccttgtatgtatncccaacactgcccaaagtaaaacattaggtcaggcatggtgcctcaggccctgtaatccccagcattttgggaggctgaggcaagtggataacttgaggtcatgagttcgaaaccagccctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaact

SEQ ID NO: 506611 - DNA, 219 bp, Homo sapiens
cagaggtgatatagggctagctatcagtcatcagtggatacgtactgtcacacagatcagattttcatgcattgtgtgcggctgctgctagatgataaaggaagttatctgtagctggtggaaatcgctttggcttaagcgcctccaaattaaggactctcttttctccatcagccgaaacttctgaaaatggtgctaggtcggtaaagatttctcttg

SEQ ID NO: 506612 - DNA, 308 bp, Homo sapiens
cgggtgcctgtaatcccagctactccagaggctgaggcagagaatcgcttgaaaaggggaggcggaggttgcagtgagccgagatcgcgcccctgcactccagcttggtctccgtctcaaaaaataaaaaataaaagtaaagtcatcaattctgttttcccctgtccttgccgagaagcaaaatgacatgaaaaggatagagaattgtgtctccgaagctgagtcttacccctttaccagagaaaagacacaactttgggaggccaaggcgggcggatggccaacatgatgaaaccttgtctctacca

SEQ ID NO: 506613 - DNA, 286 bp, Homo sapiens
ggggcagtatctctcacccagtctggagtgcaacagcgtggtctccgctcactgcaacctccacctcccagattcaaatgattcttgtgcctcagcctcctgagtagctgggactacaggcatgtgacactatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctc

SEQ ID NO: 506614 - DNA, 221 bp, Homo sapiens
  misc_feature (217)..(217): n is a, c, g, or t
cgagctcggtaccaccacgccacctgagaaggtccggaccgcgacgagttcggccgagatcaacgaatcctgatcgtcgagttgtactcgcgctgatcctgagggctggcccacgcaccgcggatggcgcggcgcgtgggcgtctgcctttcccggtcctggcgcgggaggatatcgccgggtggtccatcagccttatcggccttctccggtggcntggt

SEQ ID NO: 506615 - DNA, 242 bp, Homo sapiens
acctcgggaccggcacgaggcaagatccacctgaacacaggagagggagggtgaagcgggccgaaatcactccactgtactccagcctgggtgacagagagagactctgtcccaaaaaaaaaaaaaaaaaaaaattctaattctaaatttccaattaaaaagctggaaagggcaaaaaagcctaagaaaccaggtaactaatctaatttgggggggccaagtggaacacagtgagaatatcc

SEQ ID NO: 506616 - DNA, 228 bp, Homo sapiens
tgtttttgtttacctgtggcctgggccatgtcagtatcagctgaccttgcaggtcaacgaagagactagttgccatgggcatgaagcatgccaatgtgatcaatccctagtaaaaccctggacacctagcatgggtgagctactctggttggtaatactctgtgcacacatcattgtaccacacatcattgctggggaattaagcattatcctgagactctgccagga

SEQ ID NO: 506617 - DNA, 209 bp, Homo sapiens
accacaccagtttgctgcttcaagtttggtcatcttcccgccttttgttcaccttcaaggaaagaagggaagtctagagagcagtttctcccccaccccgtcaacctccactctccccatctcgtttcgtgaatcaaggtgcctaaatgaaaacataacgatcctcacatatcgtattttgtcggtctctagctctgtattgagtccat

SEQ ID NO: 506618 - DNA, 586 bp, Homo sapiens
gagtcagaggaccccgaactgtcgaggctatcaatcctttcattgctgaatttgatttgctagtcattttgttgaggatctttgcatcaatatccatcggagatcatggtctgaagttttctttttttgtggtgtccttgtctggcttggaatcagggtaaagctggcctcatggaatgagcttggaaatcgtcccctcctcttcatttttttggaagagtctcaggaggattggcgataattcttctttaaatgtttggtagcattctccgatgaagccatctggtcctgggctttactgtgtagggaggtttttgattactgatccaatctctctcattattggtctgatcagactttccatttcttcatgattcaatcttggtaggttgtgtgtctcctctagaaattggccatttcttctaggttattaaatttgtcaggcatacaattcttcataatattctcttataatcctttttatctctgtcgtataggtagtaatgtcccctctttcatttctgattgtagttattgaatgttctttttttttcttaatctagctaaggatttggcagtttggttt

SEQ ID NO: 506619 - DNA, 637 bp, Homo sapiens
ggacggcggggatggccggggtggccacagctgtgcgcgggggccgtggacacaggcggagctccggtcggtggagctcccccagcgcacgcgccagagtccgggtcagagacgccgcgtctgcggccaggggtcacgaatgcggcgcacatattcagccctcagcgtgctctttcccgagccgccgcgttgcgaggcggaaatcgccgcagtgggtcccgtggtcatccagatgccagagcgcaccgaccaagagggtggttgggaatggatctcacagtgagtggacaggtatcctggtcgtccgctgggaaatgctgaagactgtcgctctgctccgaatttccgtctatctaacactttcttgacctagctttccctgtgtggtgcggaccatgcagtgctttgggccccccgtttcccgctaagcctggacctgggcaaatggagcgaggtcccacttatgcgtctccttgtaatggcacggtgcgttcatccttcctctagggcaggaattccgcacagtgtgtctagtgttcctgggagtggccgtccatgttttatctggttcttgaaatgttgtgttactacagaaaataaaactgcgctactaggaataaaaaagaaatgaaagaaa

SEQ ID NO: 506620 - DNA, 171 bp, Homo sapiens
  misc_feature (84)..(84): n is a, c, g, or t
agcttccgggagctcctctcgcgtcaccctgcgggcctgcccgctgtgaccggccgtcgttttgccgccgtcgtgcctgggctnaccaaggccaggcggctaagggatttagagggccagggggccgttcgattccccccggagggttccaagatcgggcggggtttagcg

SEQ ID NO: 506621 - DNA, 1460 bp, Homo sapiens
taccaacgggtcaaaaaaaaccttaataacttttaatgatggccccttatgctttctggccaaatgccttgggaccaggtgcttccggggcggaacgcttttgggacccttctggagctttggggagcaggcgctggatttcctgggccgggggattttctggggcagaaaccttctggggtctgggacgcctttaaactccgcgggggtagatcttattatggtctgagaacttatagcagcatgcagcagcacgccagcagcgagcagagcaagagagaagcaagccgagagagaataccctttagatcccgaggtgtgcctttgttggggaagaaagccttactcaggagaagcgtgccttttgtgaaagctttcataaactctcataccgtagaataaatacctgtaccctcaataatttctatggcccttacgaataaatttacaaagaagcagactcaaaacattctgggtgtacactcatggggactatcacacctatcatatcacgggacatatacaaactcctgtgcgtgggcgccccaaattcgtgtggtgtgactgtggccccaaatgttgtagcaaatgaggaagtgttaaccgtggaccatcaccttgcaccaaagcgacatagctcggaacaacaattaactatcagtgggcagagagcaccactcgaggcgccggagacaaacaccctgtgccagagagacgtacaaacacctcgcaggggacaccgccgtgacccagtggcaccacgttggggaaacaaagggaccaagagggactccggggtatcaccaccacttcacacactgatgaagactgaacaacggggtccccatactcagcaaccacaagagaagccccccccggaggatgatcagggaaccacaaagaaaagccactaactaaacaagaagtcggggcggcaacccacaaagtgttgatccccgcgggagcatacgtagaagggggtcccacacagcgggagacaggcaacccatatgacggaggacaccacaccccgcgagggagaaacaaccgcactgtacccacaacggagaaaagggccggcccgatgagacaaccaacccactagatgggtgatggcggaccaccaaagcgacaggtggtcgtcccccaacaaaacgcaggagtttaggactacccgaacagaaatacccagcgaatccgaacacctgtagagaggggcgacaaacttgttaccacaaaaatggtcacgggaggaagcccccgtagaagatgttacccgcggcaaaaacatgaacagggcaagcgacagagagtaggtcacacaacagcagatactccgctaaggacgaagaaacgacaaacccccaacattatggtgggtggctgccacccacaacgtcgttggagcatcatcacggaagatgtggagaccaacgagactacgtctataactaacagag

SEQ ID NO: 506622 - DNA, 1130 bp, Homo sapiens
tatattctgtattttattactgaaatatgttgtcctactcatcccaccccacaataaaaatctgacccaggccccccatttctttccctcatccccttttccacacacaccatcccggaacaaggtgctccagggattcccgtgtcgccacgtggccatttgtggaggtgtgtccatgtgggttagcaagtggtggaaaccaccgagggcctttggtgggaagaaaatgggaggggggttagaggggatgtcccaggaggggcttattatggaggggccttggcgcacttggcgccataaggcagagctcagatgctcctcatcatctgggacacggtgggaacgcagaattcttacccgggctgtaggcattggcgccaagtaccgatagcactatcccggaaggcgctcggggatggtggaatccccggtactatcttgacaacaccacctgggactatggtggtaacttgggcaacaggttgcagtcacgccagggtgacgctcgtggccatccaaaaacttcctctgagagacaccttcatcttcagcacgggtttcatccacttcttctgggagggggggatgtcaccgtcaatgtgctcacaaccttcaggggcttccacggagtccctctctccagatggtcactcgaatgccaggatatggaactccagagtacgcgaacaccttggcgccatttgttcacgcccaactctcttggacacacgggtcacaacagcgtcacacacgagggaacccccgcagagagggccaccaggccccccacaaaaacaactcccacatcgcgaggcgcgttccgcggacaccaccggcggcacaacacacgagaggaaacaaccccacgggggaaaccacatacgcgcagagccccccacctagtgagacaggggggccaccccaagcgcgaccgaccgtgcgcagacaacaacacaccatccatgctgaagcgagcacacagtcatgacgcacgccgaacaaacaatacaatgcgggctgtcaacagggcgacaaacgacagaacgagacgacaacacaggtaagacaaacaactccagatcaataggcaactataattatatcttttttatctgacgtgcaccgcgcgg

SEQ ID NO: 506623 - DNA, 295 bp, Homo sapiens
  misc_feature (116)..(116): n is a, c, g, or t
  misc_feature (127)..(127): n is a, c, g, or t
  misc_feature (131)..(131): n is a, c, g, or t
  misc_feature (279)..(279): n is a, c, g, or t
cactgggaggcccgccagtgcagctccaccttctggcgggcttggggcagtcctgaagcattttgagggcgaatttctcctgggtcctcttgttgaagatctccaaaacttttccntttatccccancccnaaaacatagctgaaaaccccgaccccctctttcatggcgttcttcttgatctgcaggccggacttgacgtggaactgcggggactggtgcgggggcggcggcggcgtgcgccggggggtgcggcagggcaggggtgggggggtgcggncgcggggccggggggg

SEQ ID NO: 506624 - DNA, 284 bp, Homo sapiens
acctctccctactgtatctaccacgtagcctctatacacaggcatcagaatcgtacggtctctctcttcctaagggagcgagagctcaccattagagatgctactatccaagcctgaatgagacatgacagataataagcggaaaagttggtgaggcacagaggtacacagctgtagtcgcagtactgcgggaggcagaggcgggcagatcacggtgcaggtcaggagttcaagagcaggcaggctaatagtgaacatcctgtctctcaggatacagtagggag

SEQ ID NO: 506625 - DNA, 489 bp, Homo sapiens
ccctcccatgaagccctacggacggcgcaatgggatttggcttttgaagacctgggtgaccccctgacccaagaacttactggaagtgtgcctctgtgtctccttcctcgggggtaagggggggacagtgcttcccaagttccagctgcaagtccaacttaaccaactttccttcaaagtcagttacttccaattttttgaaaaaagcattttccctatactaagtctcttttctcacggttggaaattataccgcccaggtttgccgcctccttttcattgatgtagaaaattttgcggttggcccgaaaaatcctggccgcttttttccaggcatttgggtccctaaaaactggttttctaaaattattgggtttgtattttgttattaagggggaaaatgtgatttgtgcctgatctttcatctgtggtttttataagggctttgttttccgaaaaactaaaaataaaaggccttggctttaacca

SEQ ID NO: 506626 - DNA, 149 bp, Homo sapiens
tataggatcacgtgactctgaactgagcgtcctaccagaatcagcccaccatccttcaacgacaatgaagagaggttctgtacattggaaaacaccttacggagaactcccgcggtactacaagaacatcggtctgggcttcaagacac

SEQ ID NO: 506627 - DNA, 483 bp, Homo sapiens
  misc_feature (482)..(482): n is a, c, g, or t
tctagagcataccgacggcgggtgtactcctgttggagactctccctttcctttaatcacccagcctgtttcacctgaatggactctcccttagctaagagagccagacggagtccatctgggctttttcactgggcagcccgttcctcgaggacttaactggtgcaagctgactcccagcacatccaagaatgcaattaactgataagatactgtggcgagcaatatccgcaattctcaggaattcgtctgatggataatgcccagagccccaagtctatcacctggtaatggtcttaaagcccctgcacctggaactgtttactttcctgtaaccatttatccttttaacttctggcctactttatttctgtaaaatggttttaactagaccccccctcccttttctaaaccaaagtataaaagaaaatctagccccttcttcgggccgagagaatttggagtgttagctgtctctgggnc

SEQ ID NO: 506628 - DNA, 594 bp, Homo sapiens
atatccctccagcctggtgacagagtgagacccagtctcaaaaaaaagaaagaaagaaaaaaaagaaaagcaacccataaaaaggttggaaaaagaaaacagagaaacaaaaagcaaagaatagaaagcaaaaactaaaatggcagaaagcagaattaagccctaacatataaataactgcattaaatgtgaatgacctaaatacaccaattgaaaaacaaagattggcacagtggattaaaaaacaggatccaggctggctgtggtggatcatgcctgcaatcccagcactttgggaggccaaggcgggtgtatcaccgaggtcaggagtatgaaaccagcctggccaacatggtgaaatcctgtctctactaaaaatacaaaaattagccgggcatgctggcacgcacctgtaatctcagctactcgggaggctgaggcaaggagaattacttgaatccaagaggtagaggttgcagtgagccaaaatcactccactgcgctccagtgtaggagacagagcaagactctgtctcaaaacaaacaaacaaaaaaaaacaggatccactacaagaaatcacttcagttatatga

SEQ ID NO: 506629 - DNA, 264 bp, Homo sapiens
aggaacctcggttctgggaatgcccaaccccgtcccagaaaaatcatgaataatccacaccttgtttagtatataacaagaaatataataaccataaaaatgggcaaccagcagtcctcggggctgctctgcctatggagtagacattcttttattcttttactttcttaataaacttgctttcactttactttatggactcaccttgaatcctttcttgtgagagatccaagaaccctctcttggggtctcttggattgggag

SEQ ID NO: 506630 - DNA, 468 bp, Homo sapiens
gcggcgttctagaggatctcctccatatgtgtgaccagttcgataaatttcttgcccccacattagaggttatatagaatggacctatcaccattactttatgattaaaaaggagtaacatttctatttgaataaataaatcatagatctgacatacacagaaagaactgaaaaaaaaacagattttatataattagtggtaataaccagaaaaataaagttttaaagaattaatcaatatttctatttgggatgaactatggtcatttggttataatacttacacaaatgagtgtatctcttatatatagctactatctcaaaaacctatcttaagtgattctaatgcaaatttctattccagaaaacatcagtgtggtaaaaattatcagctttcatcactatttacccgcctttctacctactctaactctctgggttatgctcaatggtacttgagcatagtac

SEQ ID NO: 506631 - DNA, 193 bp, Homo sapiens
ttttaatttttttgccccccccccggttttgggttggttttcccaggttggggtttaggggatggtgggcttcccccctttttcctttaaaatggcaggtttgggaattcttgggggggggggggtcccccccttcccggttgtgggcgggggttggggtttaggcttcctttttttaccccccccggcccca

SEQ ID NO: 506632 - DNA, 933 bp, Homo sapiens
atgctgctctcgggacatgagggggaagtgtactgctgcaagtttcaccccaatggatccaccctggcttctgcaggatttgaccggctaatactgttgtggaacgtctatggagactgtgataactatgcgacgttgaagggacacagtggagcagtgatggagctgcactataacacagatggcagcatgctcttctcagcgtcgacagacaaaactgtggcggtgtgggatagtgaaactggggagagagtgaaaaggctaaaggggcatacttcctttgtgaactcctgttacccagccaggcggggcccccaacttgtctgtactggcagtgacgatggtacagttaagctttgggacatccggaagaaagcagctgtccagacatttcagaacacgtaccaggtgttggctgtgaccttcaatgacacgagcgatcagattatctctggtggaatagataatgacatcaaggtctgggacctacgccaaaacaagttaacctacaccatgagaggccatgcagactctgtaactggcctgagcttgagttctgaaggctcttatctcctgtccaatgcaatggacaacacagttcgtgtctgggatgtccggccatttgctcccaaagagagatgtgtgaagatatttcaaggaaatgtccacaactttgaaaagaacctcctgagatgttcctggtctccagatggaagcaagatagcagctggctcagcagacaggtttgtgtacgtgtgggacaccacaagccgaaggtcctgtacaagctgcctggtcacgctggctccatcaatgaagtggctttccaccccgacgagcccatcatcctctcagcatccagtgacaagaggctgtacatgggtgagatccagtgaagatggggaatggaaggctcccggctcccagccctga

SEQ ID NO: 506633 - DNA, 111 bp, Homo sapiens
ttaatcttagagcgaaagctatgatcactggccgctcataaggggctggcatggctcaggtttatatgatagttgggtggtgggtgtcaatgagtgaggccaggcccgaga

SEQ ID NO: 506634 - DNA, 150 bp, Homo sapiens
tatacataaactaaacgaacttaaatcatcatacattacttcatttatagcttgacttctagtaatcttagcttcattgatttggctgctatataaggagatactcctttgtcaggatgatttaaaagcataattcgtcgatgagcatct

SEQ ID NO: 506635 - DNA, 964 bp, Homo sapiens
  misc_feature (310)..(310): n is a, c, g, or t
tatggtaattcatccagcgagatcgttgtacagacgaatacacagatattgaccctatgttccttaatcacttgtactatcatcactgagtgtctcacactagtgccttcacgctgtcctaccttaaaatacctgtatcactgtaggtccctgaccggtctgtccaccatggactaaaagtgcatctcttatgtataaaaagatttcctgtcagacgtcaggatgtaccactaccgtgtagttggtattgcccttatgtgattaggaagttcatggccatggtcgtggctggcatcatagtccgtgtaantacgcaacgcagcgtttgcgagggccgacggtggacagtagatccacgtgtgatgcgtagagggagggttcgagacccagcaggccttggttcatccagtggatgaagtaatcctcatagcgtaatataagttactccccagaagataggtaataatgtagtgccagcgcgagtggctggcaaccactggctctgtactctcccaagggctgcccttgggtagggccttggagagtacgtgcagatattggcgtgcaatccctcggggaaggttggcaggcttggcccttgaagtccgagtattgggtgcccactgtaactttcccagacactggcctctaaacattagcggagacctcaccactctgccgaggttggacagggacactttcactggtgcctcgccgattttttgcactatagttgtccgtaacaagatgtcccatccgtgagagtcctgctctcacttcttactttgtgtcatggcatgcacggtgggggccggggccggcatggcagcaagggttgtttgcggatgtacactgcccggcccgtgtcatcggggtccgcctgggtccctctcaagacctttttgtggttttggctaagacttcggctgtttactcggcggggggggggtttgccctttgcccc

SEQ ID NO: 506636 - DNA, 257 bp, Homo sapiens
ctgactgagacgagatctgggtaggagatgacaagatcctggtaggtctgatgaggatgagcatggatggggcatagacttgtgtggagaagggaagagccacctgagcttctgggcctgagagtggaagctgagaaagaacagaggggctttctggcagatggagcagctttggcaaggggcacaggcagacatatctgggataaacctgaggccaggcctgagtgtggagacaaggtagatccgaggggtaccga

SEQ ID NO: 506637 - DNA, 434 bp, Homo sapiens
ttgagtctgcagatgtgccattgctgcgtcgggtgcgcatgtgtcctgggtcgtcacgtgttaggtttaggggagttctacttatctttgtttttttttatttttatttgtatcttattatctttttatttacatccttacttttcttcatcttacctactactctttacttcctttttttgatctctcttttcttctttctttctttcatttatttccttctctcttctttctcttaactttcctttcattctctttcattctttctctttatcatcttcctttttctttatttctcacttttattttcttttctctctcttttacatctcttccttcttcttcttcacttttctttctctcattctatcttttcctttctcttcttctctttatttctttaccttttttctctctcttttccttttttccct

SEQ ID NO: 506638 - DNA, 696 bp, Homo sapiens
ggggctgcaaatacctggtactgcagatgggcgccaccacatccagctaatttttttgtatttttgtttggttggttggtttttttgttttgttttgtttgtggagagacgggtttttgctgtttcccaggctattctaaagttctaggctctgcctgcatcagcctcccagggagctgggattacaggcgtgagccactgtgcccagcccttagaaataattttctccacctccattcctctgactcttggtttgtgcctcctctgaagaagcttccttgagtgagctctgcatgaataggtcttctttcccaaatgtaagctcttaaagagcaaggatcttgtccacatcaagctcttccttacctgccctcaagcggtgatgttcctcttcctcctttcctatggtttgcctcttctcatgcttcaggccccagcttaaacattacctccaatagagaacctttttctgaccaccatatttaaagtctccccttactattttttgtcacacaagactagttctttttcttcctaatgattcctaattaaagctacattgtttacaagtgattattgcctgtctcttcctctcttcctctaggccttaagctccctggggataaggaccatgtttgtttcgctcaccatccatactcagtgtctgcacagtactttgacactagagaacaccgg

SEQ ID NO: 506639 - DNA, 960 bp, Homo sapiens
  misc_feature (4)..(4): n is a, c, g, or t
tccnaaggagcagagcagaaagagcgaaagagaacagagcaaaaagatgtttcgcgccacacaacgggtaggagcaacaaacagtggaaggccccctcatattcgcgccgcgccgagtccgccccgtaccgggtattggcgaacgtagaaccggcaccaggtccacgagacggacagcttcgagattagggacgcgggggttgtccccggcggagggtccccgaacttcgtggactggaggaaccggcgccccgaatgttcccaccggcgctgcgcccccggaagggtccactacagggcggcccccaacagaacacaaatttgggtccgccgtgtgatatttttggttctttggccgggcgccccattgtgaagaagtgtggtgccgcagctgcgagaagccctgctccggtcatggtcacacggcaggaactctcctgtcgccatccttgcaagtccaggatcttcatcgggcctacaacaagagcctcctcccggttgtgtccacgaggcctgtcatgggcgccctcccttcatatgtgggcacgccccggggaggcacccgtttttcttgacgaatcttctcgcgcgggtaaccccgcagggttgtctgataaccctacggccgccctccccgcttcctgagattatattcaccgggtaacgccatgtgtcgagcgcgccattggtacgcgctctccagatgggtgtagctgattctcggggcatgtctcctgacgacgcacccgcgatatctccaacaacgccaatgacttctggccgccccgtaaagaaagacactggctgaccacccgcccaaaattcaagggtagagaggataaacccctgtcagtctgttgttttcttgtcccatggaattcaaaatggcgctgatgtctgagggggctcttaaagaggaaaaaaaaacaattttcccctgcccttagccccaccaaaaaa

SEQ ID NO: 506640 - DNA, 202 bp, Homo sapiens
tctacgacggctgaatggctccgcagctggcctcgttttggtcatgacaatggcttgggctgcaaagcacctggatcctagagtcttccttgtggctcttccaacagaggcagactttcagctggttagagatgtggttctgtgttcccttctgatcttcctgccagagggtgttgatacaagtctcaaaatcagttccagt

SEQ ID NO: 506641 - DNA, 131 bp, Homo sapiens
cctatgtatgttgaaagggtggtcgattgcgactgcagtgtggtggtgatgcgatgtactatatgagtctatgattagtggaagctacgtttttgatgcatttgtgtaggcgcactgttgcgacagagtgt

SEQ ID NO: 506642 - DNA, 584 bp, Homo sapiens
tgatatgtgttccgtcaataagggctttagtcagtatcgggattaggataaaaagtgggagggtgtgattcttcgtttcagttgaaaactctgaggagactgtagggttcattggcttaattgcaatattgttgtgtctcagggaatagggaggcctgaggtgagggagagagatggtggaacacatgcagcagtgatattctctgttttatatgggtgcagttagtggcacccccaaacaattacaatagatgactgatcaaagatgactgatcacaaatcactggaacagatataatgattatgaaaaaatgtgaaataccgaggagtaccaaaatgtgacacggagacacaagtgagcacatgctgttagaaagaatggcaatgaagacatgctcaactcaagattgctcaagatgcttcaacttgttaaaaaaaacaaaaaacaaacaaaaaaaaatataatatatacaaggctcaaaaaccaggtatgcctgtacagctttatataggagagcactagaaaaaaagctgaagtgtgctgaggggtagtgacgctccagacaaaagccagagcagagtgt

SEQ ID NO: 506643 - DNA, 1164 bp, Homo sapiens
agttgttacaatgatacagtgttggcctagtatctaaaattcttggttaaggagcttattgggctgagcactttcttaggggagaatttgtctctgtctaatttttattcgaaacgtacttcacttttccgaatattctttgtcaggtaatgttcaccttctgtatgatttgggctatatgggtgcttacgctgttactttttattttgtctctatagtagtttttccgggtaggaaggtttgctatttttaggctaattgaatttttattctgctatagaggtgccttaggtatgttatagtaaagtgccctttcctctcaaattatttggggttcaaattaagtttgttggttttgtttggattctaaattagtgtatatacatcaatggtgaatttgctttgggcagtgtgctaacatttgtaaatcgccgtagttaggaccatatggcagtggggtgtgatgtatattttaggcggtaggtgtttcgggattatatggggtatttgaaagttagatgggggtaggtctctgtagggaagtagcggtaggagtagtagtacaggataggaatcgttcctattttcagttggtagacagttctagtaattactacaccatactattatcatttgtattgaagcgtgtcctagtcaccagattgaggacaggttacttggcaacttccaaagacaatgtagcatgtacctaatcattcaaagattcaacttgattcagcaagattcatccataaacttgatattatatatatcatggatatagtctctgtaaatataagtgaaaatttaccatatatatgtgacagagtgaccatactatgaactatatatcgctagttggagaggatatggccactgattagtatttgcccaatgacagggttgccactaactttcaacttgtaaaaagagcagtatactgtgaaagacgcgtaaagtctagaaagcaataaaaatgatagtgtgtcccatgtatactcaactaagaccatagttcattgttaattaataaagcacctgtcaatttcagattgagtaatattgttatcaggaatgggtttgggagttatcgttcaaggcttttaccacgcagtctgtgggataaactaagtagttgtttacctggatctataaatacatata

SEQ ID NO: 506644 - DNA, 208 bp, Homo sapiens
ttgtggtatatatcacaaggaatactactcagccataaaaaagaatgacataatgccatttgcagcaacatggatggaactagagaatcacatactgagtgaaatgagtcagaaagacaaagacaaataccatatgatatcacttataactggaatctaatatccagcacaaaggaacatctcctcagaaaagaaaatcatggacttg

SEQ ID NO: 506645 - DNA, 264 bp, Homo sapiens
ttttttcccccccttttggggggccggggggggggtttcccggggtcggggattcaaccccttttgggttccccgggggaaccccctttttttttaaaaataaaaaaaatttcccccgggggggggggggggcccttttttcccccccctccaggggggggggggggggaatgggttttcccttggggggggggggtttcttttttttttttttttcccccccccccccccggggggccccagggtttttccccttttccccca

SEQ ID NO: 506646 - DNA, 632 bp, Homo sapiens
  misc_feature (5)..(5): n is a, c, g, or t
  misc_feature (68)..(68): n is a, c, g, or t
  misc_feature (77)..(77): n is a, c, g, or t
  misc_feature (100)..(100): n is a, c, g, or t
  misc_feature (105)..(105): n is a, c, g, or t
  misc_feature (110)..(110): n is a, c, g, or t
  misc_feature (159)..(159): n is a, c, g, or t
  misc_feature (171)..(171): n is a, c, g, or t
  misc_feature (174)..(174): n is a, c, g, or t
  misc_feature (215)..(215): n is a, c, g, or t
  misc_feature (229)..(229): n is a, c, g, or t
  misc_feature (240)..(240): n is a, c, g, or t
  misc_feature (252)..(252): n is a, c, g, or t
  misc_feature (279)..(279): n is a, c, g, or t
  misc_feature (282)..(282): n is a, c, g, or t
  misc_feature (321)..(321): n is a, c, g, or t
  misc_feature (343)..(343): n is a, c, g, or t
  misc_feature (345)..(345): n is a, c, g, or t
  misc_feature (351)..(351): n is a, c, g, or t
  misc_feature (401)..(401): n is a, c, g, or t
  misc_feature (410)..(410): n is a, c, g, or t
  misc_feature (446)..(446): n is a, c, g, or t
  misc_feature (452)..(452): n is a, c, g, or t
  misc_feature (461)..(461): n is a, c, g, or t
  misc_feature (521)..(521): n is a, c, g, or t
  misc_feature (523)..(523): n is a, c, g, or t
  misc_feature (598)..(598): n is a, c, g, or t
gggangagccgcttttcagccaccatgtctccaaattcatcagcattgaactgggggaagccccactnctttgagangctggatctcctggcggccaggnaactngaacntggccctgcgcagggcctcaatcacatgccccttgtcctgcagcctggngcggatggacanganaacttggccaatgtgaaccctggccacagtgccctggggcnttccaaaggcaccncgcatgcctgnctggagcctgtnagccccagcacaggacaacatcttgtngangcggatgacgtggaaggggtggagccgcacccggatatngaagccatccctgccacaactntntaccangtacttattggcacaaattcgggcagcctccagggcttcagaggacagcngcccatatncatctgagagcatgtggccacaaagcggaaactcanccactnttgcctttntccgccccaggcgcaaaaatgcgaatctcggcatcagggacacctcggcagaagcgagantntgggtacggcttgtacttacaataccggtaacaacgggcggggcggcggccatggcgacaccaggatcttcagtngcacacgaaggaaaagaggcgctcctccgcctgc

SEQ ID NO: 506647 - DNA, 284 bp, Homo sapiens
  misc_feature (213)..(213): n is a, c, g, or t
tgaaaaacaaaatgaaaccctcaaaaacagactgatttcagccaaacagcaactgggcatcttggttggttctaagtctttgctattgtgaatagtgctgcaataaacattttttttaataaagagacagacactaaacagctttgtgagctatacagtctctcttgcggtcactctactctgccactgtagtgcacagatatagacagtagntaaacaaatgatcctgggctgtgtttccagtaaaaactttttttgcaaagccaggcagttggctggaattt

SEQ ID NO: 506648 - DNA, 130 bp, Homo sapiens
ggagctgcacatgacaggtgaccctggaggtgggcaaggtgatccagcaacgtcggcagagcaaggggcttacgcagaaggaactgggcacgaaaatcaatgagaagccacaggtgatcgttgactatga

SEQ ID NO: 506649 - DNA, 556 bp, Homo sapiens
tggcgctacaggcctcctggcctctcatccacgtctggctcaggtctgatcagaaagggaatccaggtcccacctcacagtagcattggcagtctctgccccactcacccctcactgcctcctggacagacttcctgccccagctcccagcttggccaaccatcctctctctggcgactgcccccctccagcccccagcccggccccggaccctgcatggcctcccccagcctggcctcccctccccaccccatggccatgcccagactaccagccccttggggctccatctgaacactggggcaagggtcatgcccgcttggtccctccagtgcctgcccctcagtggagtgagcacagctctgctggcaggactgtggccggcgtcaggaataagcatgcagcgctctccccagggcctcccggaagaggggcaatgcttgcagctcccccctggagttacgaaagtgctctggaactagacgctggtgactgggcgatgctgtgaacgagccagtgccacagaactgtgcacctgaatgtgtgagttctgtcg

SEQ ID NO: 506650 - DNA, 211 bp, Homo sapiens
ccgcccgcgccacttttggttcactgtttgaaattaccacgagttttaaaatgccactcgttcacttaaagagaatccacgcggtattcacgagtttctggggtttttcactaattgtaattaattattaattccttatgggaatagttccaatgtacccacgaagaaaacttgacccttgctctggtttaacccgtaataggccccttga

SEQ ID NO: 506651 - DNA, 478 bp, Homo sapiens
agcggccgcattggagcacactcaaattgtaaagcatgagagacgaaaagacggatagatggcataattactttcttcccacatcccacaagattgtctggtatgtgcacctcactttgcgagcataaggtcatctaggtcagaagaaacttgctatccgcgcgatacaggagaatctgtagaagtagggtttaagattcgcggggatgccgaagggtatgggacactcactttggacatctaggtcaatcagagttactgcataatggctccccttctatttagcttccctttatgtatgggtctgtttagaccaggagcagcatgactcttgtatgttgccatagcagatcaaataggaaaaacaactaggttgacgaagttggtgcggaaggagctatttaagtcagaactctcagagtgacaaactcaacttccattagttttcccgacagtccatttattggctttcataaac

SEQ ID NO: 506652 - DNA, 236 bp, Homo sapiens
agtcttcctaattgacattcatacgctctatgatgtgtcaaacaagcacatgcacaaatgccagatgctgctatgaagagtgggttatctagaaagcatcccttgatgacagccctgtgtggacagtacaatattttttcatcatccttggtttcactgcgatatgagataaaacgcaagataaatttttcttagcgaccacctctacttatcactctgtctttgctggtgagaag

SEQ ID NO: 506653 - DNA, 104 bp, Homo sapiens
acatctgctatagatggaggcggagtcagaacaggtagaacagtcataccctcccttagacaggaaactactcccaccctggtagcctcacgtagacctaagca

SEQ ID NO: 506654 - DNA, 214 bp, Homo sapiens
agttcaacatcaagcaacaggcaaactgaggtaagaacggtctatcacaggaagacctggcatggatcgggggtcgccccacagacagtggaagaacgaacgagtacgaaatgagagcaagacatctcatgacgaccctgacagtcatatccagaaaagaagaactactgcacgaggctgcctgcgcaccgagaggtccagcgtcggataaggg

SEQ ID NO: 506655 - DNA, 679 bp, Homo sapiens
tggtggctcacaccgtgtaatcccagcatttggggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaaataggtgaaaattccttataaatccaggatgggctctgagagacacgggctaagattcaggaagaaacaaaaaattcagaatcctacatctcctccgtaaaatttggggccctaatgggtcatcaaaacctgggtaggatgcggatgacaatgagggccaaaattttaggaggagatgtaggatgcgggaagaaaggtgaaaggtgtggaatatataccagaggaggacaaactcagagggcagggaaggaccgggggtagggaaacatgacggacgggccagagcactggctagcggacgcgagacgggcctaaaccgggggacaaggctgccggggccagaacatggggcaaccggaacgctaggggaaacggggaaa

SEQ ID NO: 506656 - DNA, 209 bp, Homo sapiens
gactctagagtatccccacccttcaaccgctgcagatccatcacacttggtcttattcctagatattcaccacatagtcatcacattactcaaagttttttttttaagatcaggtcactcttgtcgcccattttgaattgctgtggcacgatcatggttcaccgcaactcgaatagtgtaccgaggctctcaccttcgtaaatccatcg

SEQ ID NO: 506657 - DNA, 525 bp, Homo sapiens
ccttgatgctgctggatgtctttctgatgctgaaggtgggatgtgaagtctccagctattattgtattgtgatctatctctcttgtggctctaataatatttgtttttatatctgggtactccagtgttgggtgcatatgtatttacaattgttttatccttttgctgaattgacatatttatcattatataatgatcttatttgtctctttttatagttggtgttttgaaatatatttggtctgatttaagtatagctactcttgctcttttttagtttctatttgaatggaatttcttttttcatccctttattttctgtgcctttataggcaaaatgtgtttcttgtaggcagcagattatggcgtctttttttttttttaaatccattcagccactctatgtcttgggatgggagaatttagtccatttacagtaaattttattatggataagtaaagacttacttgggccattatataacttctctgcgggaggaaatgtgaccttctcctttttcttcc

SEQ ID NO: 506658 - DNA, 167 bp, Homo sapiens
tcaggacgcacgatgtccacgggccgctgcgtagcactgtgccacggacagctctgttaggcagggaaggtctgggcacccgatctgagggtccgggcagaggacgtcctccatgtcatcgatgaacttctcagcgaccaggtaggagaacgcgtcaacactcgggg

SEQ ID NO: 506659 - DNA, 165 bp, Homo sapiens
tccaggaaattaaagaacccaagagttgtttgtttaaaggggatgagtttgtaaattaaagttccttaaagctgttattggaaaaaaaccctttgaggaggtaacctttaatgaaaaattttttttttttaaattttcacatttttttccccttccccccttcct

SEQ ID NO: 506660 - DNA, 649 bp, Homo sapiens
tccagtggtcaaatgacccttaatggaaatggtttcccttggggcttaactgggcggggcttcccacagccaccacggtggagtgtctcactcgaagtggaatgctcagtaaggaagtgggggccaatcaacatttacagcccacgtgacgtgggcagtcccccgaggaactcctcttataagtggtctccagaagaagtttcctcgtggcataagggcactcgggtgcgcgcactcgtgctcgagccaatgtggtgtgaccaatctctctcatctcaagaaaggtgtgatatattctcccaccgtggtgtgtaacaaagcgtggttattctctgtgagttctctattctcagtggtcctcgtggggagggggtctcctattgaggggcgctttgagagtagaactcaggggacaagagggcaaaagagggcgcaccacactctctcaatctctgtggggcccgtggtctgtggtcctgtggaaatgtggctcgagtgttctcacctgtgataatctcctctcagggcccttctccaggttcacccgcgttggcctttgggccaatgtgttcatctccccaagctttttttgtgtggaagacccaagaccccggggggcgccgtctttggggggcccagggcagcacgt

SEQ ID NO: 506661 - DNA, 165 bp, Homo sapiens
tgatctgaggatccctgccaagcgtagtacccaaggtcagagttcaagaccagcctggcaacttggagaaaccccagctctacaaaaatacaaaaaaaaagacaaattagctggcatgatggtgggtgcatgttattccagctacttgggtactacgctttggca

SEQ ID NO: 506662 - DNA, 619 bp, Homo sapiens
  misc_feature (609)..(609): n is a, c, g, or t
cctgcacctgtagtcccagctagttgtgaggctgacgcagaagaattgcttaaacccgagaggcgcgttgcttgcagtgagcagagatcgcgccactgcacaccagcctgggtgacagagcgagactccatctaacaaaaaataatagtaacagcctcccgaagaaatacacattttgcccaatgccttctgtttggggctttgaaaagtgagccctgactgggtgtggtggttgacacctgttatcacagcactttgggaggccaaggtgggaggactgcttgagcccaggagttggaggctgcagtgagccatgatcttgcccctgcgctctcgcctgggtgacagagcaagactctatctcaaaaatgtttttaaaaaatacttcctagggaaacacacattttgccctatttggaactttgaaaagtgagccctcctctgcccatgggccgtgctgctcagcctgccatactcgcttgctttgctgtttgggatttgcctccagaataaaggtcctttttgttggaggcaaatcccaaatcggcaaagtgcaggaattggcgcgttgcagttgggtagctgggtggcaggccaaatcggcaaagncaggaattgg

SEQ ID NO: 506663 - DNA, 331 bp, Homo sapiens
  misc_feature (161)..(161): n is a, c, g, or t
atttttgctaaaagagtagattttagatgctcttgctacacacagaaaaggggtgactgaaacgatggattcattgatttgcttgactatgagaaacgtttcactatgtatatgtgtatcaaaacttgtacacattaaatatataaaactttaaaattgantttataaaaagagaattgccaagagaatagattttaagtgttctcaccacaaaaaaataagtatatgaggcatatcttaattagctcaattataaccattccacaaatatacatatttcaaacatctgcgctccagcctggggtgacagagtgagaccttatcttaaaag

SEQ ID NO: 506664 - DNA, 408 bp, Homo sapiens
  misc_feature (22)..(22): n is a, c, g, or t
  misc_feature (39)..(39): n is a, c, g, or t
ccaaaaaggttttcaagtttcnctttattccagatctanctgaagaaattactttttgtagaaagctacagccttgcaaaaagtatttcctgaaataataaaacttgaaagtcagttgggcatggtggcccacacctgtaatcaaagcagtttgggaagccgagatgagcagatcacttgagtcccaggaggtggagactagcccgggcaacatagcaagttcccatctctacaaaaaaaaaaaaaaaaaagaaaacttagctgggcatggtgtggtgcgttcctgtaatcccagctactcaggaggctgaggtgggaggatcactttaggccaagaggtggaggtttcagtaagctgagattgcaaccactgcgctccagcgtgggtgacagagtgaaatcctgtct

SEQ ID NO: 506665 - DNA, 186 bp, Homo sapiens
tttttggcgctgtacacctccctggactttgttggctctggcaaagtagaccacacagtgggccagaagcacctcacattcaggcatgcctatcacatgacagccttcgtaggcagcaaccgcttgtgttaacgcagaccggtctgccagacctatgtcctcgctggcagacctgagcaagccagg

SEQ ID NO: 506666 - DNA, 730 bp, Homo sapiens
gcgctgattgcttgccaggtagtggatcccggaggcgcgcagaggagtccctggaggagctagggaccccaaaggcctttcaccgctgtgggccagtcctcaggtcaggtgggagggtgggtcccagggaatcctgttagtttctaccaccgtccgtccgccctttctctggagctggtggagcttcaggaagtcctgtggagcgtcggctgggatcagttgtctcggtgagaaagtaaagcttgaaagctttccagagtgttgaatcttccaccagaaaaccttgatcacatcagatatctggcagtatccaatttgcccagaagaagaagaagtagctgattttcagctttcttgtggattctttattggaaaaatgacaatgagcattcaagaccagatattcaagttcaatgccaagagactagcagagaagctaagatgtgatacagtggtgagtgaaatcagtactggtcaagaggactgtaagatttcaagaataagacagagagctcttaacaagagacagtgctacaacaagtaattgaagatggtcaaaatatggattaaagaagtgaacttttctctggacttgcccagaagaagatgtggttgacttcaggaaattgtagtagcaaatctcaagagaagctttaggacatcaagtaataagaataaattagcttgggagttggggcatgccagtttggtctttctgggaactggttac

SEQ ID NO: 506667 - DNA, 1392 bp, Homo sapiens
tgtggggggggcgacacgcggcggcgggcacccccgacgggagcgccggcggggggggggggcacaaaaagaaggggcgcgaacaccacacacagagagggggggggggggagaggagacgagaaaaaagggcgagaggggcgcccgcgcgcggcggggagaaaaagaggagagaaaatctctctctctctcacacaaaaaagggggagacgaaacaaacgggggtgcgacgacgaacaggggggggaggcggggagagagaaaaagagagagaaaagggggaggtgcgccccgcgcgcgagagagacacgcggagaggaaaagacaacagagaggggggtgtgcctctcttacaaagcgcggaggagagagagtacaaaagaagagatgtcgtgcgcgaggagtgttcaccacacgcggcgcggggtgggggggagagaaaggagagagaaacacacacacggggtgggtgctcgcgcgagagcgcgcgcacagagagagaggagaagacctgaggcgggggaggggggggtggcgcacacagggggcggcgcccaccgcaaaggatcaaacagagagggggcgcccacacaatattctatcacacaacaaaaattcactcccacccaccaaacacaaactcacccacccagataaagatacctgccgccctagaaaacaaagggaagctaaaccgaacaggcccagccgcgcagcggggggaggggagggggggcccaaaaatacaaaaaacacagccgacgaagagggagcgaacgagaggcggggagggggcaggaaagaaagaatcgccacacaaacaggaagaagaaggagcgcccccccaagagaggatgcatccccgagaagggagaaacaggcgggggagacaaaaccacaccaacgcaggggacgcgcggagcagtaaaaaaagcacctgtaacgacactcgtctgcggcaacacaaagaacccaacaaaacagagcagagctagagccacacggaggggaggcacaacaacacacaacagaggagcgagcagacaacaacactccataagagaagagcgacaacagcgggacacaaaaatacacaagaacacggaggggaacaccaaccacaaaatatctaacaccgagcgagaagagaccccccacaaaaggagcgggagggggcgagcgcccccccagaggggagggtggacggacgcacaacaacacacccacaagagcgcggcacagaagaggagaacgcacaccgaccgaaccgactaccccgagaggccacccccggaggggggaaaaacacaaaagggctgacaacacggaggaagccgccccgcgaggtagtagggcaaccacacaggtggtaccgcgagcgaagaaacacta

SEQ ID NO: 506668 - DNA, 376 bp, Homo sapiens
tcgtgttttggtataagatattgcgcacttcttaagataagcgtttcctccctatccaatgtcttttggggtaaatcatcacatacatctgaatttgtttttcacagtcccagtaatgggtctgcctcattctttccatctcctcccattcttttgtctcccttgcctttttcctgtatatcggtagttctcataaagaagtggtaaatccaagatataaaattcttacacaaaggtctcacatatttgtgcccattctagactctctgcttgaaatgtcctcaattcatttctcctttttctcctggaatatctcttataccacagtcctcaacatatacactatagagagagtcctctgatgaatgcgattgct

SEQ ID NO: 506669 - DNA, 695 bp, Homo sapiens
  misc_feature (103)..(103): n is a, c, g, or t
caggggtaagaaagcattaagaataccgtcgggccaaatctctgcggggcaaaaaggtgggatttatccttttaaaagacaggaaaaattatgccagaggttnctctagcctgcttaaagagattttggggcaaaactcaaaatggtgtttacagtgctgcaaattacacaatgggagctttggaagtaattttgtgtctgctggtatacagaccagttttagggctggtaatccaacagggacttcccagaatggttatgatagccctcagcaatacggaagtaatgttcccaatatgcccaatggtatgaacccacaggcatatgcatatcctgctactgcagctgcacctatgattggttatccaatgcccacaggatattccccataagactttagaaggatatgtaaaagtctgtttttcaaaaatgctctttatattgtgtgttatctgccaagatagttatttaagaaacatgggaattgcagaaatgcctgcagtgcagcagtaattatggggccctttttcgctatttaaggtggatatttctctacattcctgaaacaatttttaggttttttttggactaaaaaaagcaggcagtgttttccccaaagtaaatggacagtgattttaaatacaataaatgaaggcaatgcatggccttcccataaaaaatatttgaaggctgga

SEQ ID NO: 506670 - DNA, 236 bp, Homo sapiens
atggaatgaaggaaaattcctgatgttccatttttctcctctggtaaagtactccatggcaaagtggtctatttaaagagtgagtttgatcttggccctatctaaatcttttgatcttgaaagaaggatggagtaccaataatgagagggcaagacagattttctttaaagaaatgtgataaagttaaagggatggttatgacccagcaagtaactcggacaactcgtttggaact

SEQ ID NO: 506671 - DNA, 263 bp, Homo sapiens
catcacctaaggccgtaacttctaaagcggggactgcttcctgcaaggataagggccgagttcaattagcgatgactgccttgatcaatgcatggagattggcattactagagtactctaattgccagccatgagcgagaggaaaaaatatacatcgtgcttgccatgcgatgagctcttagctgtaaggcatctctcaatctgtacaggcttggtctgcaccagccttaactaacatgagcttcatagattttctagaagct

SEQ ID NO: 506672 - DNA, 878 bp, Homo sapiens
ggacctgcgtatctctgcttgggggagtgtgcgtccgcatatattggtttcttcgctgacctccgtggtcgccggtttcctcatgggttcccacatgcgtggttctttgtagacccgccattcttttagcgcctttagtgttccgtgccgctccgaatttcctggttggtcctttcgccgggaacctgtggggaccctgcgcaaacgcagatttctgtgtatctggcccgcctcgtctgtttttcccttgccaccacaagtttggccccagcccacagttgctggacgcagagattctgcctattctactctgattgtcccggtcctcccacgccattcccccccccttccctacttccgtctttacacggcaagttccccccccgcccatgtcccataaagagcgcgtcgcccccctaatttccgcggctgacctcgtcccaaacccggtcccttgtcttctttaattcttttaagagcgctgtcaaccactctttaaaaccccccaatagctgcctgcttcacacattatataacaaagctgtggtcccccctctttgcaacctcaaataagtttcgccaccctagtgccatgcgccctgtcaccaccaccgcggcatcactatctcgctgcgcacctcggaagaaggacactctcccattcgtggtcgaagtacaaaaaaaggctgtagaaaaattggggttgcgtccccgtcttattcatgagtcgacccacccgaggcccccgagtgtcaccccccaacgcgggaactctcaagtatcaatcacaagcgcacgcatttttctttgcgcccaaagttttaaaacggggaaagcccaattctttaacaacccacaaaaaaaactctaacaaaaca

SEQ ID NO: 506673 - DNA, 368 bp, Homo sapiens
ccgacccttttcacaggaaacaagcataccgctctgctaaacctcgtgatcccctggccgttctcctaaaggcgcgccttctaccttccagccctgcaagaagccctagccagcgaggtagatgacagatggaaagactgaacccacgctatttccattttagaaagtgcaaaggctagagttacaaatatgaagacatctaaacccatcgtacattccagaaaaaaataccgctttcacaaaactcgctcccgcatgacccacagaacacccaaggtcaaaaagagtccaaaggtcagaaagaaaagttatctgagtagactgatgctctcaaacaggcttccgttctctgcagcgaagagcctcat

SEQ ID NO: 506674 - DNA, 1217 bp, Homo sapiens
caccaagagctgtgccaggatccacgagaccagatcgctgaagaaacagggcctgctgcctctgaccttcgctgacccggcatgactacaagcaaagattcacccatgatggatcaagctgaccacttcaggggcctgaaggatcttacaccccatggacaagtgccctgaagtgcactcatcatagcatgcgcaaacgggaccccaggagagccgatccctcctgaaacgcacagcctgcaacgcgacgacggcagcattagacgggtgggtatccgcggctggagtcagatgacgcctcagaccagacactgcaaggaaacctggcagagcaggtagtcgtggggcaagttgtcccttccacccgacacgccggtgccgctagggcagattcagacagttcaacgccataccatcgataggtggcacaatacaaagtgggattcacggattcgcgggtccaaggcacaatggacataatccataatgcccgcagagacatgggctgggtggaacccaagaacaatttgccttcccatggcgtccacccagacagtttagacaccaaacggggagatgaaacctgggttgggatatgtagacgctgggagagaaggaggttgtcagatgaaagacaatcaacatatatattcgacggacccccaccacagtgatccgttgacaccgtaaatgacatgggacaggtttccgggggctgtccgagggaacgtaatataaaggcaaaggcggtaccaacgtggcgaaatcgatggttacactatagtacttataaaaggggacagtggacacggaaagggaatgttccccccaatgcattgaaacggctgcagaacccactccgcgggcacatggccagtcacgttaccaaaaggggagggacatgaacaggggcattacattaggcaggaacaccattcagaagggtacaccctgggaccaacgcgaaacaacacacaggaacatcccacaaacaccccaggacacgaagacaaaaaacaaaacagtgagcggggcagaacgccatagcgagcagaaatccccactacaaaaggggggccccaaagagtacgtaagagcgcgcacaccccacagacatccacagggacaccaaaaggaggggacccagaaatcacagggagacccgcgataacaatagagacgtcagccgaacggggcaaggctgccggtcagaaaac

SEQ ID NO: 506675 - DNA, 150 bp, Homo sapiens
cggcatcggcacaattgtgtcacgcgcacatcaatacacatcatccattcgggcttgcatgtggtggcaggtggtgtatcaaggggttggctcaggtctcacttgtctagggtcgcctcaggaggtctggtgcacaatcagtgttcaatg

SEQ ID NO: 506676 - DNA, 274 bp, Homo sapiens
atatcaccagatcgatgttcctggatcccaaaaccaaagtttccagtatctgagaagttgttttttcttaactcttactcccgcacctttagacccttctccaagaatttcttctagccttgagcccctcgcaactgtgcacgtggacagcaactcttttcatattctccgtgatgccaaacggatcgtgacacgtgtatcatagctttgtgaaaacacatggggtctgctcctgtgagctgctccaacaccttgtggtactacgcttttggca

SEQ ID NO: 506677 - DNA, 137 bp, Homo sapiens
gcgaagagtgtgcgcagccaaacacggtggacttatccttttttgcagccccagccaccgtagggagctgggggaccgtagtaccgacaatctcttctctgatccggctgcagagggatgcggccacgtggcaagtg

SEQ ID NO: 506678 - DNA, 148 bp, Homo sapiens
tcataggctcgcaggcagattcaaaggatcctggaggtatgggatagactggggagacgatgctgttgctttgcatgatcacagtgctggaagcatgaacccaggctccagtaacgtgttgcccggggcccatatgcctctgacactg

SEQ ID NO: 506679 - DNA, 157 bp, Homo sapiens
  misc_feature (53)..(53): n is a, c, g, or t
  misc_feature (64)..(64): n is a, c, g, or t
  misc_feature (94)..(94): n is a, c, g, or t
  misc_feature (147)..(147): n is a, c, g, or t
actaggctttaaagacataggaactatatcttggtcagctttgcacttccaantataaaaaaangcctggcggggggtaggcactcaagaaaanggttgactgaccaatgggggggggggctctgcacactctaaggtaggggaaancaagaacagc

SEQ ID NO: 506680 - DNA, 175 bp, Homo sapiens
actctaacgatcccgtaatcccacttggttgccccggcacacgaatggtgtatgttacataaatggaattgtataatatgaaaccttttggaattggcttttttttcactcagcataacgcccttatccacgttgttgcatatatatgggttgaattatgtcccacccaaaatat

SEQ ID NO: 506681 - DNA, 157 bp, Homo sapiens
tatctagcatcgcagtgctgggagccaaataactgttgacagcttttttggtgcagctcaagaaaacttgaaaagaacatgctttaactgaagcacgtggactctgcagctttctgtgtcaggcccgtgtcactccccactggtcgcggataggcac

SEQ ID NO: 506682 - DNA, 411 bp, Homo sapiens
tcgggtctttcaggctgatcaggccggatttctgcaggagcagcaggcacggccgctgttgctgccttcgttcggaatggccacggtggcgccgtctttcagctcagccaggcttttgactttcttcgagtaaccaccgaaaggctcgacgtgcacgccgatcacggtgaccaggttggtgcccttgcctttattgaagccatccaggtacggcttggtctggaagtagttggcgtccaggtgtttctcggccacctgggtgtcggttgtacgtagtcggtgaagaccttgatttccaggtccacgccttctttggccaggtcggcttgatcagctcgaggatctcggcatgggggatcggcgttgccgccacgaccagtttctcgccggcctgggccagacctgccgcca

SEQ ID NO: 506683 - DNA, 85 bp, Homo sapiens
cctgaatggagagggagaagagaaggtaggaaagagaaaaaaaaatgggagagaaaagaaaaaaggaaaaaaaataaaggaaaaa

SEQ ID NO: 506684 - DNA, 897 bp, Homo sapiens
gcatagtagtgttgacatttcaacctacagatccagtagatatctctgcccccttaggaggttgctccactgtgcctaggaagaggctgcagctcgggtcgtgactgttaaatattataattgtacgtgccccgtcctcactactgtgaaatgacagccgtcttccattatattaagtttagctataacttattctatcaatcggatacatttttcagtcacatgtgcattagtcacaatcctgggcacgaagtgcttgaggtccagctgacgatagtaaaatcaaggggtaggaggcacggggatggaccaggattcatgttcctttgcatttcttacgtaaaatgtgaacaaccggcagctggtggatggtgatccacgcattcccgaagtaataatgtgaggacgaatgcacgtgcatctggaacataacccgagatgctaacctgggggtctcatgtctagtgcagtcgaagctactatcttactcacattcagattttttgtcctacagtgcacatgcaccagatgatcttttcataatgtgacttcttggtaaggcttatcatgaatgagggcgccgtagtctgtggctggggtgtctaaaccaggctaccactattcgaagtgactatactgaatagatccatcttattgagttgctttcagaaacatctgccttatatgttgttgtcgggatgtggcttttggggctaaaagttggtaggccacataaactaaggaagagccattagggactaaagccacggggaagcaaagaggaagtcgccacggcttcgagggcaattcaagttcttcctaatttgaagccggaacaatgtttatggtgtgagacccacattttgcttatttgaatgcctttggggaggtttgcac

SEQ ID NO: 506685 - DNA, 136 bp, Homo sapiens
gtgactctgaggatcccgtcagaagatacctcagaacagattttttaatcactcacaactaaaaattattagaactaagctggtcaggatgaaaatataattaaaaaaatctgttctgaggtgatcttctgcacga

SEQ ID NO: 506686 - DNA, 203 bp, Homo sapiens
ccttgtgcatcaagcccacgtgttggtacggcacgagtgcccgcgggcagggtgactccccagtgttgtgctgaatcctgactggtcggctgctacactagattctccatcattcctctgcctcactgcagtcccagaagaggaaggctgcaggcccagatcccggagcactgccatcacacctacccccgcttatatgaaga

SEQ ID NO: 506687 - DNA, 378 bp, Homo sapiens
ggtttgcagttagccgagatcgcaccacttcacttcaaccttgggtgacagagcaagacttcatctcaaaaacaaagaaacactgaacagttatcctatctgatctttttatatgcaggatagtgattaaatcactctacaaccactttcctctaatttctcctcataaggcctaatcaaatgtatttgccttacttcctaccattctgttgagatctccgaaaattggaggaaggactaaatatggtaggaggatctcttgaggtcctgtgatcttttgaactgcattcctgagtctatcctaacttcctaaaggaggatgacttttgggttgttgtaatagggggctcctgtccttgggtgggggggggggggggg

SEQ ID NO: 506688 - DNA, 887 bp, Homo sapiens
  misc_feature (771)..(771): n is a, c, g, or t
gcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacggtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtctttcgggagaggaggaggagtagggccccctcggggntgggcatccggcccctggggcccccccttgtcaaccgggtgggtaggaaccgtaaactcgctcatctcgcctgggtttgtccgcatgttgtaatcgtgcaaataaacgctccctcc

SEQ ID NO: 506689 - DNA, 1031 bp, Homo sapiens
gcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgcttcttagtcagcacagccgcggcggctgcagcagcgagagttctagggttgcccttaattgctgtagtaacccgggtccggggcctcggtggtgctcctgatgcccctcacccacccctgaagatcccaggtgggcgagggaacagtcagcgggatcacagtctttcagctagcatcctgtactccgacgagcggctgaatgtgacagaggagccgacgtctaacgacaagaccagggtcctgagcatccagtccacgctcacggaggccaagcaggtcacctggagggcggtgtggagtggcggcagcctctacatcgagatcccgggcggcgcgctgcccgaggggagcaaggacagctttgcagttctcctggagttcgctgaggagcactccaggctgaccacgttttcatctgcttccccaagaaccgtgaggacagagccgccctactccgaaccttcagctttcttggctttgagattgtgagaccggggcatccccttgtccccaagagacccgacgcttgcttcatggtctacactctggagagagaggacccgggtgaggaggactaggtgccagccctgcccagtgtccctgtgccctctcctgggttagtccacatgtcgtgattgtgcagaataaacgctcactccattagcggggtgcttcttcgagctgaatgctgtgtttgtcacactcaagtgttggctttaattctaaataaaggtttctattttacttttttattgctgtttaagatggtcaggtgacctatgctatagcagtctcctttgaagtctggaaaaatagtgtcacctcccctggctcaaatccaataaagtgatctcgttc

SEQ ID NO: 506690 - DNA, 680 bp, Homo sapiens
tattaaaggttttctcaatttttatcccggggccttgtgggggaccggggagggaagtgtataaaggagtgacggggcccccgggggccctttcccaccctggagcctcaaggccgggggggggaccagtgaaccgtgcagaaggcattcaaaatagggcctcaaaaagcccaggccatctcatttccaggggaccaggggtggccacaatgggtggaactgggccctcccaaagcaccgaggaaaagggctcgacatgtgggtgtgccccccgacaccgtggtgccttgaacgaggcatgggggggcgacaggcacaagacgaaggaggcattcaaacgcccctcccttccccaaaaagggggccagtgggggcagtggggcacaactatccatcccgaggaaacccaaggggaaagcccgggcaggacacccgtgggctgtggcccacatgccccaaaccgtggatctggcgaaggctccaacaaggggagacgggtagacaccaccccccgtggggtaagagaaaggggcccacacacagtatccacaccatttgggggaaacaaaaccgagagcaaggggagcacaaaacagcggtaagcagcggaggagcaccaggagcaaacaaaacacacccccaacaaaaaacccacagaaaggaaacacatatagggaacc

SEQ ID NO: 506691 - DNA, 409 bp, Homo sapiens
  misc_feature (370)..(370): n is a, c, g, or t
  misc_feature (394)..(394): n is a, c, g, or t
ggtccagcagcaggaagaaaccccaggaggaagaaacctcagacagatcgccggcgaggcagcgcgggatcccagcctcaggcgtgcgcggacggtgtgcgggtgagtctccccaaaagtggagcccttgtgatggcgagcacaggtccgcctgcgtgcccgtgggctgctctctcaccggtggctctcagtcgcggagagcagaacccggcagcttcaggggctgcctgcgggagggtgttccctgctgtacgtgtgtgttcgtcatgggtgtgtgtgtgtgtgttggggggggtgcgtctgtgtgtgtgtctgtgtgtgtgcgcgcgcagtgcctgtctgtgtgccgacttctgtctctctctcacgnctctctctctctctctctctctgnctcccttctcgctct

SEQ ID NO: 506692 - DNA, 842 bp, Homo sapiens
gcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctgcctgagcctgcccggcggcagcggcggccgcagcgccgagagggcctccccccacgtgctgtagtaacccgggtccggggcctcggtggtgctcctgatgcccctcacccacccctgaagatcccaggtgggcgagggaagatagccagagggatcccagcctcgcggccgcgccgctgtactcggaccagcggctgagcgtgaccgaggagctgacgccgagcggccagacgcgggtcctgcacgtgcgctcgcggctctcggacgcccggcaggtcagctggagggccgtgctgagcgccaaccgcctgtacgtggagctgccggccggcgcgctgcccgagggctgcaaggacagcctcgcggtgctgctggagttcgcggaggagcagctgcgcgccgagcacgtcttcatctgcttccccaagaaccgcgaggaccgagccgccctgctccgcaccttcggcttcctgggcttcgagctggtgaggccggggcacccgctggtgcccgcgcggcccgacgcctgcttcctggcctactcgctgcagggctagcgccgcccgcgctgtgcccgccatgaacgcccgcggccccgtgtcgtgtttgtgatactgaagtgtttgctttaattctaaataaaagtttatattttccccgccctcaa

SEQ ID NO: 506693 - DNA, 974 bp, Homo sapiens
  misc_feature (771)..(771): n is a, c, g, or t
  misc_feature (894)..(894): n is a, c, g, or t
  misc_feature (917)..(917): n is a, c, g, or t
gcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacggtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtctttcgggagaggaggaggagtagggccccctcggggntgggcatccggcccctggggcccccccttgtcaaccgggtgggtaggaaccgtaaactcgctcatctcgcctgggtttgtccgcatgttgtaatcgtgcaaataaacgctccctccgaattancggggtatttcttgaagtttaanattgggtttgtgaaactgaaggatttgctttaattttaaataaaaatttatatttta

SEQ ID NO: 506694 - DNA, 748 bp, Homo sapiens
gatgtgtgttgccgcccagtgttggtgtcgacgcggcgtcgcaatctgtgagggtgtggcaaggtgttgtgaggcttcgcacaaggttccccttaaggggctactttctgtggggagcccccgcagtgtcgtgtagggtcccccaagggggggcagccccctgctgtttctgggggccgcacgtttattatagatgatgtttgggcacaaggggcgtttctcccgcgtgtgtttcgtgctgcgggttggggttgccgtctgtgtgcaggccacccggcttggggtgtcaacagtgattgccccgctgtgagaaatatgtgtagagtagccgctcttgttccacgtggctctccccgaacttatgagaattgtctcccgcgaatgatcttctcggcggacacagcaacacgtctacggcctttggaatcggtgttgcgagtcggctccagtgtctagcagtaacgaccccgtgtagtatgccccaaagattttcaccggagagacgcctacttgtatgggggtagtagcgtgcacgcacgcgttgtgagcctgctatgcgacttcttcttacggtttttggcggaactgttcattgccttccaccggcgattggtgcggcatcaccacggtccacacgggagtacataggtagtcgcataccgtgtacacgactgccacccgcggctttgtgtataaagaaggattgtactttgtctgtgttcctgtcgttctaataagtagtacgaga

SEQ ID NO: 506695 - DNA, 799 bp, Homo sapiens
cctagttcggtggaaatcagccctgtagccatgagtttcttgcctggggctagccctagagtactggagcagtgctgtgacttttctgtgttccccgccccgccagtgtgtgctggggcctactagtgcctccgtgtgcatccccgtgtctcaatgtatgtgcctcatcttgcctgtgcaatggtgctgccctgaagacgctgtgtgaggctgccatgtctgctgtgttgcttactgccagcagctgatgagagctgagcctgtgatgatgtgctgagccctgatgcctgtgatggaagcagtgatggtgctggttggctcctacatcttgggccctgctttagtggggcttgttctgcttctctccctgctgcccaatggtgtcctggccttgcttgcctcctgccccctcagatgcttggcgccatgcctttccccctgccgcttgttgccttcccgatgccttctgttcccggtcgattacaggttcagactcgtcacgactcaagtgttcacctgattacgctagtccgatcatctagggaccaatccatccctgcgcgaccgatcaagtgcgtttgctaacccagtcctcttatcttgcgtgactgggtattttcggttcttggaggggttccgaatctcttgagttgttctctaccattgtgcccgtccagacgtacggcctgtcccaatctcctgccctgccttgcgttagtcaggatggaagtagctacgcatgtccacatgtcggagggtatcaatccgatatgttaaacggagttgtgtggatgcacca

SEQ ID NO: 506696 - DNA, 1137 bp, Homo sapiens
  misc_feature (771)..(771): n is a, c, g, or t
  misc_feature (894)..(894): n is a, c, g, or t
  misc_feature (917)..(917): n is a, c, g, or t
  misc_feature (1016)..(1016): n is a, c, g, or t
gcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacggtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtctttcgggagaggaggaggagtagggccccctcggggntgggcatccggcccctggggcccccccttgtcaaccgggtgggtaggaaccgtaaactcgctcatctcgcctgggtttgtccgcatgttgtaatcgtgcaaataaacgctccctccgaattancggggtatttcttgaagtttaanattgggtttgtgaaactgaaggatttgctttaattttaaataaaaatttatattttacttttttattgctggtttaaaatgattcagattatccttggncttttaggagaagttttttttttggggttttttggaaaccgttttagtttttttacttggaaaaatgaggtttttatccccccccttgctttcccaaagcccataaagtgttttcccccca

SEQ ID NO: 506697 - DNA, 501 bp, Homo sapiens
caaaacaggcatacttacatatttcaagaaggcttgaatttgggaggaggctccgttgcatgcacccagaaagtgacctcaatgacactaaccatgatcatactccagaaccaaagattatctgttaaagggactcatttctaggggtctccatccttcccaggaggctctaagaggggagtagaggcagagaagtgggagcttccggctccttctgcacagacgtcaccctcatccacagcagctccaaagtgagaacagaccgctgtgaacccagggtgatccagggggtcaagaaccctctgatttctgctcccatcttgagctggcaccagcccagccctggtcgagcttcaactttgctaatgagctgtgagttaccagccccacctctggaccaagaaactaagggagtgaatggggaagggttcccaagagcctccgccctgggtaataagcccgtatctgggtcacgaggctggcttgctgctctagccattg

SEQ ID NO: 506698 - DNA, 1030 bp, Homo sapiens
  misc_feature (25)..(25): n is a, c, g, or t
  misc_feature (151)..(151): n is a, c, g, or t
  misc_feature (162)..(162): n is a, c, g, or t
  misc_feature (171)..(171): n is a, c, g, or t
  misc_feature (204)..(204): n is a, c, g, or t
  misc_feature (208)..(208): n is a, c, g, or t
  misc_feature (213)..(213): n is a, c, g, or t
  misc_feature (232)..(232): n is a, c, g, or t
  misc_feature (250)..(250): n is a, c, g, or t
  misc_feature (253)..(253): n is a, c, g, or t
  misc_feature (255)..(255): n is a, c, g, or t
  misc_feature (263)..(263): n is a, c, g, or t
  misc_feature (265)..(265): n is a, c, g, or t
  misc_feature (277)..(277): n is a, c, g, or t
  misc_feature (827)..(827): n is a, c, g, or t
  misc_feature (950)..(950): n is a, c, g, or t
  misc_feature (973)..(973): n is a, c, g, or t
atacaaaaactttctaaaaaaaacnaccctcctacccctccccaattccccccatccccaccacccccccccccccccacacacccaccccaccttttcctcctttcccaccccaccccccccatcctcaaatcctccctccaccccatcntcaataccaanctcttcccnacacacaaccaaccccataaacccacccccacnatcnacccnacccccaccatccccctcntaaccctcaacacccccnccncnaccacaantnacacttccaccntctccctcaactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacggtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacagctttgcagttctcctggagttcgctgaggagcagctgcgagccgaccatgtcttcatttgcttccacaagaaccgcgaggacagagccgccttgctccgaaccttcagctttttgggctttgagattgtgagaccggggcatccccttgtccccaagagacccgacgcttgcttcatggcctacacgttcgagagagagtctttcgggagaggaggaggagtagggccccctcggggntgggcatccggcccctggggcccccccttgtcaaccgggtgggtaggaaccgtaaactcgctcatctcgcctgggtttgtccgcatgttgtaatcgtgcaaataaacgctccctccgaattancggggtatttcttgaagtttaanattgggtttgtgaaactgaaggatttgctttaattttaaataaaaatttatatttta

SEQ ID NO: 506699 - DNA, 952 bp, Homo sapiens
tcagagaaataagagctaagtagtattcatgctcatactagtagcttctgccttatttgtccccacaaattctcccgcaaattgtcggcgcaaactgtggataaagccctccttacttggtcccccccttttttactccccctttgtcttctcaaatcattaccgtgacacgtggtcccccgcacagccttcttttgcttgcacggcaaccaccattctacctgcgcaacatagtacccacactgtagacatccgtggcaacggacacatgttcctaagtttcaacccgaattaattattgccacatcatctgaaacaaaaaaccggggaaccacaatattgttaagaaattacgtaccaaaaaagatttcgctttcccccccccttttcaaatttccaagggcagtccacaaaaggttgaagtttgcctcatcccttgtgactttatccatcacacgtctccaattttaaccaggtgaaccaccaaagtgagaaatcactatcccctttcggattggcacaaacacccaccccacgttaaccgtctctaatacacgacaaaaaaataaaacttttctccttctagcccccctttcttaaaaacacatcatacaatgagctctcaacaaatgcatctggtggcatataaaaacccacacattggtccccccaccccttcggtaacaatatctgaaaaataaattactgttgcccaacatttgccttaaaaatgttttttcttgccctcgttttatcaccccactaggactgtattctaccttttaacatagctctatactctaaaaaagccttggtagttatgatagaccatgaagtaacttcgaacaggtattccattcttctctgcctttccattataaaagggaaacaatgtttcttgactcttaaaggtttattccccccacatgacaaaaaaaacggaacataaaga

SEQ ID NO: 506700 - DNA, 135 bp, Homo sapiens
tgactatacaatcagctcgtacccacccaacaatgactaatccaactaacccaaaacaaatgataaccatacacaacactaaacggacgaacctgatctcttatactattatccttaatcatttttatttgccac

SEQ ID NO: 506701 - DNA, 834 bp, Homo sapiens
gccccccccatggggaccacctgggcgttctccctgctccagggggattattcccttggccctctcctccgtccctcattttgcccccgcgtatcgcccctggttttggagtccccacccccgccgtccccacttgccaagcccagatttgcttgggctgttaagggaagaggttggtctccccgcttctctggtcagaagacctgggcagatgcgcgccctcaattcttttggaatcttggtgatgctccgccccttgttgatatgggtcccgggccagcccccacaggtgtgcttgaggagctctctcacgagcagatccacccccttggggtcgcctttgcccggttcggtgaataatgaggagcacgaccacgcttctcgcgctgggggggtcacatccaaagcaccctggaccgcacgagaaggctgcctggagagctgggccagggtcaccccacagtctgtccccgcaaaggctcacgaaaggcttaatggataattatccctctatacctcgccccccccacctctcttaatccacatggtgggagggaccggttctcacgagaactcgtttgtttccaaattggcccacttaagtgttagtgagtataaaggaggctcggctttaatgataacccacagcactccgtgaaacccctcacgagaaggagaaaggaggaatgttttcgtggagccacccttgggttttttttttgcgggtggcccttttaagattattagatttttaaaaccgtaccttttaatgggaaccacttggccccaaatttgtccccggaatttgagaccccctttaaaaagtttaatgga

SEQ ID NO: 506702 - DNA, 484 bp, Homo sapiens
  misc_feature (400)..(400): n is a, c, g, or t
  misc_feature (416)..(416): n is a, c, g, or t
caggtgcctcaggcccctctcccagcccactcccaagctgaactagcacgtgttcatttctaccgcgggttgaaccgcagggatccctggcttcaagtcaggcaccaaacagaaggtaggaggcatgaggggttctgtcacatgtctcttcattttcttattgattcttagccttgacagttggagaaggaaaaagcaaggagaaagtgctgagcaggagtggagagtgaagagcaggacctcgtgctgggtttgaaaaagtgcctgagacccatcttagccgcccctacctgagctttagcagcctaggagctattgcaccataaaacactgcaacctgaggctgcattaacagaagcaccacgtccaggtccagggagaatccagcctcacctgcttntcctggccagctcaangaaggacattgacaaatcaggttatgttcagttacctgtgacaaccacagaatgtaagaaatgttaca

SEQ ID NO: 506703 - DNA, 142 bp, Homo sapiens
  misc_feature (38)..(38): n is a, c, g, or t
gtagatttaaatcacatagaagaaatatatgtatatanatattaggagcaatacattttcacagttaatgttaataaatttcagaaacctcttataagtttccagatatattaaacattccaaatgtttttttctacatgta

SEQ ID NO: 506704 - DNA, 215 bp, Homo sapiens
  misc_feature (154)..(154): n is a, c, g, or t
cgattatagaggatcccccctcacaagaccctgactacaacacaataaagttagaaatcatattacgaaatatatatctagcgagaattctgtatgatttgaaaattttaaatattttcccagaaactattaaactacattttaattgtggatnaatctcaatacaatcttaatctgaaataatttaatcacagaagcctggcagaagcaggaag

SEQ ID NO: 506705 - DNA, 520 bp, Homo sapiens
aacaaatacacatataacaatgtccggtggtaaaggtggtaaagcaggatctgctgaaaaggcttctcaatctcgttctgctaaggcaggtttgactttcccagttggtagagtccaccgtttgctcagaaagggtaactacgctcaaagaatcggttctggtgctccagtttacttgactgctgtcttggagtacttggctgctgaaatcttggagttggctggtaacgctgctcgtgacaacaagaagacccgtatcatcccaagacacttgcaatttggccatcagaaacgatgaggaattgaacaagttgttgggtcacgtcaccatcgctcaaggtggtgtcttgccaaacattcaccaaaacttgttgccaaagaagtcctctaaggctaaggcttcccaagagttgtaaacagtgggtgtttgacatttctattacaaagggttttattctgttatttgtacattaataattcggggttttaggtggataactaaagttttttatgattttcg

SEQ ID NO: 506706 - DNA, 130 bp, Homo sapiens
gtacatcatcgccatcatcatcactatcaccatcatcaccatcaccctccttaatctctacttctagctacgcttaatctactccacctcatcatgactatcaccatcatcaccatcatcaccatcaggt

SEQ ID NO: 506707 - DNA, 392 bp, Homo sapiens
  misc_feature (122)..(122): n is a, c, g, or t
  misc_feature (165)..(165): n is a, c, g, or t
  misc_feature (175)..(175): n is a, c, g, or t
  misc_feature (193)..(193): n is a, c, g, or t
  misc_feature (196)..(198): n is a, c, g, or t
  misc_feature (210)..(210): n is a, c, g, or t
aaaattggatctcgtatattaccgtttaatttaaaattaaactgtgagtatggcttgagtcttttcgaacaaactagaagagatttaagacatacatcatgaaaaaaattaacagtgtaaanaaacaatgtagaaacacaggttgttttggacacctttagacanaagtaaaaanaccactccctacccccanttnnncccctctgaacnagattaatacgtatatgtaaactgatacatttccatcaacatctgatatacatatttattgatctattgtgaattataagatttaatatgattccttgtcaccggactcggtactgatcaaaacaccccgacgaccgagaatattgtctcgactggataacctaatttggactctgacttta

SEQ ID NO: 506708 - DNA, 283 bp, Homo sapiens
cggcctagaggatccgggaaaatagccgacggaaatactgaagaaactcttctgtgacatgattgacattctacattaagtttgagatgcgcttgtgtctataattgtgcaccattctatcttaatatgattccatggtcaatgtatatcaagatttatttatacactgctgacaaacgcattaatggttatgtctgtcctatctcatgtcctatcacaacatgagagagactttagatctattgctgcatcacagggtatgtgcattttgaactatatttgg

SEQ ID NO: 506709 - DNA, 129 bp, Homo sapiens
aggctcagattaacgatattatggaggtcagcacggtagctcacgtatcgacgtgaacttgtacagggagtgcatgcaccgcagtggtgaatacacgtcgaccaggctccatgtttgcgataattgggt

SEQ ID NO: 506710 - DNA, 774 bp, Homo sapiens
gtatgggcttagacaaatgtatgatgatatctacaattatagaatcatacagaatagtttcactgccctaaaacttctctatgcttcacctgttcatccctttcttccctaatcccctggcaaccactttaaaaaaaaaattaggttcagggggtacatgtgcaggtaaactcgtgacaagggggttggttatacagattatttagtgacccaggtactaagcctagtacccaatagttacttttctgggtcctgtcccttttcccaccctccaccctcaggtaggcccccagtatgttattccttggtgtccatgttatttcactcccacttgtgagaacatgggaatatttggtttcctgttcctatgtatagttgttaaggataatggcctccagccccatccatgttcctgcaaagggacatgatctttcttgtggcaaccactttttactgtcgccatagttcttccttttctagaatgtcatatggaatcatatagtatgtagccttttcagactggcttcttttcactttaattaatatgcaattaagggttcctcccatgtcatttcatggcttaatagtgcatttactttttagcacttgaataattacctccatggtctagatgaataggttttatccattccaccttattgaagacttcttgggggttcccaagtttgggcattatgaataaagttgggtgtaaccttcttggggcaggttcctatggcctgtttattcctttgaatataatcaccagggtcc

SEQ ID NO: 506711 - DNA, 586 bp, Homo sapiens
agttcctttgtctatatccctgtagatattgtgcatattgtattatgctgattactacagatttataagtttgaaatgaggcagtctaagtcctcaaagttagttctttctcaaaattggtttggctatttctaggtcttttgcattaccacgtagattttaggattggcttgttaatttctaaaaaaaagtctgctgggatttggataggaattgtgtggaatttatagatcattttggggagaactgccctcttgacaacactgaatcttctaaaccataaatatgtaaatgtctatttgtttagatctttaattttctcagcaatttttgtacttttcattgtacaagtcttatacttattttgttaaatttatacccaactattttattctttttgatgctactgtaaatggaattctttcttaatttaatttttaggttgttcactctcagtatatagaaatacaatagatttttaaatgctgatcttgcatcctgtgacccttctaaacatgttggttagtttaagtagctttggtgtgtgtgtgtgtgtgtgtgtgtgtgtgtgtgtgtgtgtgtgtgt

SEQ ID NO: 506712 - DNA, 270 bp, Homo sapiens
tatagacaggttgctggtaatgatatctgggttttcatttctctggaaataatttttttttataacattgaagttggaagaatatttggctggatattaaaaagtttaggttagctgctatttccctccaacagtttcaagatggcctccactatttcagtggtgaagtctgccatcagtcttatggtggactctttggaaagtcatgtcatatatgtctctcttttttttttaaagggacacgggaattaaggggggtcccgagctcga

SEQ ID NO: 506713 - DNA, 408 bp, Homo sapiens
gcaaacggtgctggagatctgcgaggatttctgcatgagcttcacgcccgatgtgcgggaggtggtagagtttgccatacacatcccgagcttccgtgaccttcctcagcatgaccaaatcaccctgcttaaggctggcaccttcgaggtgctgatggcgctcttggcttcattgctcaacgtgaaggaccatacagtgatgttcctaagccgcaccacctacagcctgcaggagcttggtgccatgggcatgggagacctgctcattgccatgttcgactccagtgagatgctcaactccctgtcgcttaccgaggaggagctgggcctcttcaccgctgaggtgcttgtctttgcacaccgctcgtgcatggagaattccgcttctgtggagcagctccatgacac

SEQ ID NO: 506714 - DNA, 835 bp, Homo sapiens
ttttcttttttctcacgagcgcgccatgtgttggtacagcggatcggccatatggccgggcgagtgtattactaacacggggtacgggggcgccagtcctacacttactaataatttttacattttcactaccacaacttaccaaatacataaaaaaatccaccccttacaacagcggcttgaaccctataaaccccgcccgcgtccctttatccataaaattcatctttgactctataggggggggattattagatctagaaattgccctacttatacacataccataagccttacaaacaactaacctgccactaataaaaatggcatccctcttattaaccataatcctagccctaagtctgtcctatgagtagctacaaaaaggataaaactgacccaaaaaaataaaatgtaagggaccaagatctcgtgtgcggccgcccaaggcccactccactataaaactcgagcaatctaatctaatgagaccgcaattgttgcttacttgcccaattccgacatagagggagtggtattaaagtgaacaactcctggttttacaacgtagggcctggaaaaaccatggcagttcccatcttaatttctttagaaaatatcgccttttctacagcggaggtaatattaaaaaggcccaaaagatcgcccttaaataagtaaggaagcctaaatgccaatggaaattataacccaaaattttgtgaaaaaacaagtcaaatcttagaaaagagcctatttttaaccattgggcgaaacccctaaatccctttaaaccaaaagaataaaccggcaggtgagggttttcctttgcccc

SEQ ID NO: 506715 - DNA, 1471 bp, Homo sapiens
tacatatatactttaataatttcaatgatttcttggtatctaaccaattaaggtaatattttctttaacacagaaaggctcccaaaataaagacaataatcaccacagaaatcacagctcaataggtttatttcaatttcacttcacttaagacacataattcaggcctttcccatttaatcaaacaaaacacaaaaaaaaaaaaaaaaaaaaaaaaaaaacaaaaaaaaaaaagggggggaggagaaaaaaagtctccccgagggggcccaaaaagagagaaaacgagatttgggtgaacaagggggcacccaaagagacgagcgaggccgaatataaagaagcagagagagacggagggcgacacagtacaataaaaaagagagagaggaggcgaggaaaacagagggcgacaagcgggagaaaaagagaagacgaggagcgcccctagcatagcgagggagagggaggaaaaaaacagagagggacacaaaaacaacacacaacagagaaaaataaaaaaagagccacaagggagagaaaaaaaacacacacgtcgacaggcgagacaaaacagacgggggcacaacacaaccacacgcaagacaaacaacgcacagagaggagagagaaacaaaaacaaaataatagagaacaaaaagcaagcaggcacagaagtacaaaagcacaagaagaaacatatacgaaaaacaccggagggcgcacagggagaaaacaccaaagcgcacgaacaacaagccagcaaacacaacagacacagacacgaaaaaacccagcacgacgcgaccgacagcacaacaagcgaaggcaaacaagaaagaggaaaaacaagagcggaagcaagaagaaagaggaccactaccagagccggacaacagagagacgggagcggacagaaaagggcgaagtgacaagagaaacgaagacagacgaggacgcggaaagaagcgaacacaacaagcgaaacagacgaacaagcgaggggtgagggaagagcgggacacagcacgaaaccagcacagacacaaaactaccagggcaggagggagaggagacacaagaggaaaaacctcaacacagaagagggagaaaaaagggaggaaagggagagatagagaaatagaggctgatgggaggaagaaatggaagagagaacagagggatacagcgtaagagcgagaagcagaagtaaggtggagggaaaacgaggagctggggaggcaggagagcggcaaacaagatgagacaagaacgacgaggagagaagagaaagaggcaggcaggacgagaggacagaaggacagaacaataagaagaggcgaaggagataagatgagaagatgatagctagggagatggacgagagagagaacgaggcatagcagatagagcagagtacaggacggagaggacgacgagaagagcagcgtgacaagacgaagtcgtcgtg

SEQ ID NO: 506716 - DNA, 411 bp, Homo sapiens
gacgaggtaaagcaaggacaactggaatgaggatatctgggaaaagccaaaggagctgggcaagggcctctgtgctgggcaggaccagaatggaatgaactagaatggacaccactggcctttaggccattaggccgacctgcccccctcccttttttttctgagttggagtcttgctctgtcacccaggctgtcacccaggctggagtgcagtggcgccatctcagcccaccgcaaccaccgcatccagggttcaaacgattctcccgcctcagccccctgagtagctgggaccacaggcatccgccaccacgcccagataatttcctgtacttccagtagagacggggtctcaccatgctgtccaggccggtcctgaactcctggcctcaagtgatctacccacaacca

SEQ ID NO: 506717 - DNA, 539 bp, Homo sapiens
tctcttcgtttcaacgtcacttctcgtgatgaacaagatttcagaaatggccttgcgcattagatgccaaatagtagatccagaagtcttaaggatggtcttctggagaaatgaattcagaagaaaattcatcaggtgcttcttttaaaaactagaactgtggctatatggaatgtgtatcccttaagtgaaatgatggtcaatggtcatcagtgtgtgaagtactatattgtacaagtaataaatgtatggtggagatatatggaccactgaggagcttataaaaacaagtcatcttaggttcacaatgtgctacaagaagaaagtgtgtggataacctaggaaattatgtgtaaggtaactgttaatttcagtacttagcaataagagtcctttaatcacagatgtatctggctgcattaggggtacaggttgaaatagttctgttggttgtcctaagaaatactgggaaaagaatctctgcatgtaagtttttctggttgaaactaagagggtttatcctgttccatatacttttt

SEQ ID NO: 506718 - DNA, 175 bp, Homo sapiens
cgggtcgacttctgacggccccccctcattactcagcaaggctgaatggtcaccccgtgctcacagtttgcttctcttcttcaacagtgcctcaccctccctctaggatgaaagtgcttctgcccttccacgaactcctcctccatttccttttgggattggtcaccatccttct

SEQ ID NO: 506719 - DNA, 258 bp, Homo sapiens
tggtggccagcagtgtcacgggtgtggtggacctggcccggaggggccggcgctggagcgtggagctgaagcgctccgtgagccatgctggggatgttggtctggaaaaattataggaactggtggatcactttctggccatgacggaagaagagctcggtgaggacgacacccttaaccctaacccctgagtcctgccccgttcccattccctgtggtacagatcagaaaggtctgagactcacccaaagtcacaca

SEQ ID NO: 506720 - DNA, 1142 bp, Homo sapiens
ttctctgtgtggactttgtcgtctgtgtcttgtcggctttgttctcgtgtttggggcactctctctctgtgcgccgtgtgtcgatcttggttcctcctgttgttcttttggtgtcattctctgcatcgggcactggttgactccttttactgattttccgtctcaggtttcatgggtactgacatgctgctattgttccgcagggttcctgtcattctggcctttgtttaatttgattgcacaaagagccaatctctaaacttagtccttgtctattcgcaattctctcagggtgcccagtattttgactaagttatccggccttgaaagctacttgagatgtgtactgctattctaaacacgtgatctagtgtctttcatctctggcataagattatatcacttaatgttaagtgtcatgaggcactaaaagccttaaatgtggcttatctataggatctgttttctcatcgaggtctcgggtatcctttcaaagatagtgagaagcagacacttgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaataagtggacaagctccgtctttagtgagatagaatacttcctgagaaatccttgacaagtatctctccaattttaccacttatgaaaactattcatataatacagaaaacagttgtagactgccttctccttattgagggaaaaagcggtgctttttacttgtataacagcagcgtcttatgtattttgatactaccagtggtgtcgaaacttccgatgctctataggcctcgagtacgagttcctgcatatcatgccttgattttggatgcttcacgtatgtcttgtgaagagaggtttactgggacagactctctttttgccctcgggaattatagcaaaatatcatgtttgggtgactgtgtaaagctcagtgtgtaagaacatctcttcttgtctagttcttctttctgctctttagtgaagacaataacaccccatagtgatagttacgcgttggggggggt

SEQ ID NO: 506721 - DNA, 211 bp, Homo sapiens
aaaaaaggggcccccttttggcccaaccccccccaaaagtaattttctgggaggcaaaaaaagggattcccaaaaagggttaggcctttttttttttaagggaaaaaaaaactttttttttttttttccggggggggggggggaagggaaaaagttcatttcccctgggggaaaaaattcccggaaaagaaaaaaccccacttttttttta

SEQ ID NO: 506722 - DNA, 814 bp, Homo sapiens
  misc_feature (717)..(717): n is a, c, g, or t
ctggttccgcgtgcccgttgtcgttaccgtgccacgctagtgttccaccgcgctccatgtgtgtttatccccccctcttcttgggcgctggttgccttcgagccagatgggcgcgccgccatgttctgttgtgtgcgcccggcccccaaaggtttgttgttgcacaggctattagtggtgggttcggcacttgccgggtttgtggtacatgtcgccggggtgtttgtcccctctctggccccgcaggggtttctcccacagttgccttacgcctagttgggtcgagccgcctacggcggtcgtggtgatcccgtccgtgcgcgtgaccttgcgtctgtgttgcctgcggagtcccacggcattattcgccattggcctcgaccaaagtagcggttttcccccggttgcgccccaagttgagatgcccaatcagtgttacccttcaggaggtgtagtaccaccccatcgaggcagggcatggatatatatccccgggtttcaacggtggagttcaggccccgcgtgattgcgatcataattcgggagaccagtgactcacgccgaaccactgcgcggcaatattacgacccggcgctgcttgggtagagattcatctgaaggctacatgaggacaagatccaccgtggattctttctgcgtttgaaaagcttgttgtccccagccaacaggtgggatgaagcacctcagtgatgcccnacccttgtgggggcacccactaaagtagggaggactttagaccccaaggctgggaacccccgagccaagggggaaacccccttttaaaaacaagaca

SEQ ID NO: 506723 - DNA, 407 bp, Homo sapiens
catcatatagtgatgagcctaatacataacggccctattgtggtagataggacccattaggtatttctgagaatacaccagtttgtatacctacaaaaatcttcgtggcagtacacaggttggatggagggaataaaaaaaaatggagagagtctgcttgattataactaattcattcaacaatatttgtggccaccactgtaaatgcactcagtaggaacgcaaaaacttgagaagggtcatcaagtcagctctgatttatataaatattaagaccctaaaatctcaacactttgaataaacattgtatcatttgatgcttctttatatctattctttagaaggctgaggaagaaaatgtggaaaaatcaggagagatagaggacagagatattggaaagagtcag

SEQ ID NO: 506724 - DNA, 286 bp, Homo sapiens
ctcagcccttgaagaattgcagcaatacgaacttttgctagaaactatagaaaaaccaacaaccttcaaataaaaggaaagaaaggaaccagcctatgagagaaactaattaaaactatgaatgcaacgacatttttgagtctgtacctgattgtgagctttaaaaagtcaaatgctttttaaaatgccaggagttttaagttggttaccaaatgccattcttatgttgaagtacagatacacacacacacacacacacacaaatatgtaattgaaacaagtttaa

SEQ ID NO: 506725 - DNA, 136 bp, Homo sapiens
ggatagttgaattgccctgtccacaagtcttaactccatggcaccccgtgcacctgtaggcagctctctgctataagaaaagcagacgcagcagctgggacccctcccaacctcaaatgcctgcgcattaataccg

SEQ ID NO: 506726 - DNA, 93 bp, Homo sapiens
gccctggaggtctgccaggacagtggcaccgtgttcccagcaggccgtggcaacgtggtgacaggagaccgggaccatctgacccgctgcctg

SEQ ID NO: 506727 - DNA, 646 bp, Homo sapiens
cgagaaaggactattgagtgtgcccagtggggaaacttctccaccatcctttgtcaccttgcacagcatagaaagattcatacctgagtgagccttatggaagtggtctttgtgagaaaatcttcagccgagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgtcctctagggattcaggactgtgctcagctcaatggaatggtttaattcccattgcctctgagagggttaggcagtgaactgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtca

SEQ ID NO: 506728 - DNA, 101 bp, Homo sapiens
acaaaagaaaaggaaaacaaaaagattattccacccccatacaagatgcttacttgagaacctgatggataacgtgtttggctggcgtctcctattatgaa

SEQ ID NO: 506729 - DNA, 260 bp, Homo sapiens
  misc_feature (18)..(18): n is a, c, g, or t
  misc_feature (24)..(24): n is a, c, g, or t
  misc_feature (54)..(54): n is a, c, g, or t
  misc_feature (145)..(145): n is a, c, g, or t
  misc_feature (178)..(178): n is a, c, g, or t
  misc_feature (217)..(217): n is a, c, g, or t
  misc_feature (223)..(223): n is a, c, g, or t
  misc_feature (256)..(256): n is a, c, g, or t
atgtacgcctacgccctncaggtnttccccagcaagaagagtgtgtggctgcgngccggtaacttgcgagaagaaccatggcactcgggagtccctggaagcactcctgcagagggctgtggccacctgccccaaagcagaggtnctgtggctcatgggcgccaagtccaagtggctngcaggggatgtgcctgcagcaaggagcatcctggccctngcttancaggcaacccccaacagtgaggagatctggctngcag

SEQ ID NO: 506730 - DNA, 233 bp, Homo sapiens
  misc_feature (187)..(187): n is a, c, g, or t
aaatcataaggcgatggcgagtgcatgtccggcgcatggggcgggaatcgattgtgtcatccccttgtgtgtcatccccttcgtgtgtcatccccttcgtaggcactggtggtccccggtccgggagtcacatattgatggcgaattagtgcggacaccgatcggcatagcgcactacagccagaantcctggactcaagcgatcctccaggctcagcctcccgagtagctgg

SEQ ID NO: 506731 - DNA, 322 bp, Homo sapiens
gcagcctttgtggaaacttaggctttgactccataaaaaatgcccccgggccgggtgcccacagggcaggcatttattttttcacagatttggaggctgcaagtccaaggtggaggggtgggcggggttgtgttttttgcaactgctccttttggctggcagggggtcccttccagccctgtcctttttggcctttcctttgtgcacctgcacccctggggtctttttgcctttaaatgtcctccttgtttatggaccccagtcagacaggattagggccccccctaagggccatgagttaatttaatcccccctttagtga

SEQ ID NO: 506732 - DNA, 93 bp, Homo sapiens
ggtcaatgctgagtgccgcgctgggccaccattgtccacgtgactgagcttgccaccaagcttagccggctggttgcagatggagtggctgat

SEQ ID NO: 506733 - DNA, 532 bp, Homo sapiens
  misc_feature (68)..(68): n is a, c, g, or t
aaaggtatccagtgttttaactacgaaattcgcaactcccatgaccactcttaacagtacgactgggnaacatattccatatcctactgatgttgctgatacgaacagaaggcaagggagatactgggtagtagagggcagttccccagcaaagcctcaagcctggaaacctacggccctaaatgggaacaggcattcctgtttctgcacccaaacgttgccttttggcctgccacgccccccatcctgtacccatataaactccaaaccccaggctccatgagcagaagagcagagaaatagaagagtggcaaggcaaggaaggagagaagagaagaagcatctgaatatcaagaggagttcagctgggggcagttggagagaagatcagccgcaggctggctgaactccaggtgaagatctcatcttcccactccattccctttcataccgctgagagccacctccatctggaataaaattcccagcgtttaccatcaaaaaaaaaaaacacggcctacttggcctcagc

SEQ ID NO: 506734 - DNA, 274 bp, Homo sapiens
gattattggtaaggtattattttagaaatcttaccatggcctttgcgctgaagtattttcatagctgtttatatctcttccattcatatatttaacatactgtctaatttcaaaaataggtcattaaagctttcatttttaagttcatgaaccaaatatttacttagagtggacggactgattgagaatgttccaatccaaatgaatgcatcacaacttacaatgctgctcattgttgtgagtactatgagattcaaatttttctaacatatgg

SEQ ID NO: 506735 - DNA, 287 bp, Homo sapiens
  misc_feature (12)..(12): n is a, c, g, or t
ctaattgcgttncgttcgatgacgaacgagtgcatagagcagccactgtgatctagtttatgttatgtcacgtgacaggtgtgtgggcagccacgtgaacagtgcatgttcagccacgtattcagtgcacgatagccacgtgataggtgtgtgatcatccacgtgaacagtgcatgctcagtcacgtgatcggggcctgctgagctgcgtgtttactgtctgctcatctgcttgacaattgccagctgagctgcacgattcctgcccgtcatcgaagaaccaattag

SEQ ID NO: 506736 - DNA, 1064 bp, Homo sapiens
  misc_feature (334)..(334): n is a, c, g, or t
  misc_feature (471)..(471): n is a, c, g, or t
  misc_feature (661)..(661): n is a, c, g, or t
  misc_feature (852)..(852): n is a, c, g, or t
  misc_feature (1020)..(1020): n is a, c, g, or t
atctacaagtgtgatctctaagttggtccttacgttatacttaagtactgctactgtcatgaaacgattattacattaggtccggtcatgagtggtctcatgtcctgataatcccaggcagtctaggcgagggcatagcacgtgtccgtgagcgtaaatcgaacctagcagtgctcacgagacgtttcagtacggattcacgacgcctgcgactcgacaactattggttagataaactccttgcttctcaataacgttaaaataactcactatacaatatttacggcgccagggctgtgggtggaccactggcgctctgttcacactcctcagncataactgcggtggacggctgaagagtgaggcgatgaatcaccgttgtaaaacccaacggtggaccacgtatacgtgagctacgttttacgcccacacgtactcgtcactttcacttgctagttccaagactctagngtgagacagagaagcgccgagaacttcagtctcagagatatgaaacagatctaaccacatcaccttaggcgggggacacgtactacaacacatccctgcgagacgcggcgcgctcaggaagcttaaaccgattctatctcgcttatctatctctgtagacaggggtgagtgctcctcataatcgtgtagngcggcacattcaagtgtttcagtgcacagagcgaagtgtaatcataataattaaaaatccgcgcatgcgcgagtaaacccagtgtacccaagacggccccctttctgtggcggtacgtgaatccctgtcctatgttcgagcgggggagggtacctacattgcgtcctaaatctctccacagataccatatntctgacgttggtcatacagtaataacttacataaaactatgaaccgcgagagtcttacaggggttgctaacttctttcgagccctcatgtccggacggacggagaacccctattgcgtataccgaggaatctaattctggagtaaatcgtgttcacccgtgaagtttntgatttacaatatatctaaccagggtttcggaataaatctccct

SEQ ID NO: 506737 - DNA, 229 bp, Homo sapiens
aggcgattttgtctttttctgagatgggggaactacagcgtgtgtgaaatgagctcacccacgagatcacatactctgtgtgcggaaagtgtggacagatgggttgtcacattagatctaccctgaatgtgcatttctggtgcctataatctataccgttcggtgtgagctcgacctcactgtcttgagccatggatgcgacatgttgcaggtgttcagaggttggggc

SEQ ID NO: 506738 - DNA, 405 bp, Homo sapiens
ggcacgcatgtcttcgcgtctttgggtgctgagtgtcggcagtgcatgtgctgaagccaccccttcagtgttgtgaggggcacctgctccccaggcccacagactgcctggtgccgggaccttcggtgttgtgaggggcacctgcttcccaggcccacagacagcctggtgccgggactttgcctggctggaccctcctcgtttcacagataagggggttgccctgatttgcccacagccatattgaatattgaataattcacatgagtgttggatggttgaacaatccatactctttgaccttagacccacatggccttttcagtcctttcctagctttaaaatgaacctttagttcttgagcatacaccagtggaaataggtattctgcagtgaggcgttgtg

SEQ ID NO: 506739 - DNA, 596 bp, Homo sapiens
cttggaacgatgtacgataccctcatagtgaccattaaacctgatcctccaccgcgaaaaaaaaaaaaaaaaaaaaaaaaaaaaaaaaaaaaaaaaaaaaaaaaaaaaaaaaaaaaaaaaaaatgtgtgtggggcggcgcgcgcgcgcgcgcgcccgcggagaaaaatatttttaacacacacacacatgtgtggtggaggagcgggcggcggcgccccacgggagaagagcagaaaaacgcggcgcacacaaggcggtgtgttagtcccgcaggaaagaacacgcgtcgcggcggagcacaaacaaaatagagcgggtgtgagcgtgtgtgctctctctcccacacacaaaaataaaacacagacgcgccgcgcggcgggagacaaacagagagaggagagtgttcttcagcgacaaaaacaacaacccccgcgcaagacggagtagggtcgtcttgatgggagagggagtccactgcccatagagcgcgggatcgtccatccaatccaccagacgaggaggagaataccaccacgcgagagagagacgacgaccctagccaaacaaaatagcaacatctatggccgcacgcgcc

SEQ ID NO: 506740 - DNA, 361 bp, Homo sapiens
ctcatgcctgtaatcctagcactttgggaggctgaggcaggtggatcatctgaggtcaagagtttgagaccagcctgatcaacatggtgaaaccccgtctctactaaaaacataaaaattagccgggcatggtggcagatgcctgtaatcccagctacttgagaggctgaggcaggagaattgcttgaatccaggaggcagaggttgcagtgagccgagactgcaccattgcactccagcccgggtgacagagtgagactctgtccctaattagagacaagattccttgtataacaaatactaatcatttcccaatatggcattctgggattcagataccacaggatttcttttgtttggt

SEQ ID NO: 506741 - DNA, 120 bp, Homo sapiens
  misc_feature (119)..(119): n is a, c, g, or t
gtgctggccggtctacggattccaggcgtgtgtacgcatgcaccggcagcaggcggccagcatcgtcgactgctgtgggggaatccccagcggcgctgcggtagcttccacgcaggtgng

SEQ ID NO: 506742 - DNA, 631 bp, Homo sapiens
tgtttatcgatgccaccagtggcggcagaactgcccatgggccagtggtggcagcagcaggagaggctcttccacttgtggaaagaggagggaagggtgggaaggatttcgtcttgtggtttgggttcaagcttagtagaatagaacaccaaacctggagaaagatgccaatattcaagtacaaggttatagaacaccaagcaaatttaacccaaagaagactacctcaaggcatttaataatcaaacttccaaaggtcaaaaataaaggaacctaaaagcagcaagagaaaagaaacaaatagcacacaatggagctccaacacatctgactgcaggcttttcagtgggaaccttacaggccaggacaatggcatgacatatttaaagcgctgaaagaaaaaacttgtaccctagaatagtatatcatgaaaatacccttcaaacatgaaatagcaagacagactttcccagacaaacaaaagctgagagatttcatcaacaccagacctatcttacaggaaatgccatagtttgcgaatctgaaagaacaggatgagcaataataaatcatctgaaggcacaaaactcactggtaataataagcacacataaaaatagactattataat

SEQ ID NO: 506743 - DNA, 511 bp, Homo sapiens
  misc_feature (495)..(495): n is a, c, g, or t
  misc_feature (497)..(497): n is a, c, g, or t
attcgcggccgcgtcgacaaaacaaccacaaaaatccaccgggcgtggtggcatgcccctgtaatcccagctactcagagggctgagacaggagaatcacatgaaccccggaggcggaggttgcagtgagccaagatcgtgccactgcactccagcccgggcaacagagcaagactaatcatagacagaatgtagaatagtggttgctagggtggtgctggggtgaatgaggagttactgtttaatgggtacagagtttcagttctacaagataaaaagagttcctggagatggatagcagtaatggttgcattcaatatgaaggtacttaacatcactgaacacttaaaaatcttgaagacacaacctggccaacatagtgaagccccatctctacaaaaaaacaaaaattagctgggcatggaagtggatgcctatagtcccagctactcgggaggctgaggcatgagaatcactttgaacctgaaggcagangntgcactgagccaag

SEQ ID NO: 506744 - DNA, 346 bp, Homo sapiens
ccctttttcccttttggggggcccccccggggggggggggtttttttaaaggtttttccccctttttgggggggggaattttttttttttccgggggggcccttttttttttttttcccaaaaaaaggggtttgtttttaattacccccaggccctttttttgaaaaaaatttttttttttttcttttttaaaaaccccccgggccccccctggggggggtttttttttttttcccggggcaaacccctttttttccctttgtttttttttcccggggggccgggttttttttttttttttttttcggcggggtttacccccgggcccttaaaaaattgcccccca

SEQ ID NO: 506745 - DNA, 2248 bp, Homo sapiens
  misc_feature (612)..(612): n is a, c, g, or t
  misc_feature (1015)..(1015): n is a, c, g, or t
aatattggtgatcatgtttgttgttatgtactaatttgttcaagtttgtgctgtcttgtattgagatgtctatgttgtgtgtgtagtagagtgtgtgtttgattgatggatgttatgtgataaaggtgtggttgtatgtgtatagtgtgttcgatatgtttggtgtattagtagttgttgagttgtattttatgttttgatttggtttacgttgattgatgatagtatttttagttttgattcgtttggtgtgtgtgtgtatgtgggagttgctttctaatgattgttttagtgtttttagtatggtgagtgtgtggtgtgattgttggaatttatgttttatttgattgtgggaggttgttgtatgttgttggggtgagttgtaattgtttataatttgtttgtatgtttgggtagataatgtgaagatttggaggtgtaaagtagggtttgtggttgttgtgaatgtttatgtggatatttatggtgggttattgtcttagttagttgttgtaggtattgatggtgtgtagagagtgtggtgaattgttgttagatagaactgtgtctcttgtttgtgtgtatatgattgatgtgtatatcaatgatcangtactgaagaagattgagtacgtgttgtgtgtgtgatgttgttggtatgactttattgtgtgaggtgtgtgttgttgtattggtgtgatgtgattgtggtgtggttgtttaatgaatgatggtgtttggttgtgtgtgtgtatttagggtggtggtgacgtatctagtgatgatcaatcgactttgggggtttttgtcagtggtggatgactcatgggttggttgttgtggtggttgtcgcctttcttgattgtggtgggtgtgggctctactgtggggctccggtcggtgttgtcttgtgttgtgtggtgttgtttggtgtgttttgtttgtgtgtgatgactgcctcctcgcgagttggctgctcgtcgtgtttgcgatctggtggtgtgctgctcgtccnatcggtgttggtggtgagttgagtgggctctcctcgagtcggggtggtggtgggtaaccacaaagtgtgtgtttggtgtgtgagtttgtcttctcttctgtttgttgtttgtagggggtttccaacaatatgtggttgtgtcgtgacatcatggcctgcgtgttgtatgtgtgtgggtggtggagtaagtagtagtgtatttttgtatctccacctggttcatttatggcacctcataaggtggtgctgctgtgtcttcgagctgtgatgatgttgtggtgtgaagtagtggcatcagggtagtggcatcaccacataataattgttgtatgtagaagtggaatgtcgtccccgtcgacatttgcttagtgggtgttgcatccaactgggtggggcgcgggtgtgtgtcgcctcaatatggcgtgtgggggtgatggtggtctactgcgtgtcgtctgttcgtcatagttcgctacgcatacagctgtgtgtgcgatcatctaatatgggctcctaactaataggggtattcaatcgctgttggttgggtagatgctcaaagtgatcgacggagggggagccgcaagtagagtagtttttgtggggtgatgaatcaacacggtgggtgttgtgttgacgatgattacttcgtgatatatatgtcgttttggggggctacacgattacaacaattcaatgtggcttgaggggcgcgctttagtggtgcgtcagttatggtatgagcagtgttgtggcacttgtgaattatctttgtctcgatgtggagtgtcagaggtcgacgagatagagagattgtgctagtagagtgggtgtcgtcacactaatatgggtcgtcacgagatgacatccacactgtctctcccgtgtagcactccagggtgtgctgtcacagtcttatggcgtagtgcacacacattgtgggctccacacacacagtctgtctcaactacaacacacagtttgtcaaagacacacacaagggtgtctctcacatgtgtgtgcatgtgatgtgcacagtgcgcaccacagattatgatctcacatagtatgtagtgggggtgtctcacgtgtatgtctagtcacacacacagtatcacgtgaacacaccgtcaggggctcacagtgacacaggtgtatatcacatggtgtttgttaactctggttagtctctgttagatttagggaggtatacagtctcccaccaaaataaat

SEQ ID NO: 506746 - DNA, 299 bp, Homo sapiens
gctatagcatcgccgataacgaccttggggtgaggggagaatactggaagctttacttcatgctaaagctgtcgctaattggaaaacctctttccgccccctccaatcctctgttcactctgtgctctcaaagaatagttgggagggacaagtcctgcggtatctatcatagcctttctctttttagggactcctcctcctcatcttttctccctctccccgccctccattccgttcttcccgatacaaactgttgtctcagattccgaccgagggaatgttttcctcctgtttcttga

SEQ ID NO: 506747 - DNA, 368 bp, Homo sapiens
tagctgggattataggcatgtgccaccacacccagttcatttttgtattctttacagtagagaccgggtttcaccatgttggccaggctggtctcaactcttgaccttgtgatccacccacctcggcctcccaaagtgctaggattacaggcgtgagctaccgtgcctggcctgatctgttttaaaaagagatagcctccttgtattaaataaaatcagcctaaccacttgagatgggtaagttcagtgtgtacatttatattcatctacagaaaaactaccgagaattttataaacctgcattgtcaaagaggatattagaaaacgattgggacttatatagtaaaatctgtatttaggaacttaag

SEQ ID NO: 506748 - DNA, 717 bp, Homo sapiens
agcgggttttacccaccccctagacgccgatgggcctagaaagtgtctctgtcgagcaacgtgacgccaggtctctgtaccgaagatggggtttgtaaagtgttaagaataaggcctacgtttaatggagataccaagtgaaatttagaagcacgacgagagggtaaacactgatggatgtctgctcgagaacactgcttgtgtgatacacgataacacgataatacaacacacccaatatacaaggatgcatagtccgccgtgcacgaaatcagagatactcattatagacaagactagctttatttgcccgaataaaaggagggatatcgattagtactagaagcaagacagtaatagcacacgaacatgcgcaaaactactaggtagtgacagggttagtgcctagaccaaaaatctatagctagaaagcataattagtacatggcccttcgctagaatagaacacgcagcacgggctagcatcacataagcgtcataagcgaaaattgaggacacacaatgcatcctaattgaacagagagcctaacagattgggagcggatgaatagtgggttgaactaggacaaatagcacaattattgggaaaaaacgcatgtttggaaacgaagtaaagaaccagagagtgacccttccacacttgctaagtaatggcgaattccgaacgcaacctatgccagtaacacctaacgcata

SEQ ID NO: 506749 - DNA, 98 bp, Homo sapiens
ctgggttcctggaagcaaggattggctccccttctgcctctgtccccctctttctccttcgctgtgctcctcccctcctccctttgggctcccagtcg

SEQ ID NO: 506750 - DNA, 442 bp, Homo sapiens
  misc_feature (67)..(67): n is a, c, g, or t
gacggttggctggcgcgcatagtatccatacgcctgtgaatccgacagagccgccgagcgtctgatncactttagtcaggagaccgataggatttcttgacaaatcctacgcccgacacggacaatagtggccgactgacaggagtccctatgcgtcgtttgtttttttccttgctgatgctctgcgttttgcccgcctgggcagacagccatgaccagttgtacaaggtcgccggctgggcagaccagcgcgcgcattttaatgacgccctcagtgccgcccagcaacgctaccgcaacagcctgccgccggcggtgtatcaagcgctggtggacaacagcaataaacgcttcgcgccgcagtcggtagaccagcgcgccgaagcacagctacccaagaatctggcggacccgaagccggctttggccttcttctaatctc

SEQ ID NO: 506751 - DNA, 329 bp, Homo sapiens
  misc_feature (109)..(109): n is a, c, g, or t
  misc_feature (176)..(176): n is a, c, g, or t
gcccccctaagggctttttgtttgccccagggtgctccatggatttccctgtggcaacaggcatggagagtcagggctgcctttatggcagtaggctttaaatgggtgnctggccacaggccgaaaaaaaggttcagcctttaggtggggttcccaaaaacgccttcaggctggantgaactgctttcccacaaggtttttgtgcaactggattttttttgttgcaaacaagcctggcatttgtttccccttgtttctgagtggccccacatggggcttttaacaggctgtatttggattttggcaataaaagtactttgggtgcttga

SEQ ID NO: 506752 - DNA, 1176 bp, Homo sapiens
gccagaacttcgcccccaacttcaaggagagctgagatgaatgccatcgcggccgacatgtgcaccaacgcccgccgcgtcgtgctgcaagagctggatgcccaatggtcaatggtgctcaatggctgaggatgactgcctacaccaccttcatcatgtgaaacgggcaacgatctgagccgtgacatgatgggtgtaggagcatggcttcgagaccgccagccactgaggtgctgaggctgggtccactcgtgctgaatgccctgctagtaaccctgaccagcctccctgctgggggcctgcaacacattccgcctcgcgcaacgacacgacacacaacctagccatcttgcgtcactgagctacttgtctagtacccttccccaggacaccagacggctgtggttgctagacatgtaaccccggaacctcatggaccactacactgtccataccccactatatcccacacctgagcagctggtcgccgaggacgagtgactcgcagtgacagtgtggccgtgcagtgtcccgtgtctgcctatctttagagacacactctgtgccagctgcgggagagataactggatcgcccaaacctaagacccatagccgtcatcaccaacactcaaacaggcccaaccagggagacgggggctaggacatgagaggtacacagggcgacaggcccactccacacggacccgtacgagccaaccataccgctggagaagccttaaagcgacatccggacccaatcaagttggacagcccaccaatgagcgaccttttgacgtggcgatggccaccaaagcggcgttactaaactagaccaccatcaccaaacatgactacacaagtaggatcacacagtaatcacaacaaggcgagctatcctgtgataagcgcatctgatgtaatcaccagtcagcccattgaggggagcagaggcgtattagcctgaatgccactaaatgtgtgacaatcccacattgtaatatatctaggtgcgtcatagcacgcggcgatcacgcctaaactgtgcgtaaacaccgtgaacactactatggtaggacacgaacacatggctagtgcactggtagcacacctactcttcaatatcacacactagaggtactattaggtaactcagagtgtcttacaacataccagtcc

SEQ ID NO: 506753 - DNA, 111 bp, Homo sapiens
  misc_feature (16)..(16): n is a, c, g, or t
atatagaaaatatcancaagtcaggatttggtccacaatccaatgtgcaaatgggatttctcactgtgaaagaaaacctcaggcggttggctaaaataaaagggatttggc

SEQ ID NO: 506754 - DNA, 651 bp, Homo sapiens
  misc_feature (649)..(649): n is a, c, g, or t
attctagaggccgaggcgggccgacatgttttatttttttctttgttttatctctttttttcgaacaacaaagagcccctcttctttttctcccaacaaaaaaaacaacaaaaaaaaagaaaaacaaaaaaaaaaaaaccagacacacaacaacaacatcacacatcaacacacaaaaaacaaaaaacaaacaacaacaaaaaaacataaactcaacacaccaacaccaaccaacaaagaaaaacggctagacacaaacacaacacgcaggccggcggacgagcggcgcgagcgccaagaatgagaagagagaagcatcacgacagcagcacagaacagcagagagagatacgagcaaacaagaacgaatagaccacgacgaacaacagaacaaaggcgtggtggggtggcgcacccaacaccacgcaacaaatagacaaacaagcgccggggagggggtcacgcgacaggcagcgagtgagtactacatgaaatacaccaacgcgcgaagggaaggagcgagcagacagacgagacgagcaaccagcaacgagagagacaaccaagagcgaagcagccgcacgcagcacagcagcgcacaacatcactcatatacaaacaacagcacccgacgagggggagggggggnag

SEQ ID NO: 506755 - DNA, 526 bp, Homo sapiens
  misc_feature (441)..(441): n is a, c, g, or t
  misc_feature (449)..(449): n is a, c, g, or t
  misc_feature (484)..(484): n is a, c, g, or t
  misc_feature (486)..(486): n is a, c, g, or t
  misc_feature (492)..(492): n is a, c, g, or t
  misc_feature (498)..(498): n is a, c, g, or t
  misc_feature (500)..(500): n is a, c, g, or t
gccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctcttcggatccccaaggccccttccgttgcttcattctccggaccgcttccgttcctcttgaaggaaaacacactcgccccgttgcccggaaaccgcggctttcttcccaacgcggggcaggccggggcttgttaaggggcaacccgccttgcggatctttggccgggggttttaggaggcggtttcttccggtggaacaaagccgggggcgttgaggggcggtttttccgggttnggggcgcncggggcatgtttcgttaagaagcggaaaattccantngccctnggcttntnccttcccggccgccggttttccgccc

SEQ ID NO: 506756 - DNA, 378 bp, Homo sapiens
gggtaactatcacccttaattttctttaaatttagatctttgagtttgagcttttcattttaggtcaccagccctcgaagaaatctgcagtttctggcctaacgcggtggctcacgcctgtaatcccagcactttaggaggccgaggcgagcagatcacaaggtcaggagttcgagaccagcctggccaacatggtgaaaccctgtctctactaaaaatgcaaaaaaattagctgggcgtggcagcgcactcctgtaatcccagctactcgggaggctgaggcaggagagttgcttgaacccgggaggcggaggttgcagtgagccgagatcgtgccactgcactccagcctgggcaaagaagccagactttgtctca

SEQ ID NO: 506757 - DNA, 600 bp, Homo sapiens
aaattattagtgcaaaccactagtgatataacccaaattttttaatatctttattttccatcaacttgatctgtagacgtcaagagaatcatatttaatgcccccttgcatctcctttctgtttttattactgaatctttcaaatatacacaatagcacagagaaaaatataacggatacctgagtacccatcatccttccttttcatatcttaacatttgtcacacatactcctgaaagtattgttttaattttagctgtttattatgagttacacttaccaagagagtagggagtatgaatgtacagtttaaatagtattagctattaaatacatatgtaactaccactttgttggagaaatagaaaattaccaacatctatgaagccttttgggtatccctcctcaactgtgccctctcttttttccctgaggtacaactaccctgggttttgtcttcatcgttacctaactgtttttgaaggtttattgcacatgtatgaataataaacattatattgttaagttttgcctgtttttgcactttaaataaatggagggtactttttgcactcttctgacttggttttttttttttt

SEQ ID NO: 506758 - DNA, 281 bp, Homo sapiens
ccttagcgtgggcgcggccgtggtactgcttcttttggtcaaataatgttgccagtatgttttctgcattttggggagaaatattagaaaaaattttataatcttttcctgcttttttgacagctgcgctttctactactcatcatattttcagggtttcagattggtaaccgtttattttttattttgtaagacagagtctcgctctgacacccagtctggagtgtgcagtggtgcaatctcagctcactacaacctccaactcccaggttcatgcaatc

SEQ ID NO: 506759 - DNA, 409 bp, Homo sapiens
cctcctcggactcctgcctcactcatgttacaagccgacaccacccaatctatctatataacctagaccatcggccatccccttaatgcaggcgggcgcaagtgattataggctttcgctctaagagtgtacaaaatgccctaatccccacttcttaccacaagcgcacacctacaccccttatccccatacctagttaactactcgaaaaccatcagcctactcattcagaccaatacccctggccgtacgcctaaccgctaacattactgcaggccacctatctcatgcacactaatctggaaagcgccaccctagcaatatcaaccacttaaccatccctctacacttatcatcttcactattctaattctacttgactatcctagaaatcccctctcgcctaaat

SEQ ID NO: 506760 - DNA, 296 bp, Homo sapiens
  misc_feature (97)..(97): n is a, c, g, or t
  misc_feature (103)..(103): n is a, c, g, or t
  misc_feature (123)..(124): n is a, c, g, or t
  misc_feature (156)..(156): n is a, c, g, or t
atagtctgttgggtctaggctgagaatggctgcaaagtactgtttcaccagccgggttctctttccacagcttcgtagtttcttcacagccaccatncccggngtgttgtgggagccacccanncacctcccacaagagcaggcactgccacttcncccagtttgttccagatgtctccttgtcgcttggctctcgatggaaagacaatgcgcaccaggaggcaggtccaggtcaaggccagcaaggcggcagagccactgctcttactgggaacacctgctttggagactagttc

SEQ ID NO: 506761 - DNA, 768 bp, Homo sapiens
  misc_feature (150)..(150): n is a, c, g, or t
  misc_feature (252)..(252): n is a, c, g, or t
  misc_feature (365)..(366): n is a, c, g, or t
  misc_feature (679)..(679): n is a, c, g, or t
cggaaggcacactgcaacattctcctgagattttaactagtgcccagtaaactccgctataaaagagatatgataaacattcaaaaagggagtaaaggaagagttaattatgtagtctcagggtaggcagagaaatgactgctgtcctgncttgtctgcacctgggaagataagcttgtaatgggcatgtcagtgtgaaatgtaacagactgcaattccgtggacagggagctagacttagattgcagaccnaaagttacagctgacatgtccttttttatgggaagatacacatcttgaaaggtttagggaccagcagagaatttacttatgagcaatttgagggcagtcatccgggatgcacnnggccttctgccttctccaggggtgtggctaatgcatagcgctttgacacaaggttgggaagtcgcagctatctactgggcaggggggcaaggtgcgaggggacagcagcagtgtcacgtgactgtctctccagtcttaagtttccatttggcataaagagtttgggcagtcctgagagggtttattttcctttacacaaacaaacaaagagttccattttctccccactcctttttgagacagggtctcactctgtacccaggctggagtgcagtggcgcaatcttggctcactgcaaccgtcgcctccaggnctcaagccatcctcctacctcagcttcctgagtagctaggactacaggcatgcaccaccaagctcagctaattttgtgtgtgtgtgtgt

SEQ ID NO: 506762 - DNA, 825 bp, Homo sapiens
  misc_feature (326)..(326): n is a, c, g, or t
  misc_feature (573)..(574): n is a, c, g, or t
ggacgaccatctgccagcttctctcgtccgtcgattgggcatggagcggtggcgacctcggccttcagtgtttccgacggtagtgaatggcggtcgtgctgcgctgtggatgctgctgttctgggcttgctgcaggcgggtgggtcggtgctgggccaggcgatggagaaggtgacaggcggcaaccttcttgtccatagctgctggattgccatgcagccattcaccactcacgtgctggtcataccctgatccagtctggctcgcctggccacacttgggtccatgctgcccgcaggggtgacaaagtctcgtcctagtagcanttttcatccaccagattccattccttgggcatgccatagcattgtgggaaacagtccgaattgaatttctagaacatagtgcgatatgagaagtatggacctgtatttagttttaccatggtaggcaagacatttacttaccgttctggggagtgatgctgctgcactgcttatttgataggtcaaataattgaacgacctgaatgcgagaagatgtctacatgtcgcctgacaacgaccgtgtgtnntgggaagggagttgcgtacgatgtgcctaatccagtgtctgtggagcagaagacaatgttgaacgagttggccttaacatagccctactttaaacatggatgttctcctagtactgtgataatatgaaacctggggaattactttgagaagttggggagaaaagtggacgagaaaaagtggtgtttgaaggctctttcctgagctcgttaattttaacagcttagcccatggtttgcatggcacaggacac

SEQ ID NO: 506763 - DNA, 297 bp, Homo sapiens
ccttgacttgttgggctcaagtgatcctcccacctcagtcttctgagtagctaggaccccaggcatgcaccaccatgcctagctaacattttcgaagagacgggggtctccctttgttgttcaggctggtctcagtcaaactcctgggctcaagcgatccctgtctttgcctcccagggtgtaattccagcttctttggaggctgaggcccgagaatttacttgaacctgggaggtggaggttgcagtgagccgagatcacaccactgcactccagcctgggcgacagcaccacttt

SEQ ID NO: 506764 - DNA, 119 bp, Homo sapiens
tcatggaatgtctgatccaccatcgaggtcgtaacaccctattgttgatatggacactagaaacgaggattgcgctattatccctagggttaactatgtgccgttgtgtcaagtaattg

SEQ ID NO: 506765 - DNA, 1024 bp, Homo sapiens
ctcgtgagaggcctggatcaatctttctcctttgcctggacaagatgggccttgagtgagtcctctcagcaattaagaacctgcctgatagaggacaggaggtggtgagaagaaactgtggcacaggtgactgaggtatctgtgatagctaatcctgtccaggtggactgtaggagaatttgatgattggtgcagagagaaaacctgaatacggacgcgtggtcgagtggaaaatcctcgtgccacgaaccaccactgctgaacatcggcgcaggggtgctgcgaagctgtgattgagaatcatatcacgcccaccattgttgcggtgtgccaagtgaccctacccacgcgtgtgcaggccccacttggcgaggttgtgataaagcgtgtgcgagcagagatgactcatcataggacctttcggacgtcgttccttgccgacattctttgcgcaacaatggtgcgacctctgtgacgtgagcgaccaggacagggacacacaagtctccgcctgtgactacatctgggccttgcgactacagttccccccttgaccttggttactctgagctgacccgatcttccctcgctgagcatgcgggactggctcaatggaacgtcctggtcactcgctgtagtgagagcggatgagggtacaaccacccttactgggggtgatgatagctgaagctgtggcgttgatgaagatcctaggaagaaatggggaacccgcctgcgacgctggcgagcatcgcgtgtgctgctgggcgcggagatcgagagtgagtgtcacctgtcgtcttcctggtacctgggctttcggcccttgggtctcaccccttgggggaccctcccggcggggtggcttcctgtgcccccgtttacccggggcttggctcccgggtttcacagctgctggcgggggtgttcccgagatggggggttccccacggaggttccggcttgtgtgaacctcaccccaggctggttccccggccccgcaaagggggggacgcgcgaggaa

SEQ ID NO: 506766 - DNA, 381 bp, Homo sapiens
ctcccagcggggcacattcacttgcagccaggcagtcaagcaccagctggggctgcatggcacaaccttatctccccaaaatattcaaaaactagctgggcgtggtggcctgtacctgtcgtcccagctacctgtgagggtgcggtcggaggatggcttgagcctgggaggcacaggctgcagtgcacctgagctcatgctactgcacgccagcccaggaaacaaagtgagactctgtctcaaaatacacacatacacacacacccccagatttatatctgagatggagtctcgctcttgttgccccagggatggagtgcacgaggatatgatctatggctcaatgcaaactctgactatctgggtacaaagtgattcttg

SEQ ID NO: 506767 - DNA, 206 bp, Homo sapiens
acaaaccagatgtcagtctgcaggatgttcattctggacagagtggaaggtgatacttgttcccttaatgagtttaccttaactggttcaacttatgcacctattggagaagtgcttaaggttgataaaccggtgaattgtacacgagtatgatggtctggtggaattagcaactattgtgctcttatgttatgatcagctttggg

SEQ ID NO: 506768 - DNA, 486 bp, Homo sapiens
tatacgtaatagggagatataatacatcaatcaatacatgtaagatagacataggtacgatcgggggggagacaactatgaagtggggaggggggaacttagaatagtatgccggttatataggactgcctttcttcctttactccccatgggtcctgtaggatctatgatgagataataggtattttatgctccaattttctcataaggtcaaggacatgaatacccaatgatctcagcttctggtcattagagataagcagtgtttccatggtgtctctgtttaattctagtcaaaagcaaaggaacatgatgtataggttagcctgtgtagcatcattgcagcctgatgggtgacacttcacaaacttgtagtatgctaaaaataggccacgaaacccaatggactcaccctgttactggtggaaggtgtacaagttactagcagtgaatccatacgggtctgcaccaacctcaattcttgcc

SEQ ID NO: 506769 - DNA, 113 bp, Homo sapiens
gactggggtagcgaaggctgctctgtcctggtgctcccactaaagtgagaagggctgatcactcaatgttgcgaacaccaatgctcaagcaattgagccctggtaaaattgct

SEQ ID NO: 506770 - DNA, 188 bp, Homo sapiens
tctgtgtgccgcattaggtataggaatatgccactctgccagagaagttcacgtgagtgacagctagatgagaactgaggattctcccaggcagcgaaacaaagaagcaatttgatggtatcctctgaattactgcagtcttcaatgattgtcttcagataagttgttctcacacaataacaactgtc

SEQ ID NO: 506771 - DNA, 888 bp, Homo sapiens
  misc_feature (192)..(192): n is a, c, g, or t
gtcctcagcttcaggcgccaccattgacctgggacagtgatatcgagcaatgccgtgcttctgcttctcgtggcggtcagtgccttctctgacttggcctaaggtcgctgttgacttcgactctggctacccctgttcttccacctggtcatgagagtatgcccctagagggacgtatgtctcgtcctcagnatacgtatctagatagctatcgccaacacatgtatttcaggattcatcgcaattgccttacaatgacattgaatcacctccctcctatatcacatgtgacttgcaagttacagactctctacagctctaatatccgtgcacgctggtcaccatctaggtccacaaagatcaatcgtaatatacttgcgttgctcccactcagttcgaagctatccggttacctagccctttttgcatattgctctccaatggtgcgtgtcctacaggcttgactattctagcgattgaaaattcctgggtacgggccttgttaattatcattaccatcatctgtggtgattactcgggaagagcctcatagatcctagtggagatgagctatctcgggtgcacccaatgctctccccgtttatccccttgctattaccccatgtccaggtaactagaccccatgatcctagcttgacccaaactcgtgaccgaattggggtcctcgttacctccagggcgaacgggtccctagagaagccttatgctgtggaatataggtccatacaggatgtgaattgtgtaagcataatgtttgtgacccatttactaagcaaaggccctttttcactggttccaatcgtttctgccagttggacttggccgaaaaacgaagagttcgagattgaaaccaccaggattcgaacg

SEQ ID NO: 506772 - DNA, 336 bp, Homo sapiens
  misc_feature (166)..(166): n is a, c, g, or t
  misc_feature (175)..(175): n is a, c, g, or t
  misc_feature (260)..(260): n is a, c, g, or t
  misc_feature (305)..(305): n is a, c, g, or t
  misc_feature (327)..(327): n is a, c, g, or t
atcccagcattttgggaggctgaggcgggcagatcacgaggtcaggagttcgagactagcctgaccaacatggtgaaaccccatctctactgaaaatacaaaaattagctgggcatggtgccacacacctgtaatcccagctactcaggaggctgaggcaggagantcacttgancctgggaggcagaggttgcagtgagctgagatcaggccatggcactccagcctgggagatagagcgagactccatctcgggtccnggggagggaagatttaaagaaggagagatgttacaataaatgttnctttaaacatatatatatattnccccaagtg

SEQ ID NO: 506773 - DNA, 97 bp, Homo sapiens
tgcagtgctagagaccccgggggctcacccctccactttgggaatgggaccaggctcactgtgactagaggacctgaacaaggtgttcccacccgag

SEQ ID NO: 506774 - DNA, 125 bp, Homo sapiens
agccccaaccagacatctgtgtacttctgtgccagcagtgatggacaggggaatatggctacaccttcggttcggggaccaggttaaccgttgtagaggacctgaacaaggtgttcccacccgag

SEQ ID NO: 506775 - DNA, 444 bp, Homo sapiens
gctggttagtccacgctagatgcctactgagcgatgctcgtgggccgcgagcagcgctgtgctgccggtgagaaggaccgtggaggtgctggtggtgcgcgcttcgctcaatcaatgaaaccacgaggacgttgtcgccgcatatgaaatgccacgaacactttgcatggcgcgcgaagcatcctgtacgtgtgcgcgcccagaggatggtccaatcgcgtctgcggtgccgagacggataccacacgcgcgtagcacgctgtgctacgtgtgtgcgccacttgcacgtatgcatagacgtcatggtatgctgacgagcccagttcgcgcccaagcggctttcgctgaggcaggttgaccacaggattggcgtcctggtctagtccttggtgcgcgcgggacctgtggacgctagggggagaggcggcggcccaagggtgcgcc

SEQ ID NO: 506776 - DNA, 110 bp, Homo sapiens
  misc_feature (25)..(25): n is a, c, g, or t
  misc_feature (27)..(27): n is a, c, g, or t
  misc_feature (30)..(30): n is a, c, g, or t
  misc_feature (32)..(32): n is a, c, g, or t
agcatatatctctgcagcgttggtncngananggatactatggctacaccttcggttcggggaccaggttaaccgttgtagaggacctgaacaaggtgttcccacccgag

SEQ ID NO: 506777 - DNA, 236 bp, Homo sapiens
agtaccaagatgattaataactccaatgctgggccttcacgtcgaggatcgctcacgtacaggcgcctgctggaaggcgaggacgcagagtctactatagtcgcattgcggcgtgtaatgtctgtgctcatgcacctcccttggacgacgtcgttgagctgggaacaccctgcgtcaggctcccggccagtgactggcagtgtctgcaggaacccacgctctgcaaggaacccact

SEQ ID NO: 506778 - DNA, 100 bp, Homo sapiens
  misc_feature (27)..(27): n is a, c, g, or t
ctctgtgccagcagcttaatggggggnggatggctacaccttcggttcggggaccaggttaaccgttgtagaggacctgaacaaggtgttcccacccgag

SEQ ID NO: 506779 - DNA, 132 bp, Homo sapiens
  misc_feature (44)..(44): n is a, c, g, or t
  misc_feature (53)..(53): n is a, c, g, or t
  misc_feature (55)..(55): n is a, c, g, or t
gccagcaccaaccagacatctatgtacctctgtgccagcagttntagtacggngnggaatcagccccagcattttggtgatgggactcgactctccatcctagaggacctgaacaaggtgttcccacccgag

SEQ ID NO: 506780 - DNA, 1023 bp, Homo sapiens
  misc_feature (222)..(222): n is a, c, g, or t
gcataccattgtgtctttatacgtgtactagaacaattattttaatgagttcattatggtgaaggcattaaagtattctgaggaataagatttagggctctggtctactggggcaaactaaagttcagtgcacaggatattctgcagttaacgtcacatagataaaggttatatgtaagaaagttcaggctgtgaattttttcaaggagacatatcttctcntagaatttgctaatgttgagacaatggttaaataaagcaatagagtctagtttcatgccaatttggcaattaataagtttaaattaagaaaacaaaggaaaggcttcaatttgggccccattcaaatggattgcgcatgggtattaaaacagaaccattagttggcggcccactatttaatcaccacactagtggggaataatcaactttaagtgcaacggcacgactaaaacaacacaccacgggcactgacgtttccaaatggtcccctacctggtaacggggaccattgggcatttgcacccgcctgggggaaaccccaatttacatctacatccaagccacaaaagcttaattcgacccacacgtgaaccccaggcacaagtaacccaaaaaaaccaacacgggcgaattgttattcttccaacgttccatacagggggtggggcgaaaatccggaaaaacaaaaatggcaaggaacaacacccggttggggacccagcacagggggcaacacggtgcgcgcacaaaccaattttccaaacagaacaacccccgggtggtgggcccccctgaggttcatgagttggaaggcgtttcggacccggcggggaacgatgggcggaggacggggggacattaaggcacattttcaaggggcagggatataattaaccccttaaaagtgggttgatacaccaggaaccggaaggtttacaattggggagataggcaactgagcaaccaaagcccaaaaacacggttgttgacacccacagtgggtaacttaacacgcgatta

SEQ ID NO: 506781 - DNA, 119 bp, Homo sapiens
gacagcagcttctacatctgcagtgctagacgggacggaataggaatcagccccagcattttggtgatgggactcgactctccatcctagaggacctgaacaaggtgttcccacccgag

SEQ ID NO: 506782 - DNA, 134 bp, Homo sapiens
gtgacttagaggatccgtctagctcgccagtgtaagacacttccacactcttcctgggccagacagacacgcattctcatctctttaggccaggctcaggtattccacagtccttccttcgttaagatacctca

SEQ ID NO: 506783 - DNA, 126 bp, Homo sapiens
agccccaaccagacatctgtgtacttctgtgccagcagtgatggacaggggaatcacccctccactttgggaatgggaccaggctcactgtgactagaggacctgaacaaggtgttcccacccgag

SEQ ID NO: 506784 - DNA, 353 bp, Homo sapiens
tcatccccggttctgggtaacatagctctataaaaaaattcaaaaattagccagccatggtggcgcatgcctgtagtactagtaccagctactcaggaggcggaggcaggagaattgcttgaccccaacagttaagactacagcaagctatgactgtgccactgtacactaacctgggcaacagagcaagaccttgtctctttaaaaaaaaaaagggaaaagaaaaactagttgtgctcagtgccttataatcccaacacttcaggaggccaaggttgagaggactcacttgaacccgaggagtgggagacctgtgccgtggaaaacattagcaaggaccttcattcttacag

SEQ ID NO: 506785 - DNA, 108 bp, Homo sapiens
ttctacatctgcagtcccgttcctttaaggggggactatggctacaccttcggttcggggaccaggttaaccgttgtagaggacctgaacaaggtgttcccacccgag

SEQ ID NO: 506786 - DNA, 252 bp, Homo sapiens
tctagaggctccccgctcacaactggcacagcgagacctccgtagccgaccatgtcgtctgtgtcccgtgtacacaccctcttctggaggtgggtgcggtctggggcttcatagcattcgcctactcggtgaagtctagggacagagaagatggtgggcagacgtgaccgggggcccagtgcctatgcctccacgcgccaattgcctgcaacatctggggcccgtgtttctggtgttcttccacaatagaaa

SEQ ID NO: 506787 - DNA, 106 bp, Homo sapiens
ctttgcgccagcagccccggaccgggatggggtcgatggctacaccttcggttcggggaccaggttaaccgttgtagaggacctgaacaaggtgttcccacccgag

SEQ ID NO: 506788 - DNA, 126 bp, Homo sapiens
  misc_feature (44)..(44): n is a, c, g, or t
  misc_feature (53)..(53): n is a, c, g, or t
  misc_feature (55)..(55): n is a, c, g, or t
gccagcaccaaccagacatctatgtacctctgtgccagcagttntagtacggngnatggctacaccttcggttcggggaccaggttaaccgttgtagaggacctgaacaaggtgttcccacccgag

SEQ ID NO: 506789 - DNA, 148 bp, Homo sapiens
  misc_feature (17)..(17): n is a, c, g, or t
  misc_feature (40)..(40): n is a, c, g, or t
  misc_feature (46)..(46): n is a, c, g, or t
  misc_feature (60)..(60): n is a, c, g, or t
atgaacggatacaggtncggcaggcccgagcgtcaggtcntgctancgcgtcggacagcncgacgtcttgcccggcagccattcgaggttgccgtgcttgccgagatggatgaccgcgtcgatgtgatacgcatcacgcagccagaaa

SEQ ID NO: 506790 - DNA, 791 bp, Homo sapiens
cgcggacaatgaccacaagatgctggacgcaagcgcaggcaacgccatctatatctggcctaaccacactgccccctgtgcatgtcattaaggctgctctgctcaactttgatgatgtttgcggtcagcaaggatggcatggaaaagctactgaccatgatgcccacggaggaagagcggcagaagattgaggaagcccagtggccagaccctgacatacccctgggcccagtcgagaacttcctgatgactcttgcctccattggcggcctcgttgtcgtctactactctgggccttcaagctggactatgacagcatggaagcgggaaattgctgacggccatgtgtctgacctggaaagtgggtatggaacagctggtacagaatgccaccttccgctgattcctggctaccctcctagcggatgggcgaacttcctcaagtggctcccagagcagtcggctttgagctgagctacctggaaaaggtgtcagaggtgagaggacaccgagtgcgtcgacggtcacatggtacacccattcttcgtgcatccctagtgtcgtccaggacctcggcctgaggtccgctgaaccttctaattcaggaaaatcccgtgcaccgtgacccgtctgagccaagggatggaccttttggaaacagcgtggactgaagaaccctggggcatgcgttggaaacgcccgagaaacccagggggcaacgcccggaaggggaacagaagccgcttggaggggaagccccttggggcccagaacggccattggaagcctgg

SEQ ID NO: 506791 - DNA, 320 bp, Homo sapiens
ccttaccgtatcctacggctgtacgtgcagtgctgcgatctcggcctgcactgcaatgctccgccgtcccgtgttcacaccattctcctgcctcagcgctccgccggttcctcggactacaggcgcctgccaccacgcccggctaatttttgtatttccatcacagatagagtttcaccattttggcccaggctggtctcaagcctctgagctccggttatccgcccaccttggcctcccaaagttgctttgaatcccaggacgtgagcctctgctgcccggccctattctctccttttctcgcataccgtagggacagt

SEQ ID NO: 506792 - DNA, 81 bp, Homo sapiens
  misc_feature (8)..(8): n is a, c, g, or t
  misc_feature (21)..(21): n is a, c, g, or t
  misc_feature (53)..(53): n is a, c, g, or t
  misc_feature (65)..(65): n is a, c, g, or t
cgcccagnaaaattgaggcancagtgaactgtgatcatattactgcactccancgtgagtgacanagtgaaaccttgtatc

SEQ ID NO: 506793 - DNA, 598 bp, Homo sapiens
  misc_feature (357)..(357): n is a, c, g, or t
gacatggcgcttgccagactgtgtatggagagaccgctagcggtgaaccagcgcgggtttatcggactggggggtcgtgcagatctcgctggatctagtgtccaggggaagtctcgagtgatggtctgatgccgtggtccgcgccgggcatggggtgtcccgagaaaggagccaggacgtcggtagagatgctttggcatggaatcgaaccagcccatggtgcttatcgaaaggtgtgccgtcactgcggagctcgagtaaggtctgtcgatgcgtcgacatcacaaggggtctaccaaggcgcgtgtgcattaccattgcactcacgcgaggagcggtgaagaagggtgatacgangatcaaggcacagaccttggctaggcgagcatggctggggggcgcaggcggattgcatgcttctgggcaacgggtagttgggctcggccaaagtccgaatcgtactgaggctgtcgaaactagaggcacacgcgatcgtctggtaggcgagcatgcgctcgcaagacgtgcgttgcgcgaaaccactggtgggtgatcggtcagccacaaggggccgtgggggggcatgttcgcatggggc

SEQ ID NO: 506794 - DNA, 327 bp, Homo sapiens
  misc_feature (2)..(2): n is a, c, g, or t
  misc_feature (41)..(41): n is a, c, g, or t
tncacactggccggcacggtgtactggactccattgatggngaagtttatgtcggacaggctgctgatggcggagcagctgaccaccatgtcgccatctgagttctcgctggctccgatgtcgctctggatgttggcaatgattctggttggtccggtcagcagagagttgccggtgtcaacaatggcctggcagccctcagcgcaggcgatggcctctccgttcatggtgatgctgtccacggcgatctgccagtaaccctcgacggtaacaggcacccagatcagacttccagtgtggagagaggcagtgcaccagtgtggagag

SEQ ID NO: 506795 - DNA, 97 bp, Homo sapiens
ggatttgctggtgcagtacaactaggcttaatagggacatgtaaagatactgatttaccttgacacttggagaacgtgaagaatcaccgaaaaaaaa

SEQ ID NO: 506796 - DNA, 436 bp, Homo sapiens
tgatgaacgaaactaaagacatgcgaataactagaaatgtatctgtgtctataacgcgtaagattaatattgttaaaatgccccgtattaatcaaagcaatctacagattttatgccatccatatcaaaacttcaatgacattttttacagaaatagaacaacccgacaattggtatggaactatagaagatgctgaatagccaaagtaatcttgagcaaaaagaataaagggggaggcgtcacattacctgattttaaaatctactataaaattatagtagtcaaaacaactttatactagcataaaaacagacaaatagactaatggaacagaacagaaagcccagaaataaatccacacatttacagtcaattgatgtttgacaaaggtgccaagaacacacaatggggaaaggacagtctctttgataaatg

SEQ ID NO: 506797 - DNA, 639 bp, Homo sapiens
aagcagtggtatcaacgcagactgcccattacggccggggggggacaaaaaaaaaaaaaaaaaaaaaaaaaaaatggggggcgcgccccgggcccctcggaaaaagcttttatataaacacacattgcgcgtgtgtgggcgcgcgcgggggcccacgagagggtataagggagaacacgtggggcacaaaggcgcgggttccacaaggaaaaccgcgcggggccagagaaacaagggggcgggagaatttccacaccacaatataaaaacacgcgcgcgcgcgggggcacaaccgcgagggcgtttgctggaaacaaatatcccaaagggggagttctctgagggagagctctcatatatagagcgaggaatctctatatatcaagagagggggagactctccaagagcgcagagagcctcgcagaatatatctcaaatattatagcgccccgcggcccgggggtgtgaaaagaaaaaatgataaaatagcaatttataaatgaaaatacataaacaaatacaaaacaagacaaaaaaaaaatctaacaccaacaaacaagtaaaagaaaaacacaaaaaaaaaaacaaacaacaattatcatcacagcaaaatacataacacaaaaaaagtcgacact

SEQ ID NO: 506798 - DNA, 149 bp, Homo sapiens
accttgagctcatgaaacccatggctgttctcccatttacttaggccattagcttcaccgatctcctctgtcgccgccccgttcctggcttcaccgtattcatcagttggcagagaacagggcagacacctgcgccacaaagtcacatc

SEQ ID NO: 506799 - DNA, 235 bp, Homo sapiens
tgtttgcagccggctgcaaacttgtgcagctgctgaggatacggaaattaataaaacaaaaatgtggctgggcacagaggctcacgcctacaatcccagcactttgggaggccgaggcaggaggatcaccaggtcaggagttcaagaccagcctgaccaacacggtgaaacaccatctctactaaaaatacaaaaattagttggacgtggtggcgcgtgcctgtaatcccagcta

SEQ ID NO: 506800 - DNA, 290 bp, Homo sapiens
ggtcgaaatggaccgtgcgttcccaactcgatctgcgttaatactttggtaagtatttctcacagctgttgttatcaaagcagaaccggttattaaaacaagtgttctcattgttcaattcccaactaagagtgagaacatgcggtgtttggtttctatccttgcgatagtttgctcagaatgatgggttctagcttcatccatgtccctacaaaggacatgaactcatcctttttatggctgctaatattccatggggtataattgccaaatttctaatccagctacat

SEQ ID NO: 506801 - DNA, 668 bp, Homo sapiens
ccggcaattcgccataaggacgttttcttctttctcatcaagagagtgagtcatattttatcttgtgataaatttgcagcctaatctcaatcgcacactaacagatcgcaaaggcaagtgccaccagataaatcggccccatcccttcttttcgctacattgtataaagtaagacagaagtagagaagagtaatcagcaagagcaacaaaaatcaaagacagaaagcacctccgctgcacgggaacccaaaggtacgcttacactcaaaccgtggtgggacaacttggaatgtgaagggtgttgtgggagagggagaagggggaagagaagaaacaagatgacaatccaccgctgctgcttaattcgtaacacaccttaacttatacatttatcttgatctgttcgggggagttgtaggtaggtagtgttgttggcaggcgtgccagcaccgggcatgggggtccttgaggtgtagttgttaggaatttgttacaccagacggccaccgcgcaccccgctacgcaccacccgctcgcctcactaattacagataccgaagagatcaaatagttgcacgagtgtagtcgggatgcaggcacatcatttatcacggggaagcgtaagcattcgttggtctgcgttactcgtgctcattatgttgatggtg

SEQ ID NO: 506802 - DNA, 1264 bp, Homo sapiens
ctgatggatggacttgggggcacccgcgtcgtgcctcctgggttgtggaggagtcgcccgttgccgccactgcctgtgcttcatgtagtgatagatgctcgccagcgtctcccgcgtgctgtctgtgctgcttctctagaatgctcggcagcagatgtgcttgggtagacatccgcgtgaaagttgtttgccaaagtgatcgcttacatttgaaattaaagaatatgttgaccttcaccggctggaagaaggccctcctgtcacaacagtgctcaccgagtggaggatgggctcaatatactgacaggatgatagcagactgtatcgtccgaatggagtttgaaagcagatcacggcatgtagtaaacagtaacaattgattcgtggtggctgtcacgttgctagtgattggtcagtgaagtcttgctgtcgtgcggcctgcgaggcccggcatcaacgcccaacagagccatctcatcactagcctaccgggactcacggcttattctttcacccgcgggccctttcctgtcctgacgcatcacttctcgccagagctttactagcgaccgaaaagcggcggtctgttgctgcaccgtggcacactcgtgcaggatcgcatgcaccttgtgtcgccaatgaccttctcagccggcgggcatggcatcggtgggagcgcaggtgcccctgggcgctgggacttgctctagcctgtacagtatacatggccccccgatgaggccctgccctgactctactagtggcgactggtgcctgctcaacccacgggccagaatactgtcgcagcgctttaacccacatgggcaaggctctcggtcgggacagaattccacccccttcgcaacatcctgcgattcttggttagcacgcacatcactcccgcgatcggcctttggcgaacccgtcctcgtctggcagccgcacgccggcccagcccactcactcgcatcaactaaccacacgacgcaaccgccgcaacgccaacaatatacccctgggggcctgacacacttgggccttgcgagaatgggccataaccccttgaagaccactcacgcaaaaaggcaaaacaaagaggcaccacccacgccagcgcacgtacacagacaacacacccaagcacaacgggcaaccccacccaagcaatcagagaacagcagcacaaaccataaacccgacaacccacgcaaccccaaaaaccgcacacaaccataggcaaccacgcacacggagcaccgaccac

SEQ ID NO: 506803 - DNA, 1222 bp, Homo sapiens
  misc_feature (444)..(444): n is a, c, g, or t
  misc_feature (812)..(812): n is a, c, g, or t
ggggaagatggcggatgacaaggattctctgcctagagcttaaggacctggcatttctcaagaagccagctggaacagccgtgcagcggcgatgttaggaagcacgaagtcgaacaagtggaagtgggccacgggatggcatcgactgttgtgcctccccgatgttctcaatgggattcctggctggtctatgttggtggaccatagagcttgatgggctatcagctagctatttgtgcgcttttagacctggttggggtcacctggcaactagtggcactctaatgctggctcacggcgatatttccttgtagtcccaaccgtggaagcaagacatttaacgggactgatttgtcaggattgcctacgacaatgcgggtccctgaactagactcataggtgccatgtggaaacgagtgcagagtatgtagccatgtctctagncttcattcaaagttgagaggcacatcttatgtcctgtcattttcccgctcaagaacatggtctactcaccaattttgggacgtagtccttccaaaactttatttccttagacccatcccatttccagttcccttttggtctcatcccccattgtactctggtcgatgcacttcgctgtgcaacaatgtaatgatttccttgcaaggactctttggcaatccgcgcattggggcaatttgcccattttgctttttcaccccctttgttaccccatgaagaccttttccccaatggaggcgcaacattcccgtcgcggctccgacacgggatcatggtcagcggcggtttactaaaacgggattctcaanccctaaggtgcgccgcctttaaacttacttgttcccacaacgtcggctccttgtactcttgtggtggcgtgagtatttagggattacggcattggccccttccttggacttgccctttcagcgtggatttacctccctgcctttgagtccaaacctaggttttcgcccatcgggggtcttttgctttcgccttattgcctggaggggaagagccatggggggcgttcgccaaattatggttctgtttgcaacgtttttggttccccctctgagagatatccggtttggtttcatggtcgagagtttctcggccttggcttggtgcggacctcggtgttaaagccgctagggcccccgaaaggaggggtttgcgtcttggctgcgtagagcgggtacattgcaccgcattg

SEQ ID NO: 506804 - DNA, 893 bp, Homo sapiens
cagctaccttaaagatgccgggatccgcagcgaaggtgctcggagttgtcagagaggatcgatgagcttcgtggagaccctgaagcggggtgtgtggtgccgcgcatgctccgagtgaaatggctcgtgtgagaccctagtgtgttgctgcgccagatcatcactggaccacctgcgtggatgcaactgctgggtggtgatgcttgacttgtgatggcttgactcctgcatgatgatgtgttgcatgtgatgtgattgactgtgcctgctcatgcccctccgatgaccacctgtgtgtgcaacattgtgttgctggatgagtgctcaagattatcctgtggatgtgatgtatgtgcagactccatgtgacagcagctgacgagatgtgatcagcaggagtccctgcacaaacttgtttgacatcctggatggcctaaacgaggatttccagcttccattatgcccaactccagtccaacatcatttgagtgctgattaatgatgctgctagtggacgctggctgtgttgacaattggaagaacattgcagcccagagctctggagcacattcactccacatgagtgtgatcatgaccatttggcttctcccgaacagtagaggccttcctcaaagaggcttgccgaaaggagcgaaactccatgtcattgtagcccgagtgtgctccctttctggccagtggtccttgaaattggctgtgcattttgttcccaaggcgtggtatgagaccactgtcatgatggatgctgcaatatgtgcagtattgtcacgaggcaccaggtggatagtgggcacgagacgtctgtccattgggcttgatgtgtaggagaacattggcatgggacgaaccataccccttgttcaccttccaat

SEQ ID NO: 506805 - DNA, 147 bp, Homo sapiens
tcaattaaatgattcatggttccatacacatattaaagttaaccatcaaccaccagcccatcatactctttcacccatcagcaccaatcctacctccatcgctaaccccactaaaacactcaccaagacctcaacccctgaccccca

SEQ ID NO: 506806 - DNA, 137 bp, Homo sapiens
ctagcaggatccctttagacactctggggctaggtatagatcccaggagaacccgtgtctacaaacctcactctgggcaaaactggacccagactggggttttggggatgcttgatggtaatgaggcaagtggctgc

SEQ ID NO: 506807 - DNA, 734 bp, Homo sapiens
  misc_feature (90)..(91): n is a, c, g, or t
  misc_feature (93)..(93): n is a, c, g, or t
  misc_feature (126)..(127): n is a, c, g, or t
  misc_feature (131)..(131): n is a, c, g, or t
  misc_feature (150)..(150): n is a, c, g, or t
  misc_feature (167)..(167): n is a, c, g, or t
  misc_feature (170)..(170): n is a, c, g, or t
  misc_feature (177)..(177): n is a, c, g, or t
  misc_feature (184)..(184): n is a, c, g, or t
  misc_feature (201)..(201): n is a, c, g, or t
  misc_feature (205)..(205): n is a, c, g, or t
  misc_feature (214)..(214): n is a, c, g, or t
  misc_feature (216)..(216): n is a, c, g, or t
  misc_feature (221)..(221): n is a, c, g, or t
  misc_feature (241)..(241): n is a, c, g, or t
  misc_feature (243)..(243): n is a, c, g, or t
gagtgcggcggggcgcgcgagcggcgccagctcggggcagcggaacccagagaagctgagggggcggtagcggcggcgacggcgacggannanatcccgcgcgtgtgcccagcctcttcccgccgnnagcngcccttttcctccctcccnttacgtccccgagtgcnggnagtaccngcctccnttcccagaccgcgcggntttncctccagancntctcnggcgcgggtgagccctattncnccagaggcaggtggtgctcgaccctgataacccaaagtgcggaaacatgctggactaagacatcatcatctgtcacatggtgggcacacatgtcacttgaagcttcagagcaagcaatgtaaaccaacaagaatgaaccacaagtccatcaacatctcgagtcttcatatggaaacctcaacacacgctctggtgaagaaactcagatgtggagaccatcttctctaagtatggccgtgtggccggctgtttcggtgcaccagggcctatgccttgtgtcagtcactccattgagcgcatgccggggaagcttgtgttgggcaaacaatgcgcggttgcggccgggcagaccctggaactccacttggctgggaagctaaggctgagagaccagggtcaagagaggcttggctttacagggtaccttgacagatcacggagattacaggctcgaacggcctgccgcaacagggcttaaccggtactggggg

SEQ ID NO: 506808 - DNA, 129 bp, Homo sapiens
ccggtacccaacgctgctcacaccgtgggctgttacttgctttgagttgaagcggtttgcatttacgcctgtaaatgtattcattcttaatttattccttaagagtttttgtttatgtgagagcgttgg

SEQ ID NO: 506809 - DNA, 135 bp, Homo sapiens
gacagacagccggaccccaggctcacgcaatttctcatgctcagcctcctgagtagctggaattacaggtgcctgctaccatgcccagctaattttgtattttttttttagtagagatgggggtccggctgtctg

SEQ ID NO: 506810 - DNA, 1033 bp, Homo sapiens
  misc_feature (113)..(113): n is a, c, g, or t
  misc_feature (373)..(373): n is a, c, g, or t
  misc_feature (479)..(479): n is a, c, g, or t
  misc_feature (985)..(985): n is a, c, g, or t
  misc_feature (1009)..(1009): n is a, c, g, or t
gccttacttgtatgtttgaatacttcctagccttccctgtaggcaatagtccaacacagttcggtgcgagagattacctatgtgatttctatccgtcatagtatatgatcctnggaagttgcgaagtgtcgagttgtctcgtaaccgttgtgtgctcactagagtggtggacagaacatccttatgcctacacatagtgactttgtgtagatcgtaaggccacaacgtatggtaatatctcccattatattggcttgtgagtatctattggtccccttctcttcccaaccgtttgagattgctcgactatttgggtgggtatagctctgctctaatgcgcttggttgcatctctgaaacgctctataagctcntccaggtatatcgctccctatttatttcatcgaaaagttagttcccaaactttttgtagactctaaaagcaagctgcacaaatgtgtaccattttctgtgatccangcatgcacatccgtccatgtgtctcttttcgaaatgctctttggccctaggagatcggacccaacctatgagtgactgctctattttaatttcgagactttcgattttcaaatgacgttgtgtacgagtgattcctattacgcccaagtctcgttgctttcacccgtcttttttatctaccccctattgacgtattgtgtcaccgtttgtccggggcacttggcaaccccgtagatgtagatacgtttttggcttcgaacccggcagcgttgcaggcaaatactttttattccgtcttttcctacctggctatccccgaatgtggcgttttactgctcgtttctcccaccccggtaagggtcagcccgcaataatgtaatgacgctgttggaaaagcgccttccaagacgaggtcaagaaatgaccggttacagtgggacatatgtcctccgtactaagagtaaaacaacaatcttttcttagaacgaagagcgttagggattttntttgcagaagaggggtcttttccncccttgggtggcccttaggcctgg

SEQ ID NO: 506811 - DNA, 462 bp, Homo sapiens
cagtccaatgtcctggcaacaggagggggccccagtgatcgacacatttgcatttggaatgtgtgctctggggcctgtttgagtgccgtggatgcccattcccaggtgtggtccatcctttggtttccccattacaaggaggtcatttcaggccatggctttgcccagaaccagctagttatttggaaggaccccaccatggccaaggtgggtgaactcaaaggtcccccatcccgggtcctgagtttggccatgagcccagatggggccccagtggcatccgcagcagcagatgagaccctgagggtatggcgctgttttgagttgggccctgggcggcggcgggagcgggagaaggccagtgcagccaaaagcagcctcatcccccaaggcatccgctgaagaccaacccctccccccagttgttttttatttttttaataaagtcatgtttcccttcca

SEQ ID NO: 506812 - DNA, 202 bp, Homo sapiens
agcggagattgagaggcagccacagccaccccaaaaggggtggcagagccctgcctgtggacagggccggagtcatcggcccgcatggcccatcttccacaggtctcccccagccgatagtgatggaggcactggacgaggctgaagggctccaggactcacagagagagatgccgccaccccctcctccctcgccgccctc

SEQ ID NO: 506813 - DNA, 1672 bp, Homo sapiens
  misc_feature (978)..(978): n is a, c, g, or t
  misc_feature (1253)..(1253): n is a, c, g, or t
  misc_feature (1273)..(1273): n is a, c, g, or t
  misc_feature (1421)..(1421): n is a, c, g, or t
gtctcgtcagcgagggtagtatcacaaaacaaatgggtgggagcatattgagtgactcgtctgctcgttgctgcacgcgagagtgggagacccgctggggtgtctacaaccaacacccgcgcaggatagtggggtgacgcacaccaccgttggggccaccggaagatacagccggtttacaccccgcggggagataaaaaacttcctgtggtgcgcagaatggcgccccctcattggagagccctttgtggatagaaaagcctctccttttcctcggggggggaacccaaaatatgtggggggcttcttcaaaagaggtcgccaaagaagaaaggggtggtcctgtctgcaacagggggaaaggtttgccgcgttgtcgggcgcgaccaacgaggttgttgccttgtggggttgcaagcagagcccgaaaaagaaaaggggcgcccccccccccccagagtgggggagaagcagccaagcaccttgggctgttattcaaacacatgggccttcacaagaggttgggattgttattccgccttggcagaccaccatgccccgacggggccccgccaaaaaataaaaatgcgcgccctcggcggcctttaatggtcccccgccgtggcttaatatgtgggggattttgccgccaacaccaccccacgggcgttctcaacaccactattgggacaaacatatggcaacaacaagttgtttttgtcctcgtgaagagtcttgctgaaaacaggggagatataacagaagttttggatttcccgccgcgcgctgttgtctttgggttataaaaaaaaagcttctggggagaaagaatagtggggcctccctcagaaaattatgtcttctggggagaaagttgtctctggggtgagattagcctcgggccccactctggggtgtgagaaaaaatggggtgtctcccttcgggtcaacaaaggccccccacagagtgtgtgtgtntgtgagagagaggctgtgtctctcacagagacttcattgtcccacaccgtcttttgggggggtgtctgcctctttgcgtcgtggtgtttctgttgagatatattgagagacgacacagacgacacagtgtctgtcggggtgtggggtgtgtgtcactgtcacacagagtcacagtgtgggacgacacacagagaagggcctctgtctctgagagagtctctggggcacacagggtgtcacacacacacagtgtctgctgactccacaagagaaanggctctcacagagagagggngtcataaattgagaataattaattccctcaaattaacctcggccacacccacacacttcttataatcacacagtgggtgggagaagagacacggtgtctcacgagaactcgttttgtgttgcacacattgggcgcacatttataagtnttatagtgaagtataaaagagactcggtgtaaatgagtaacacaatgcactccgtaaaaacctctcacgagaaggagaaaggaggaaatgtttttgtggagccacactcttggtgtttctctttttggcgtggtgggcacgtttgtaaagttaattagtgttttaaaaatcagtacatttttaatgggaacaacttgacccaaaatcttgtcaccagaattttgagaccccattaaaaaagttaaatgaga

SEQ ID NO: 506814 - DNA, 336 bp, Homo sapiens
  misc_feature (63)..(63): n is a, c, g, or t
  misc_feature (234)..(234): n is a, c, g, or t
  misc_feature (286)..(286): n is a, c, g, or t
  misc_feature (302)..(302): n is a, c, g, or t
atatcagactccaagttcttcagcttttggactcttggacttacaccagtgttttgccagggntcttagatcttcggccacaaactgaaggctgcactgtcagcttccctacttttgaggtttttggactcagactggcttccttgctgctcagcttgcagacggcctattgtggggacttcaccttgtgatcatggaagtaggaagtgattatccacattccataggaaggangaagcggcttcaggaatgggtctcatctccagggggagctgtccctcttctnggatctctggggcaantccagttcacaggcaccctttcttcctcctaggc

SEQ ID NO: 506815 - DNA, 130 bp, Homo sapiens
  misc_feature (47)..(47): n is a, c, g, or t
  misc_feature (70)..(70): n is a, c, g, or t
  misc_feature (81)..(81): n is a, c, g, or t
  misc_feature (100)..(100): n is a, c, g, or t
  misc_feature (105)..(105): n is a, c, g, or t
  misc_feature (108)..(108): n is a, c, g, or t
  misc_feature (117)..(117): n is a, c, g, or t
ctagccctagcccctagagcctagctacctagctagggactctcctncccctagccctagccactctctntagctactaangagcccactagcgccatangctcnacnctctaaccnctcctgggctact

SEQ ID NO: 506816 - DNA, 281 bp, Homo sapiens
ggatctgggccatacattgaattccttgagccctgggatcatggctttgatccaactgcatccagcctaggctgctgacgtttgacaccagggcagtaaagagtgcccttttgtatcttaaaccaaaaaatgaggcctgggggtgggggaggggggaaagggtgggaaaaaccaaaatagggcctgcagcatctactactctgttttccctattcagaacttggaactaaagtatttaaaaaaactgattttaaatgcaaattaaagggcagatattctca

SEQ ID NO: 506817 - DNA, 438 bp, Homo sapiens
  misc_feature (31)..(31): n is a, c, g, or t
  misc_feature (222)..(222): n is a, c, g, or t
ccgcaacactcccctaccaccttgtggacgnttgccctggcgcgggcgattctcagccagtgcatgtatttcctcgccgggttcctttccgaaacataatcccgggaaatttcgactccgggagggggatggggcggtgggacggggcggacacgacaaccggggacgcagattttaacccggatcatagacgaaaagaacttcccctttttctgacgcgcnggggcgggagaatgaacggagggatgttcagtctatccggagggatgcatgtcgagaggaaatggtcctcctcggagccaaatttttattaatccacaagccccacccaagccggggccgcccctcctgggcgaagcagcgcccgcgagccggcgatcgggaggcgccaggagcccggaatctcacaatcgcgcgggctcggagtccgggcggccc

SEQ ID NO: 506818 - DNA, 355 bp, Homo sapiens
ccccggccagggttttttttttccccccccgggttgttccccaaatggggggggggggggggccgcccccattttttaaaaaaacccctttcccttggccctgggcccccaagtttttccctttaaaccaagacccgggcttttccccccccccctttttcgggggccccttaattaacttccccccccccccgccgggcccccggtttggaaaagggggggggggaaggggaaaggggggggcccccccccccccaaagggcccccctttttggggccccccccttaaaggggggggggggggggggggcccccaggttttttttttttggggcaaaaaaggtgttttgcccca

SEQ ID NO: 506819 - DNA, 102 bp, Homo sapiens
tgtgccagcagttactctgcggcgtcgggtcatggctacaccttcggttcggggaccaggttaaccgttgtagaggacctgaacaaggtgttcccacccgag

SEQ ID NO: 506820 - DNA, 749 bp, Homo sapiens
  misc_feature (67)..(67): n is a, c, g, or t
  misc_feature (269)..(269): n is a, c, g, or t
  misc_feature (628)..(629): n is a, c, g, or t
  misc_feature (631)..(631): n is a, c, g, or t
  misc_feature (633)..(633): n is a, c, g, or t
  misc_feature (639)..(640): n is a, c, g, or t
  misc_feature (646)..(646): n is a, c, g, or t
  misc_feature (657)..(657): n is a, c, g, or t
  misc_feature (660)..(661): n is a, c, g, or t
  misc_feature (663)..(663): n is a, c, g, or t
  misc_feature (683)..(683): n is a, c, g, or t
  misc_feature (685)..(685): n is a, c, g, or t
  misc_feature (692)..(692): n is a, c, g, or t
gggcttccggtgcctggctccgtttcctgcttttggttcttacagtagtcggcgtaggccttagatnttttactgtctcctgaagaatttaacacaaacatgggatatcagaccaaatcatacaatttatatcaacaatatgaatgacaaaattaacaacaggacagaaatgaagagatccctatatgcccgtgttttctacagttagggtcatgtggtggacatgtgtggctttaaagaccatgaagatgcagggggcaggcctttgntcatatttaagtgaactgggctcatccacaaatgccttgaagacagctacaaggattctccattttatggtaaaccaatgcgaatacagtatgcaaaaacagattcggatataatatcaaaaatgcgtggaacttttgctgacaaagaacaacgaacacccgacaacgaaaaaaagccaaaaatgtgggaacagactgcaaacaaccaaaaacaaaaagcctggccagggaactccaaattcagctaatacgccaagggaaattcaacaccaaatcctcaggttcctgattaccctccaaatatattttattctcttaataactttaccagaagagactacattgagatgatgttatcnnangnctgttnnaatccngttcccctggnttnnanggaagtaccgtctggtaccngnggaggcntgacattgcttgtcgtcgactttgacacaatgatgggggtgttggagttgcagggtg

SEQ ID NO: 506821 - DNA, 292 bp, Homo sapiens
atatgctgttaatcacccccgaaatgaagtggcaggcttcacactttctggtcagaaccacggcgcacaaaaacaaaaacttgggcaagcactcacaatattagatattcattaaaaaagtatatatagggcgggcaccgtggctcacacctgtaatcccagcactttgggaggcccaggtgggcagatcacttgagctcaggagttcgagaccagcctgggcaacatggcgaaaacccatctctacaaaaaattaaaaaaattagctgggcgtggtggctgcttgggagac

SEQ ID NO: 506822 - DNA, 104 bp, Homo sapiens
ccctggcgattcgcgtgcatgttggctcctcagcgtcgccgctatgaagaaagtgttcaacagctccggctggagccggactaaccgcgtaaaagttcccaggc

SEQ ID NO: 506823 - DNA, 95 bp, Homo sapiens
ttctgtgccgcggggagaccagtcatggctacaccttcggttcggggaccaggttaaccgttgtagaggacctgaacaaggtgttcccacccgag

SEQ ID NO: 506824 - DNA, 131 bp, Homo sapiens
agccccaaccagacatctgtgtacttctgtgccagcagtgatggacaggggaatggaatcagccccagcattttggtgatgggactcgactctccatcctagaggacctgaacaaggtgttcccacccgag

SEQ ID NO: 506825 - DNA, 109 bp, Homo sapiens
ctttttacaactgatgttcgttaaagccaccaaccacacgcacccattgcggtgcgggcgttaccgccacctgccgcttgagcatgtccatggcatcggccagcggtgg

SEQ ID NO: 506826 - DNA, 130 bp, Homo sapiens
tccagtccacggagtcaggggacacagcactgtatttctgtgccagcagcgacaggctcacccctccactttgggaatgggaccaggctcactgtgactagaggacctgaacaaggtgttcccacccgag

SEQ ID NO: 506827 - DNA, 236 bp, Homo sapiens
gttttctaatgcccccctgaagtttaaatttgtggcccaaacaatgtaagcaaggggtttgtttttttaaattgatttgtaatttgaaaatactgaacaactcctattcccctttttggtaaacccaatttttgggtttgggaaaaaaccattccagcttaatgcctttaattttaatgccaacaaaattggggggaatcaaattttaaaaaaaaaaaaatttggcccccccttta

SEQ ID NO: 506828 - DNA, 114 bp, Homo sapiens
gacagcagcttctacatctgcagtgctagacgggacggaatacacccctccactttgggaatgggaccaggctcactgtgactagaggacctgaacaaggtgttcccacccgag

SEQ ID NO: 506829 - DNA, 1061 bp, Homo sapiens
gaagttcctcatggtacccattctagatcgtaatggctttgctactgcttggcgaacaacagaattctatgctatataaaaatactcactggcccgaagcgtttgtatgcccctactagggctagtacgagccattcgctgacgccattaaaagttctacatcgaaggaggctcctaaagacacgtcagaagtcatagacaatcgagcccctcgacagtcatccgccctcgtatcctttaggcgtctaagctatcgagtcttgttctagatagtggaaccggacacttacccaattagggccaatcgcacgccgtgtgtcagagtcgtcaaggctgagcgccttgctctattgtaattctatatccacgcgtgttatgcgaaatggcggttgtgacttccattcgatatgatcttggtgtcgcatcattggatcgtggtgtacgtggcactattcggaagcaagtcgtgagacaacgcgaatcaccagaggacgtgtctcatacgtgaaagctactccgcgtatgatccgttgagttttgacataatcaggaatgactgtaaatgaggatgtgactcccgttcatgaccgtcctcacaccccttagtcaagattcaacaagtaaatagcatcctgagttaagtcgctaagcaatcactggatgccgttgttcgcgttggatactcgaatcttagtctctccagtgtaccaagaattacccgagcaacgaatgtcgcgactgtacggaaacgtttgagcagaaaacgagcaaatcccgagagctacctctcaatggggttcacgatacgatgtatgtcgagggactcttcggcactattcttcatatgccgaatgtggtgaacctgataataaataaattggcctctggcatatgagacttcctaggaagcaaatttgaggcactgtccttgtgatctacacaacattgttcgtcacgcatgacctttgttttacctccggttgtttgaattcgacgattgcccgtttcgctagaacagtctcacggccttgaagaatgtacatccggttttttagatgtcc

SEQ ID NO: 506830 - DNA, 110 bp, Homo sapiens
aacaatgctgagagtgtacctcctgaggatctttcctgtgccagagaggtggggctggatgtctccatctcgtctcttctctatgtacatctcgatctcttctctatgta

SEQ ID NO: 506831 - DNA, 404 bp, Homo sapiens
atgaggatgtcatcattgaagtgaatggggtgaatgtgctacatgaaccctatgagaaggtggtggatagaatccagagcagagggaagaatgtcacacttctagcctgtggaaagaaggcctatgattatttccaagctaagtccctatcgttgcctccctggctgatccacttgacacccttccagattctaaagaaggaatagaggcggagtcaaaccatgactcgcacatggctgaacgggcccacagtacagcctcacattcttcttccaattctgaggatacagagatgtgatgagaacatgtaatagcttgggctgatgatttgatagctgttactgggtatttaataggaatcctttctcagggtgagttgtgacctgtttactgtctctatagtg

SEQ ID NO: 506832 - DNA, 108 bp, Homo sapiens
tgcgccagcagccaagaaaccgacatcgtctggaatcagccccagcattttggtgatgggactcgactctccatcctagaggacctgaacaaggtgttcccacccgag

SEQ ID NO: 506833 - DNA, 199 bp, Homo sapiens
cctttttgggaatgcaagccgatccacctcctgacataggagaactgattctgacgaaatgcctggaggaggggaatatttaaaaataaaattggtgacacatattttctacattccccaagccccccccccaaaatcctcatgtttatgcttcattttttgaaaaataacaattaaaacaggcagctgtaatggggta

SEQ ID NO: 506834 - DNA, 105 bp, Homo sapiens
ctctgtgccagtagtggccggctcttcaggaatcagccccagcattttggtgatgggactcgactctccatcctagaggacctgaacaaggtgttcccacccgag

SEQ ID NO: 506835 - DNA, 109 bp, Homo sapiens
tgcgccagcagcttgctccccggcgggggggataattcacccctccactttgggaatgggaccaggctcactgtgactagaggacctgaacaaggtgttcccacccgag

SEQ ID NO: 506836 - DNA, 451 bp, Homo sapiens
  misc_feature (4)..(5): n is a, c, g, or t
  misc_feature (90)..(90): n is a, c, g, or t
  misc_feature (101)..(101): n is a, c, g, or t
  misc_feature (196)..(196): n is a, c, g, or t
  misc_feature (223)..(223): n is a, c, g, or t
  misc_feature (279)..(279): n is a, c, g, or t
  misc_feature (288)..(288): n is a, c, g, or t
  misc_feature (312)..(312): n is a, c, g, or t
  misc_feature (396)..(396): n is a, c, g, or t
  misc_feature (406)..(406): n is a, c, g, or t
  misc_feature (436)..(436): n is a, c, g, or t
  misc_feature (446)..(446): n is a, c, g, or t
tttnnccctttttcttgaggtcgagactcactctgtcatcacccaggcaatggtgcaatcccggctcactacaacctccacctcccaggntcaagtgattntcctgcctcggccttccaagtagctgggatcacaggcacctgccaccatgcccggctaattctgtatttttagtagagacggggtatcaccatgntgtccaggctggtcttgaactcccganctcaggtgatccacctgccttggcctcctaaaacgctaggattacaggtgtgagcnaccacaccngacctgaatggttattttttaganttacaactatacaagtatttactatgtagttgaatctgggaaacttctatatctgtgggcacacagatacattcatttgacatnacagtagtgngctttcataaaattggttggaaaattttgncaccttttgnttttt

SEQ ID NO: 506837 - DNA, 103 bp, Homo sapiens
tacttctgtgccgggcgacaggaccataattcacccctccactttgggaatgggaccaggctcactgtgactagaggacctgaacaaggtgttcccacccgag

SEQ ID NO: 506838 - DNA, 415 bp, Homo sapiens
aaacgggaagtgtgataaggagcgtcgatctcataccggcgattcgggtctcatcaggagtgaagtccacatcggggatggagatctgaggagcattatagtcgactgggcatcttaaatacggagccttacaactttcctgcgggtccctcaatatccaaatcaggagcatcagtgtccacactgggtccagacacatcaatgtcagcctggggcagattcacatccacttcagggacctctgcggggaagccaggcatactgaacttgggcattttcatctggggcattttcaggtgccaatctgggtcgtgaacctccacatctggggcatcaatgtccactttgggccctttaatgtcaacatctggcactttcatttcaccttctaccttgggcacagacactggcaggt

SEQ ID NO: 506839 - DNA, 369 bp, Homo sapiens
ctacatgtccacataatgcaagcatagggtgttgactgactgtaagctcggtctgaatgtatagtctcagagacaagcatgattcgtctcaacgagcgctagtatgacaagaattgcacagtgttctatagtgattgagataatgttctattgaacagtgagcttggttcctggtgccacattctgagagtctgtgacaacctgtagtttatgccagagagtccacgtacttcattcaagtgatggtctggaaagcgcatctaaggcacaagtcgaccgcctagagtgaagaggtgctatgggttcccccatattgatggtgagcaagagtcacatatcgcgtgtaggtataatatgactaaagctttc

SEQ ID NO: 506840 - DNA, 650 bp, Homo sapiens
  misc_feature (6)..(6): n is a, c, g, or t
  misc_feature (11)..(11): n is a, c, g, or t
  misc_feature (20)..(20): n is a, c, g, or t
  misc_feature (32)..(32): n is a, c, g, or t
  misc_feature (44)..(44): n is a, c, g, or t
  misc_feature (55)..(55): n is a, c, g, or t
  misc_feature (65)..(66): n is a, c, g, or t
  misc_feature (72)..(73): n is a, c, g, or t
  misc_feature (88)..(88): n is a, c, g, or t
  misc_feature (95)..(95): n is a, c, g, or t
  misc_feature (97)..(97): n is a, c, g, or t
  misc_feature (102)..(102): n is a, c, g, or t
  misc_feature (108)..(108): n is a, c, g, or t
  misc_feature (130)..(130): n is a, c, g, or t
  misc_feature (133)..(133): n is a, c, g, or t
  misc_feature (137)..(137): n is a, c, g, or t
  misc_feature (142)..(142): n is a, c, g, or t
  misc_feature (147)..(147): n is a, c, g, or t
  misc_feature (172)..(172): n is a, c, g, or t
  misc_feature (182)..(183): n is a, c, g, or t
  misc_feature (185)..(185): n is a, c, g, or t
  misc_feature (200)..(201): n is a, c, g, or t
  misc_feature (214)..(214): n is a, c, g, or t
  misc_feature (231)..(231): n is a, c, g, or t
  misc_feature (260)..(260): n is a, c, g, or t
  misc_feature (264)..(264): n is a, c, g, or t
  misc_feature (267)..(267): n is a, c, g, or t
  misc_feature (282)..(282): n is a, c, g, or t
  misc_feature (288)..(288): n is a, c, g, or t
  misc_feature (293)..(293): n is a, c, g, or t
  misc_feature (312)..(312): n is a, c, g, or t
  misc_feature (329)..(329): n is a, c, g, or t
  misc_feature (371)..(371): n is a, c, g, or t
  misc_feature (374)..(374): n is a, c, g, or t
  misc_feature (390)..(390): n is a, c, g, or t
  misc_feature (394)..(394): n is a, c, g, or t
  misc_feature (401)..(401): n is a, c, g, or t
  misc_feature (407)..(407): n is a, c, g, or t
  misc_feature (414)..(414): n is a, c, g, or t
  misc_feature (430)..(430): n is a, c, g, or t
  misc_feature (438)..(438): n is a, c, g, or t
  misc_feature (449)..(449): n is a, c, g, or t
  misc_feature (451)..(451): n is a, c, g, or t
  misc_feature (475)..(475): n is a, c, g, or t
  misc_feature (479)..(479): n is a, c, g, or t
  misc_feature (496)..(496): n is a, c, g, or t
  misc_feature (504)..(504): n is a, c, g, or t
  misc_feature (562)..(562): n is a, c, g, or t
  misc_feature (648)..(648): n is a, c, g, or t
tctcanttaanttttttaangggtctcaaaantctgtgaaaaanttttggtcaanttgtttccannaaaaannactgattttaaaaanaaaaaantnaaaantgccanacgcaaaaaaaaaaaccaaagnggnccanaaaanattcncctttccttctgaaggttttacgangcattgttannantaaccagttttttannacaaaacttaaanggccaattgaaaaaaanagttctgagaccgttcttccaccactgantaanagngggggggcagggatnaggganaaaantcatttagccttctgagcnttctgggcagacttggngaccttgccagccccagcagccttcttgtccactgctttganganacccaccgcaactgtntgtntcaaaanacgaanagcaaancgacccaaaggggganagtctganaagccctcaananaaatgggcttgccaggaaccaaanaaanaatggcagcctcaccanaattcaanaatttagggccatcttccagctttttaccagaacggcgatcaatcttttccttcagcncagcaaacttgcatgcaatgtgagcgcgtgtggcaatccaatacaggggcatagccggcgcttatttggcctggatggttcagganaa

SEQ ID NO: 506841 - DNA, 2618 bp, Homo sapiens
gcgcgtcgggagctacgtagggcagagaagtcatggcttctccgtccaaaggcaatgacttgttttcgcccgacgaggagggcccagcagtggtggccggaccaggcccggggctggggggcgccgcgggggccgcggaggagcgccgcgtcaaggtctccagcctgcccttcagcgtggaggcgctcatgtccgacaagaagccgcccaaggagtcgcccgctgtgcctcccgaaggcgcctcggccggggcccacctgcggccactgctgctgtcggggcaccgcgctcgggaagcgcacagccccgggccgctggtgaagcccttcgagaccgcctcggtcaagtcgggaaattcagaagatggagcggcgtggatgcaggaacccggccgatattcgccgccgccaagacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagcgccaaggcgaaaagactgcaggaggcggaactggaaaagctgaaaatggctgcaaaacctatgctaccctccagcttcagtctccccttccccatcagctcgcccctgcaggcagcgtccatatacgcagcatcctacccgttccatagacctgtgcttcccatcccgcccgtgggactctatgccacgccagtgggatatggcatgtaccacctgtcctaaggaagaccagatcaatagactccatgatggatgcttgtttcaaagggtttcctctccctctccacaaaggcatagccagccagtactcctgcgctgctaagccctcgacgttgcaccccaccccctctaacggctagctgacagggccacaccacatagctgaaatttcgttctgtaggcggaggcaccaagccctgcttttcttggtgtaacttccagagtccccccttttttcccttgcacaaaagcttggctctgatggtttttttggcatgatgtatatatatatatacgaaaaatactacagaccctttttatcagcagacgtaaaaattcaaattattttaaaaggcaaaatttatatacatatgtgctttttttctatatctcaccttcccaaaaagacacatgtgtaagtccatttgttgtattttcttaaagagggagacaaattcggaggagcgccgcgtcaaggtctccagcctgcccttcagcgtggaggcgctcatgtccgatttgcaaaaatgtgctaaagtcaatgatttttaccgggattattgacttctgcttatacaagaagccgcccaaggagtcgcccgctgtgcctcccgaaggcgcctcggccggcctgcggaaaaacaaaagaaaacagacacaatgcagcagccagaaaatattagatatggagagattatggccactgctgctgaccggccacggcgtccgggaagcgcacagccccgggccgctggtgatcaaagtgaacccacatcatatttctgcattttacttgcattaaaagaaacctctttataagcccttcgagaccgcctcggtcaagtcgggaaattcagaagatggagcggcgtggatgctacatacgttgttcctatctcccgcccacgcccacacatatttttaaagtttttaggaacccggccgatattcgccgccgccaagacatatgagccctaccacctgcaccctgacctttttaagaatatttttgtaagaccaatacctgggatgagaagaatccgtagactgccggaaacacaagaccaatcggaagccgcgcacgccctttaccacatcccagctcctcgccctggaggtgaggtagaaaaattagaaatacttcctaattcttctcaaggctgttggtaactttggagcgcaagttccgtcagaaacagtacctctccattgcagagcgtgcagagttctctatttcagataattggagagtaaaatgttaaaacctgtgagaggattgtacagctctctgaacctcacagacccaggtcaaaaggttctgagaaatactaggtacattcatcctcacagattgcaaaggtgctttgggtgggggtttagtaattttctgcttaaaaaatgagtatcttgtaaccattacctatatctaaatattcttgaacaattagtagatccagaaagaaaaaaaaaatatgcttctctgtgtgtgtacctgttgtatgtcctaacttattagaaaaattttatatctttttacatgtggggggcagaaggtaaagcatgtttgacttgtgaaaatgggatgtcaaacagccataagttccctggtattcaccttcctgtccatctgtcccctccatcggtatacctttatccctttgaaagggtgcttgtacaatttgatatattttattgaagagttatctcttattctgaattaaattaagcatttgttttattctgaattaaattaagcatttgttttattgcagtaaagtttgtcca

SEQ ID NO: 506842 - DNA, 483 bp, Homo sapiens
tgccaacgagcttgacccaatgtcgagccatgatgtactctggggagcttcattgtctgagcaagagaacgtcctcagacccagcgtggcaaggtggcgtccatagcctccattcgtatgagaagccggctttgctgaagaagggatccagccacacctcctcggttttcttttttgcaataaaacgtttagaaacgaagagaacaatcaatggtgaagcaatagaagccagggagccgggacgtccttacagaatgtttcccgccccgagggggcgcacaccaaggcagttggccatccctcgacgctcttgcttggtaccccagtggtcgcccttgagtatgcgtctccgaattagtagacgacgatgccaggagaccattcttgtcaccaacacctttctacaagtatggagacacgcgcgtaggcccgcgggaacgatgtatgcggcccgcaaggatggcacacacgcttagactctga

SEQ ID NO: 506843 - DNA, 231 bp, Homo sapiens
accctcgtccactagaaagggaggcagtacagttttgattgtttagccatttagtggtgctttgttatggcagctggcataaatcgaatacatcatccaagggccatggtttcacccattcatctactccccgtaaaaaaaatcagcataaccagcacaaccactaccatcaccatcatcaccatcaccactaccaccatcaccaccattaccagccttgccctttctggt

SEQ ID NO: 506844 - DNA, 749 bp, Homo sapiens
agcttcaataccctggatattaaagtctcactgtggaccggtagaagaaaacacagctcttttgaatagtcacagtaatacttccccttaagctccatttaaaacaatagcttgttaaataacagatcaccagattttgaccatttaaaacaatagcttgttaaataacagatcaccagattttgaccatttaaaacaatagcttgttaaataacagatcaccagattttgaccatttaaaacaatagcttgttaaataacagatcaccagattttgaccctcgctgcacaatagaatcacctggaaagcttttcagaaataacaatgcctaggcccccgcccaaccaattgaatcagaatttctggggggtggaagttgagcatccatgttttccaagagatttctagatgattctaataggcagctggcatgaagaaccagtgctctcaatgaactgaataccatgtttcttgagaacctgaaacaggcgccgcatgcataaaacaagcccagggaactgagactcactcggctgactctaaacagtgctctgccactagcacaggactccaccctcaaggtggcgtccccgaaggtctcccagaaggcctcacccctttcccagcgccaccacccatacctcctcagaggaagtctcagcactgaaaaacggcttgttgaataagcagaaccaattatgtggacatgtatcatctctttgtagatgttaattaagcggccgcaagc

SEQ ID NO: 506845 - DNA, 798 bp, Homo sapiens
cgccggaggaggagacccattctataccaacacctattctgattggtacggtcaccctgaagttaatattcttatcctaccaggcttcgagaagtaactctcgccgatacttgtacactgtactacatccgagaagaaaaaaacgaaccattctggatacataggtatggtctagagctagtgatagtcaattgggttcctagggttctatcgtgtgagcacaccatatatttacgagtaggaatagactgtagacacactgagcatatttcacctccgcgtaccataatcatctgtcgtatccccaccggagtcgaaagtagtttagctgactcgccacactccacggaagcaatatgaaatgatctgctgcagtgctctgagccctaggattcatctttcttttcaccgtaggtggcctgactggcatatgtattgagcaaacatcggatcacatagaggatcgtactacactgacacagtactacgtagtagctcacttccacttatgtcctatccaagtaggacgctgtactctgtgccatcataggaggctgtcatatcgactcgatttcgcccggatgtactcagtgtctacagcctaagtatcgaagaccatgacgccgaaaatccattctcactagtcgatattcatcggcgtaaatctaacctttcttcccacgaagactttctcggctatccaggaatgcccgaagttactcggactatcccgatgcatacaccgaattgaagatctatcatctgaaggggtcattcattggtctaacagccgaatac

SEQ ID NO: 506846 - DNA, 313 bp, Homo sapiens
gctcaagttgatcctcaaagtatgtaactcaataaagatgcattctcttctaatataaagtttccatggttaatacagaaatcgtccaggggtgggggttcaggccagtaatctcagcactggggaggctgaggtagaaggggaggtgctggtgagtggaccaggcttcgggaaccagcaagttttacagtagtgggggaagataaactaagggggagattggcccggattctttttcccggttctcaacagtatggcggattcttctacggtagaccacagctcaggtagtagaagtgaaaatctcaagggg

SEQ ID NO: 506847 - DNA, 306 bp, Homo sapiens
  misc_feature (38)..(38): n is a, c, g, or t
tgtccagagtgtggaaagggatttagtcgtagagcagntctttaaattcactgtaggatccataccggtggaaaaccatataattgcccggaatgtggtaagggcttcactcaggctgcacattttcacatccatcagagagtccacactggcgagaaaccctataaatgtgaggaatgtggtaaaggctttagtcggccttcaagtcttcaggcccatcagggagttcaactggagagaagtcatacatatgtactgtatgtgggaaaggctttactctgagttcaaatcttcaagcccatcaga

SEQ ID NO: 506848 - DNA, 150 bp, Homo sapiens
cccttctcaataaaaatgtacgcttgctgacacatgcaggcatgaggcggtcctgcttcttggtcaaggagactttataaggcacttaatggacttgctaaaaccatgaacttgtcctgtccatgccacgagtatgttcgggggtaccga

SEQ ID NO: 506849 - DNA, 454 bp, Homo sapiens
ataacttggagtgtttccgaaggataagaaaaccttccatgaatgggggtaacacggaatgaaactcctcagtggcccaattcgtgccgcgttccccgttgggcccggcaacactggggttgtatgcgtctggaaccctgtgatagtcttcggcttgccagcctggtccaccacatccactgcctggtccacacggacagactctggcaatggccgcagctcctcatcaaacgttaccgagcattcggggctgcattgcgagccaccagcccatacaatacatagtgtgatttgcctagaataatgtttcgaacatccaggaaagagacaagcacagtgagcagtccagccacggccatccttgctcataagctgccggtcgctgtggtaggggcagagggtaagggtgcccttccctatatgtgtcaggccctgtgctcatgcgcaccatgaa

SEQ ID NO: 506850 - DNA, 327 bp, Homo sapiens
agtagagacagggtttcaccgtgttagccaggatggtctcgatctcctgacctcgtgatccgctcgcctctttctcccaaagtgctgggattacaggcgtgagccaccattcctttctgacactggttttaagaacttccttgaggtctgctttatttatcaagggttctaagttaactttgcaaaagttacaaaacagattaatagttgttagcttatgctaactcactactggcctatctttaagtaaagggctacctgttttggaactctgcctttcctcctcagagctctgtatcacatagaaatggcttccttgtataaagc

SEQ ID NO: 506851 - DNA, 206 bp, Homo sapiens
ggtagacgtaagagaaaggaaggtcgtgtatggcgtacaggagcgtcgttgttcaggcgtcagcccaggacgcggtagtcagcagcgccggtaccccgcagcccgaaggaggttacgatgggataaaagcggcggttaagatcccgtatcgccgggcaaaaaggaggaggcgcggcaagacggtgaggcaagtctgagccgcacgg

SEQ ID NO: 506852 - DNA, 900 bp, Homo sapiens
ggtatctaggaactgatcgacgtgcagagaggccaaggaaagtgcgcatgaggaagagagacctcatatggaccattgtcgtcattggtacaccgtgtatccggcgcaagtccacgattacttcggccatctgatctatacattcgcggagcggatagacctagaaggcaacccactgtggagagacacacttcgggcaggcaaggcggagcgcggggcatggaaggaattggaaggcaagacgagggcatccatttcaaggatagttggtctccgagctcctcggggcataccccactagagctggctagacacggtagataaccgctgtgtgataacttcaccataaggagtaactcctgcgctgtgctgtgacaacatctttggtaaggcaccgcaaggccacactgtctaccctatctgatagatcatatctctacgtatgatttgggcacccctaagtgtgaatccaagctaccagaagagggctccctaagtcaagaaattagaaacccacctcgattatattcgaaaggggggatcgaggtctatctataaggtccatggaggcgattggaaaggccttagatctctttggaactcctcgattgtaagcaataggttttgccgcttggttttcgaggataggaacatttccctcgaagatgaacttcgtgaattaattcgttactccagacgtaacactcgagagccgagggaacgcgcctgtatgaaaaggcctagttgaaacccaaccctaaggtgggccctggtttagacacctatcttggtgaagatccgatcgggaaaaattcattaccaattaacctgggaaccaggctttgttgtttaaaaccacccgaggactgcggtgggtttcctggcttgttacccacacaa

SEQ ID NO: 506853 - DNA, 1002 bp, Homo sapiens
  misc_feature (898)..(898): n is a, c, g, or t
taaagggtgggcttttattccccggggtccaaaagggggaaagaaaacccgcggggggccccccccccccccacaggaaaaaaaaaacctcttaaaaattcccaaggggggggaccaacagagggggaaggggggggcacaaagggcccacactcatacacaagtaaacccacaataaaaacaagtcaatcagagagaaataataaaaacacatactgcattacatacaaattacacacaaaacacagaggaatcaaccaccccccgcgagggatgaagctgggaaacaggaggcggcccaaccccctttagaaaaagaggtgggcggcatccataagaggccacagggcagcatctccctggtacaacaggtcctccacaatatagtgggacatggaactatcaaaacacaccaaacagagtggcgacaaacaaaaacctctcgctggcccaaatgagaaacagcggggggggaagatcacggcctcaacaccgcgaggtggtgctaaccaccatcaccgcgggccacaattattagaaacgtccagagaccacggccacaaaaagagacaaaaacaaccgaaacacagacaaacagaaccacaaagcaaggcgacgaccaaaccccacgtattagaccgcccacacaatagtcttctgctcaacaaggcggggtcccgaaaaacacttatatggcccgctaaaaacccttcggtcgcgacaaacaaagaagggcgccaaacctaaaccaaccctcgtgctgtgcaaaccccactcttgcggaacaaggtcacacgaacgcccaataatgaccccctatccacggatatttcgccacgagaaacacaagctatccataccaataagggaggcggaccagaaggacacctactcacanctgttgaacgcacaactggtgcgcccacacactgtatttgtaacgatcaggtctacccccaataggaaagtctggtatgagactctccaataactatgcccagc

SEQ ID NO: 506854 - DNA, 803 bp, Homo sapiens
gtatgaacaattccggcatggggcgacctcggactcaggaaccccaacgctcgcgagcagtgaatgtctaaatattcaccagctcaaggtgaactactatactcaatcttcgatccaacaaacgagatacattacaggaacaaagtaactcctataggcataacatgcgcatatccatatttcttaaaagtccaatatcaaacaatatgggtgaacgaggaccctcggatcctgcttgagttcataggacatctccctagatgagtgcagactgggtcattaaaaggttcctctcttgtgcaaatcgatgttacaaagtccctatctggtgactcatgagattcagaccagtatgtataaccagagtccgggtatgcccactcctacttctgagttgctcgccgtgagaatggaacaagcagaactaaggatcttactcctgcaaatgggcctttccctcgtcaatggagtatcatctccaactctagttattctacacctcatagataatatatcgaaaaccatccagacacctaactcattcaaaggcaatagccctggccgtaagcctaaccgactaacattactggggggccgacgcgaactcatgcgagactaagtgaaagcgccaccggaggcaactaatcaaaccatggggcttccctctaggctggtcatctctcacaatttcaaaatgcgcacgggctatcctagaggtcgctgcgccttaagccaagcctccgtggccacactggaagtgagcccgggctggcggagagcgaaaaaaaaccgcgcccgggaaa

SEQ ID NO: 506855 - DNA, 815 bp, Homo sapiens
  misc_feature (129)..(129): n is a, c, g, or t
  misc_feature (177)..(177): n is a, c, g, or t
  misc_feature (179)..(179): n is a, c, g, or t
  misc_feature (181)..(181): n is a, c, g, or t
cttgattattggcagttaacaataaaatgttattagatcactggtgcttctgtgtggggttgagttttttatgatatcttctgttagacccataagggaggctgtgagttgttttctacatccttggantatataagatcctcttttaaaattatattttatataagcacatgaaantngnatgaaataatgagttgacataggaattacctacatattttggctgtacatttagtgcacaaaatatcccttttttgaatgccaaatggccaagtgtgaaaaccaatatttgttaaagctggagcagaagtcggtatcatcatcatagagtaaacttctggcatatgtgaagatatgaaatgttatccctgaagttattataatttattctcagaaatattagtaatcttattttaagagtaggacattatagtgcagtaatgataattttctcagtgctgcctgttgctagattgttcctatgattgctgtcatgcacatacagacactaaattgagggtcactttccactgaagttagtggaatacaaaataggtggaggaactttcttcctctaacgtctttatatgtgtctgtgtttatatatacgtgtatgtatataaatatgtatacacatatataatatctggagcaaaaatgattatgttgtaagaacttttggaggttttcctcctcgtaaaattccgaagtggtagagttaacattctgcttttaatttatctacaaaaacatgtgaagaatccccaaataagattttctcatagaagattcatggattttgagaataagaaaaa

SEQ ID NO: 506856 - DNA, 887 bp, Homo sapiens
gagactgcactggcgttttacagagctaacaatcctactgacaaagcagataattggaatttctagatacaatatggttccatgtgaagctggacagtatatcagtacaattacagtgcttcgtgttctgaaagagacaaaggcgtttaatccccgaaggaggaagtgagatatgccaggtgtctttggctacatggcatccgtgacatgtgtgcgtgcaagatcgcaaggaatgtattaacagttgactcttatcactctttcttacacttattcagaagcacaggaagggcactgagtagccagttccaggatatgatgggagtcagcaactaagtgcttccttcgaaggttgtgatttgggggaaaatgcatatatccctatcttcgtcaagaggagaagaatattgtgagcaataagtatgaaggcttgatattttaaagtgaattattgttttctcacagtaatgttttttcagcgttaaactttgagagaaccaagtgcagctgttatcataggaacgctcatatgcctagactagaatatagtgatgattattcagatacctatgactgaagagtgggagtacctatttaagaataaaggcgctggtgtgtttaacatatgcaggcattgggtgcagcttaatttccatgaatttcctttccagattatgaactcttcatacttgcaagcatgaatctggacatgtttttcaaaatgggtggtcaagggtgatttgtcacagtctacgggcagaaagtcttacccggtatgggctcggacgaactggggtgtttcctataagaaaagagattaaagccaggggagaggggcaaccaaaagtcagagaagctttcaatgtgcgcgagggagtacacgagga

SEQ ID NO: 506857 - DNA, 1245 bp, Homo sapiens
cattcatcccggtcacttttgtgttacatggacgtggcacgctggttgcgacgaggtggagctggtgggcagggtttgatcccagtgacctggtgcaactggacgtgtgtagcttggcagcagctgtggcatgtgtgagtgaccccatcttgcctgggcagtgtgagtcaccttaccctccccaggactcgcttccccagccttctgaaagaactggacggtttactgtggactctgaaggtgctgtgcagtgggacgaatgcacgatcacaccatcccatgcatgatgggtgcacgcgactgtggtgtgcatgtgaagactgttatgcaaatgtgttgactcttccttcttcgagtgtgtgagatgcctggaaggaactttgctgacaactgtgtctttgggtgtgtggtctacttgtgtggccctgatctccaatgtgcatggagacatcgactgcaatgatgtgcgcaaggtggattggtgatgtcacttgtgggtgctgtgcccactgctggtcacctgtgtcccatgtcaaaccagattggcgagtgattgggtaacgcccccatagtgtcacctagtgtcgtccaactgaaacactgctgggacccaattgtggcacgtggatggaacagtcatgtgaaccacgactgtgggaggtcccgcacaaggccttgaccaaacacgtacaaagcgccatgtacgaaaaagtctccaagtatcttacgtcacgccatgggccaccaagcgtgcgccactggccttcctgagccagctgcgctttacccttccatgggccctatctgcccgggatgcccttcgcacagtgcgccttggcaagcaccgctggcgaaacgaacagggacaagttgcttctggggggcagcttggccagttaacgcgacagatcaaccaagatgatggggcagaacaacgggccaacagcggcaagtgcgtggggccccacggtggcagcaatttcgcgtgcaagataccggaattgctttggcttggcgacatcagcgccatgctgatacgcccttgtccaaaggaaggaaaccttgacgtggccacaggttcctgggttcctggacgaataggggcccaatacgtcgacggtttgcctacccttgttatggccatacaacctgttcacgccccatgtggggcatggcatcgtaacagatgacacagcgataccaatcgcgattccaagggcaatagggctgagaccagaaataggg

SEQ ID NO: 506858 - DNA, 153 bp, Homo sapiens
  misc_feature (84)..(84): n is a, c, g, or t
ccgtatagacgacagaagggaggggaggggagggtgaaaagacacagaaaagaaaaaatgaaaagaaaagaagcagtcctcttnaacagggtgcaagacatcctagaaaggcaaacgatttgtgagacgaaaggaagggcagtacgagacgag

SEQ ID NO: 506859 - DNA, 106 bp, Homo sapiens
gaaccctctaaatcccttgtaaatttaactgtagtccaaagaggacagctctttggacctaggaaaaaccttgtagagagagtaaaaattttacaccatagtaggc

SEQ ID NO: 506860 - DNA, 766 bp, Homo sapiens
ggcacgaaatctcacagacagcgtctgacaacctacgaggacagacaaactaaagcaccatgcattttgacacgaccaaaggccttgaggggggcacacatggcttctacgatggaatcagccagcggcacagaacaggacagagatgaacgaagcaccaatcaaccaagaccatgcaccagatccaggttctagaccacaacgtatcctcatggctttgaggccaagacgatccaaggatcttgacacaaatgctgaacctggcaaaatctcacaagacaggaagcagggccattctcagaaggaaactaaagctcacattggagcgggcacaaccagaccgacatttcctacagcatctgtgaacacgtgtgcaaagcagcactgaaagagcaagaagacgtcaaattggagggacaattcataatgctacattactcccttggacctttcccacagagttcccataagaataacccttcctacgggataaacgggcaacgggacgattcaccgtgcaacgagaacaccgaccgattgactgacacacacaataggtaaacgcttcaatacttggccactgggccacactctaaccacgcgttcgacaacaaatgtacttttgcacaagacactgggctggcacaggtcaccaagttcctggtctttcccaactacccctctgggccaatccaaggatggagtataaaacgaggtacccgggcacgtaccacagcctcccatggatgagctggccaaacaacgt

SEQ ID NO: 506861 - DNA, 491 bp, Homo sapiens
tgatctagaggacctcccagaggcacaggaggcagaggcgcagggaggcagatgacaaggggggtcttaagaatccccaattcagcttactcgattcaccaagtttcgctctaaggatgtgctgcctttaaaacagagtaggtcgaagtctttttacaagtcgccatgctagctttcagtgaatgtaaataacacgggtacgtgttcatgatgcagcaattcagatgaactacataaaagccctagcagccaagtcaggggctgttcacccttgaattcaggccaagaactagaaagagccagccttgggaatgctgaatttaccaacctaaatacgaagtggcacagcagcctcccagagccagcacagcaccagctagcccccaagggggctggtacccgggacggccaccagagctggctttcagaggcccaggcactctctacagagaatatgtgctggcggtaccgggaacccaaccctccagatg

SEQ ID NO: 506862 - DNA, 1314 bp, Homo sapiens
  misc_feature (336)..(336): n is a, c, g, or t
  misc_feature (406)..(406): n is a, c, g, or t
  misc_feature (480)..(480): n is a, c, g, or t
  misc_feature (482)..(482): n is a, c, g, or t
  misc_feature (488)..(488): n is a, c, g, or t
  misc_feature (494)..(494): n is a, c, g, or t
  misc_feature (550)..(550): n is a, c, g, or t
  misc_feature (791)..(791): n is a, c, g, or t
  misc_feature (1061)..(1061): n is a, c, g, or t
tgccaggcgcagtggctcactctatactgcaagcactttggcgaggccaaagcaagctgatcttgagtccaggagttcgaaactggcctgttcaacatggtgaaaccctgactctactaaaactacaaaaattagccgggtgtggtggtgcattcctgcagtcccagctactcaggaggctgaggcatgagaatcacttgaacccgggagctggagattacagtgagctgagattgtgccacatgcactccagcctgggtgacagagtaaaactctgtctcaaaaataataaaatcaaatactacacaatttattaagaaatagtcattatctttnagttggaacataaacttattcctgatcaagataatttgacatccttttattgtttaataacttacatgtngcttccttcatttttctcaaaaaatactctttatactaacattgctgtgattaagaaatggaaggaaaagtgtnanagtgtncagttntcactctgatggaaaatggtatggtcaaacctacagttgaatttggatggctcccnaatatatcatagttgtcattgccactgctatgaaaattacacttattcttttgtcatttcaaatttctcgaactcaatctattacacactgtatgtatagtgacatgccaactaaattagcaaatgacattttttaagtaaacttatgttttatttcttattttaataagtaatcctttcaaaagacattctgtacatgaactccaactcagaagggaatggaatgtggaaaaaaagaaanaaaacctgagtaacttttcctaaaaaagtctagctgttctcagtttgtggcaccaaatggggagcagggaatgttccagtcgcaactggctaattagcccaaccctaatttgttgataataataatgataaataataatgctagctaacacttactgagcaaatactaggtactatgtgaaatcattttcttgtattaactcacttaatcttcacagcaacccatgaggctggtactggttttatccccatgttatggatgaggtaactnaagtataaaaagattaggttactttcctcttgtcaactagagctgggattagaagctagtaatctcattttacactctgtgctcctgattataacactgttctagatccctttcttatgattaaggtacagcagtgttgctggagaatgctgacagctcagtcttcaaggatgtcccatactcccagcactttgtatcttgtgataaatgctataaataatggagtcatgaaccaaaaggtatgagaacccag

SEQ ID NO: 506863 - DNA, 769 bp, Homo sapiens
aaggaggctgctccaggagcacagacgtgcatctttggcttcagtcgtgtcccataccactgaggaaccctgaggtcccgtgccgacggagaacgtggaaagattactactttgtaaccaggtaggtgatgcacgcgtgacatagcagccctggcgactgtcatctgaggcatgccgagttctcgggggaagcctgtatggcacgagcaatggtggcggtgcaggccgtgcagggccatgaagccgtgtctgtgtgcgggacgtggaccctgcggggttgtgcggaacattcaatggccatgcgatctggggcccatctagcggactctcttgtgcacgctcgccttcatctgcagcgtgcttggcatggcagtggtgcttgctggcagtcgccatgcgacgtgcaaccaccgaggtagacgacctggtgcaagtcggctgtgcttgcttgtcccatgtgctctgacatggatgatgcagcaggggagcccggcctgtctcgaatgtgtgtcatcatttagatcgactagtcctggaacctatgcctatcgtccaccgaagcgtgcaatggaggcgctctctgaagggaggatctagaatagctcaaacggacctggcgcctgaggcttgcgtgtctcgttctcggcatcgccggggccatatccggaccagggcagcaggattgagccaatccccttggctggcgatacggcagtctgtgcccttgggcagcatgtggagtgggggaaattgttgccctgtggttggc

SEQ ID NO: 506864 - DNA, 205 bp, Homo sapiens
aggatcccccccctatccatgcatgaggtcttcgccacgcacgattggcctgtcttggctcactaacacgtatacctatgccggacttctgtgctcctccgagaggaggtgagggtgttgctcaggctgtggcctcttgggagggacaggaggcctccctgtttcccctctggtctgggctctgggagaatgcaatgatcccaga

SEQ ID NO: 506865 - DNA, 376 bp, Homo sapiens
ttaatcatttttactaattctaaaaatcagctctagcctgcttcataattttcaaggctttgcttgatctggtgaagctttctctcatcaaaactttgcagccttttagcccggcaggattttctccttattaggaaaatcaaaatgtgggtgaagatcaaaggctcagttaaccacctgtgttgtaacagtgatgtcagtcccttgattgtctttaaaaagttaatgtttccaaaaaaaattttttataatccgaccaacatgatttgctgaggacccatgcgcttttgtaaaatttaacctttggggtttttttgaaaaaaaatataaacaaatattgctttatttgaaaccaatttaaaaatgctgcctttta

SEQ ID NO: 506866 - DNA, 1195 bp, Homo sapiens
agcggagtagtgggccggaccgctgatgcatgcctgcgtcgcacatgttgggccgggcgcgtcctacgcagcagccgacgagccgggctgtgaggtgccaacgacggtttcccggccgcgtgagggccaagcggcgcggtggccggccgccgatgggagcgctcgtggaccatcctgggcggcacggacgtcccctacagggaggcccgggctgacagactgacgcgagtctgccagtgggcactccgtaactaggaggatcctaggagcgtggccgtgagagtgcgtccgactgattgacatcaggaaaggcgtatcgagacggcacaacggtgtactcgcaaggttggtcgaccgcaaggagcaatgaataacaccaggacttaatcacacagcacgatttgctgtagagaagaatactcttaccgtgagcgtggggccgagggatactactgtaacgctgcctgttcgtgcactgattgttagggagcgggagcaagacttgaacgaatgcgtctcattgagcaccggcgcaaaggggctcgaatcaaggggagcaagagaaaactagagagcgcattgcgtccagtgggccaatgaaaaagactggtgacccaagagtgaggatagagagcttcgttggggacatttccgagaccttttcaagaccatttccgggaatagcaccccccgtactgggaagagaggtccattctcgggggggaagagattgcctttttgagcagcagcgttcgagaatggaccgctcctatctatggcaatggaagcgccatactactatgatatcgacccttggggggctcccacttgcttgcgaggtagctttgcgacgtacaaccgggggagttccctcgcgaggaccttctatgggcccccgcatttacttttctaactcgtaagtgcattttccctgtccaatttccccactgggcgcgaccattcaccggaagttttactttacccttcacgttcaattcagttacacttcacctatagcaagggtaccctgtatgcgggccgttgggctgagccctatgggttcgcgacgagacgaggatatgtcagcaaacagatcattagccccacagcggtgtggggtcaccaaagggtagcggcacaggcacatttccatcccagcacaggccagtgaaattacacttgtgagcgaaacggg

SEQ ID NO: 506867 - DNA, 1030 bp, Homo sapiens
ctttttttaagggaaagagtcccatatgccgggtgaacacccctgtcaaaggtatttttttaaaagccgccacaagtggttttagacggtagctcccctcttttcagggaatttcccgccgaattcttccagtctgagtgggaataaccccagcccagatttaaagcggttatataaaaagtgtgattcttgtgagaaacgccggggggttccacaaccacgtagcaagcttaatgtggtggttctccccccgcgccccccttatgtggtcgcccagagattttaatgggttaattttcccacccacacacttcttttagtaacactgcccccagagaagaattccttcttggtccaaatttaacccttcacccggaatttcttcccgttttctcgcgggaggccattcttataatatccgctgtggataaaatatccccctctcccctttgaatagcccattagagggagagaatcttctctctaaatttgtgatggggcaatagtggacccaccctgggagataagatggactttagcccctaatagataacatctctggttgtggtaaattgtctgccgtagaccagagattgggggaccacacaaattctctgtgtgccctatagtaaagtttatactctcgctttatgtcttctacatcttgacacttctcatatgaggatattatctcccccccctttagccacagagcgtactttagatttataggtgatatttcttgtgccacgaaaaattaatatttatatttccacgacacatttagcgccccaggatttcttcctcacattaagtgggctctcaaccttattttaaaaccacaaacattattcttctctcaaccactatttcatcaataggaccaccggggattttttctgggtttgtttaccccccccaaagggtagaggccttgtgaccattccccatccaaaatttttttaggtggtgggaaattggggattttccaagttttttttttaaaataaaataaaaaaatttcttgtga

SEQ ID NO: 506868 - DNA, 255 bp, Homo sapiens
ctccgaaaggataaaatctctgtggctgcagtccaccgtctccagtggctactgcggtgccagtggctgtcggcagcggcttaggcctgggtggaggaagcagctactcctagtgctagtggtcttggcgttggatggtggctgtcagttcccagcagtggcagagccattggggagtggccttcagctactgttggagagcggcagcttccacccatcgacgtacaccacctacctctctcgctctcagcagga

SEQ ID NO: 506869 - DNA, 684 bp, Homo sapiens
taggtgaaaaagccagcttgacttttattgctcttgtggggcagggggctcagagagctctgtgtggggcgggctccgcttccttcttcaccatcacaggcttctggctgcgcaggatggcgctggccctgtcggatggctgccatgcgcaggtcggggcggataactatgtatctatgcggatacatgttgtactagatagctagctagagccgtaggcgcagagactattcttagtatgataggtaggtcccgcacataggaggtaggcaggtttaccgctaggccggatactccgcttaatgaccaccagagaaacctttgccgtcggctagccggttaccacgcccacagttcttgcggtgaatcagtccgtatgtagcggaaggaattgcgggccttacaagattattagggctacagtagctagtaggtctgctaattacctctatgatcaggaaatctggagcagttccgcacgaccatccatatgcaaatgtcgcaaacatggcggcggttccctttctgcagctgggacctgaccttacagcgcctcggatccaggcgccatggagccctccaggaagttctttcgtttgggggaaacctggaagattaaccgggcggaaacagagtctgggggagctaattggaatcttaaacgcggcaagtgcgggcgaaaat

SEQ ID NO: 506870 - DNA, 204 bp, Homo sapiens
cgtgtccttttttagcacagctttgtgggttgattttttttcttttcttttttggtacatttttaattgccagtttaagagtgactcgtaagagaatctcagcattgtgcacgataagagaatgtgtcagtatttcagggttctacattttatctgtaaaatgtgactttttttttttttcatccacacagcagctacaaggtg

SEQ ID NO: 506871 - DNA, 117 bp, Homo sapiens
ttaacgatggtcatacaagattcttcatatacagtcaactattcgctagagatataacttggaacttgacaaaaaaaatttttttttctctgagatgaagtctcgctctgtctctca

SEQ ID NO: 506872 - DNA, 148 bp, Homo sapiens
cgtactgcggcagtgtatgaggtgctgcaggcacgtggcccaggagctgcagaaagtgcaggtgagctacaggcgagcatagcgcccgcgtaagttggggagctccagggcctgagtggcacagcgtggaacgaggagctgcgccctg

SEQ ID NO: 506873 - DNA, 186 bp, Homo sapiens
  misc_feature (22)..(22): n is a, c, g, or t
  misc_feature (24)..(24): n is a, c, g, or t
  misc_feature (107)..(107): n is a, c, g, or t
  misc_feature (146)..(146): n is a, c, g, or t
  misc_feature (163)..(163): n is a, c, g, or t
tacacagggtctggcctccctntnttacccaggctggagtgcaatggcgccatcatggctcactgcatccttgaactcctgggctcaagcaatcctcctgcttcagnctcccaaatagctgggacaacggtgtgtgccaacatgtntagccaattattttttntagagacagggtttctccatgtt

SEQ ID NO: 506874 - DNA, 302 bp, Homo sapiens
gtattaacgaggaagtcaggccattacggtagggcatgtaatcaactaggacaaaggtcattaactgaggatatacggatacatagggcaaaagttagtatccgtgcttgtatgatacagagcacgagtcaaaattccgtctgataatcaagtagttgagaggacataaaaaccacagtttaggccttctgaagtcaaccataataacttcttagctgttccttagtttttgggacttgctctagaaattcactgggtttcttataaagggcaaatgcagtagagatcattctctagcaatg

SEQ ID NO: 506875 - DNA, 834 bp, Homo sapiens
gaagcggacgtggcccgtgcgattgacactgcgcgccgtgagaagcatttgtcctccaaatgtgatcaactcctaggtgttgtcacggctcatctgtgaggtgctgatgagcgagtgggactgcctacacgggcgtgcttagcatagagatcgaacgagaagttgtcgcccatgcaatggtgcggagtggcttcaagcagaccttctctgcgcagtgacacacatgcgctattgagtcctcagtgctggacgccaagggtgttgcatctcgatccccttgctattgctctagggcgcgcataatagccctttgtattgctgcgcattgttgtgccatgtgccgtgtagttcagcgtgtgccatggacttgggcgcgcctagagcttgaaatccgtgttcataggggctcgccatctggaacgtgatgcattccacgaggaattggcctacatcgtagtctttggacctggcggactcatgcgtcccatcataacttttcctgtgaagaatcatgagtattccccccggtcagctgccgtacgtgccttcctgcaaaagctgctggccgtcatggactggtgcgtgtagtccgtacctaagagaagtgcgtggtgattttacacctcagtgtccattactcttggaacctggtgagtcttctaatgctcgttatggcgtctgcgtcctaagcagtatttcactaccactttgatcggctcgggagctggagcagccatatacctttcattttctgccatcaacacacgaagaaaaacttatccaagcacctttatgactggggcccaaagggcaagtagctttgaagagtgggtt

SEQ ID NO: 506876 - DNA, 100 bp, Homo sapiens
ttattgtaatgcctctgcatttattctgttgcctcactgtacttgaagatgcgtaatatatatttatctgtggtatcagtgataaaatgatacctttctg

SEQ ID NO: 506877 - DNA, 111 bp, Homo sapiens
gcagaagttttccttcctccgccttcctctccctctcctggtgtacactcagccatttcagacgtcaaatttgtttattgttatattaacgagggagtctcgccctcatcg

SEQ ID NO: 506878 - DNA, 187 bp, Homo sapiens
acatgccttgtgcactccagcctgggtgactagagtgagacccgagtctctaaaaataaaataataataataataaaataaaattaagtgattgattcaacttcctaatttgatgtccaatgatagaataaaaataacaatagaaaaatagagaattagtcataaaagttcacaaatttcagcttct

SEQ ID NO: 506879 - DNA, 531 bp, Homo sapiens
ttctaaacatccaagtcagcagtggtgagacttggctctttcaaaatctgtaaggctaaacaattagttactttcttattcctaagagactgggcttgatttttggaacctccaaagagcgatcataacccagggtggcacccaagtggggaatgcctgatctcagacacgtcatttcagtcaaaccaagaactggttttgacctcttatttcctcctttcatcatcacagtgcaccaagaaaatccagacctatctcagttctgccaagctgtccggagagggtacacatggcattattttctcatatctgtcccctttttaaggtccaggctgcaaagagcagtcatttgagggagattgcttatcccactgttaaatatgtctaacttctctttaaataaattaatacatgagacactcaaagcactaacaatgataggcacatattaagtcttggttagtcactgtaactcttattcttactattagccaccaagattgtcactgtttgcagactgagacctcatct

SEQ ID NO: 506880 - DNA, 219 bp, Homo sapiens
tctagcgggcctaattactgccgtggcgccagctctgaaattacgatggtatattctgcatggtgttgatagctttcgtgccatagcctaccattgtaaactctaccctaaagactgggatggatacagaagtagacccactttcacttcgcagtctcctcccctactctgcccctaagctaggtctagtacctgtctctccctatagttccagcagga

SEQ ID NO: 506881 - DNA, 2249 bp, Homo sapiens
  misc_feature (18)..(19): n is a, c, g, or t
  misc_feature (34)..(34): n is a, c, g, or t
gaagccaagccgcagctnngaagcctgagcggcngaactcggcagctccaacccaactcggcttaactccgcctcaccgagcccagtccaagactctgtgctccctaggtttgcaacagctctctgatcatcttcttcaattcctgctaggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgttctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtagaaaaataaaaaaa

SEQ ID NO: 506882 - DNA, 840 bp, Homo sapiens
  misc_feature (18)..(19): n is a, c, g, or t
  misc_feature (34)..(34): n is a, c, g, or t
gaagccaagccgcagctnngaagcctgagcggcngaactcggcagctccaacccaactcggcttaactccgcctcaccgagcccagtccaagactctgtgctccctaggtttgcaacagctctctggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgtagggacgtgccatggagttccgggggctccattgcgcgcgactcttcgcgctttgtggccctgaccggggctctgctcggtaaa

SEQ ID NO: 506883 - DNA, 319 bp, Homo sapiens
ttattctgagccatcaatgtaagccgctgtcttcactgctcaggtgattatcctgaaaccatccaggccaaataagcgccggctatgcccctgtattggattagccacacggactcacatatgcatgcaaggtatgctagagctgaagtgacaagattgatcgccgtatctggtaaaaaagctgcgaagatggccctcatattcttgaacgtctggatgatgtctgccacttgtttgactactggattcctgtgcaatgcccattgtgtgcttgtagagccttctcagatctatccagcctttgcggtcggctttgtct

SEQ ID NO: 506884 - DNA, 2225 bp, Homo sapiens
  misc_feature (18)..(19): n is a, c, g, or t
  misc_feature (34)..(34): n is a, c, g, or t
gaagccaagccgcagctnngaagcctgagcggcngaactcggcagctccaacccaactcggcttaactccgcctcaccgagcccagtccaagactctgtgctccctaggtttgcaacagctctctggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgttctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtagaaaaataaaaaaa

SEQ ID NO: 506885 - DNA, 323 bp, Homo sapiens
  misc_feature (109)..(109): n is a, c, g, or t
gaaagcccttggggagactagaaagcaaagctaaaggcaatgcagggtcatatcatgtcatgtcttgtctctcagtcttgaggaattgagaatcctgacctgaggactntgcagctgagagcccactacctccacagcccatctcggccccagccgcataatcccacctgtcacctacccccacctccagtggggcatttctccagacgtcttatggattgggggtttcctcatgggccaggagaggagggaatattctagcgacacacatgtctgggttaagtgcccaatgagggcatgggtgtaggggagctggcctcaga

SEQ ID NO: 506886 - DNA, 334 bp, Homo sapiens
  misc_feature (223)..(223): n is a, c, g, or t
  misc_feature (291)..(291): n is a, c, g, or t
acgagccgagagctcgcaaaaaccatgaccatcgaccaggccatggcctccaccggaaagtcagaatcagccatgcgccgggcagcccacgaaggcggattcacgttcaagagcaagatcgtagatagggagcgggatttgaagctcatcgagcgcctgtcagccctgcgggacgctggagtgtcacgtatcgctgcatgcaggaaggtcgggatctctgacnccctgctgaaccgcctggtagtcgactacgacttcaacttccccaaacggtgggagaagcgagcttgnggcgcttcagcaaccgcccgcaacagcgcaaacgtcaaacctg

SEQ ID NO: 506887 - DNA, 321 bp, Homo sapiens
ctatctctaaaaatatttctaaattgttttaacgctagcacgtttaaaaaaaaatttaacccttcattaatataaataccctggaacacctttacttatcctccaagaatatttataacttccgctctgacactattatttttcctttaataccaaaatttcccaaagggctcacaaatcatggttggcagtgcagccttttcattactggacacattcccattgctaaggccctctgcacagatttttgtttactatcactggcgatcagcccaaactttctcaccccatatttcaacccaccccgatgtgtacaccagg

SEQ ID NO: 506888 - DNA, 825 bp, Homo sapiens
  misc_feature (127)..(127): n is a, c, g, or t
cgggtgggagtgagaagctttggagagctgttataaatagatgtgtcagacagatcaggcattatgcggcttgtaatagggaggagaagcctgatagtactcagtgtattgttggcattcaggtttngggtgagggaagatcctttatatagaacaagatggagagaaacaagaagcgggaggatagttgtttgaagagttcaagttattatgtggatccttgtttaaagaagaggggtctaagcttagcactcgatagggctaaagggtgtataccgtccgatgaggagcaatgggtttattgggactaggtttgaggggtgggatttccacctcctctcagagtcaccatatcagtgagtggtggtagaaacaatactctggcggcatagggataatgggtctgtgtcacaaaacctgtacttggataaggcatggggtgagtagccttcgtgtgtcgtgaccagatggtgtgtttagtcctatagttaagttcaatgcaatgaaagtttaatactcaagtgtgtacttttgttgggataaagtttgtgttgagtacatgtaggctgggtggggtagctcacgcctgtaatgtcagacgtgtgggaggccaaggcaggtggctcatattaggtcagaagttcaaggccagtctggacgacatcgtaataccatgtctctgctaaaaatacaaaaattagtcaggtttggtggcactttggctgtaatcgcggggggcgcagaaggctgagacactagcccccttctagcatgcaaggcttcggttcagtgaaaaaagctagtgtctttgcactgcagcgtgag

SEQ ID NO: 506889 - DNA, 325 bp, Homo sapiens
gcacgaggccaaggatactgattagaaggcatattgaggagtggccgggcatggtggctcacgcttgtaatcccagcactttgggaggccgagacgggcggatcactgaaggtcaagagtttgagactagcctggccaacatggtgaaaccccatcttaactaaaaatacaaaaagtagctgagtgtggtactgtgcacctgtaatcccagctactagggaggctgaggcaggataatctcttgaacctgggatgccgaagcggcagtaagctgagatcacagcactgcaccccaacctgggcaatgtagtgggactccatctca

SEQ ID NO: 506890 - DNA, 263 bp, Homo sapiens
tgacgtaaccactgcaatcccccagaaacccagtgcttgggatgactttgacttatgagatgctgttgttgatggagaaaatgacgacccacgaccaccgagaccacccaaaccgatgtccaaatacaaaacccaaacaccctagttcctccggtagcttatcagatgctgaccttgcggataggcgtatcaggtggagaagtgaaaagagaggcagtgatgtgttgtgcaggcagccaccgcgaaagacaggggacgcggcc

SEQ ID NO: 506891 - DNA, 419 bp, Homo sapiens
ctccggggttcaaatcattctcctgcctcagccggggtgggaaacccaggctgaaatggacacccagggcggaggaggaccctcagatgtccagggttgaagacggtcatgctgtcaaaacataatagccctatctcctcggtccagtctcagcccagccagtcagtccgttcggtcagcagtcccaaggtgcctgcctttgagagtggtacacccagatcagcccagaacagggatccttgtccggacccctctatgcagaacagggagcacagccccatgagggctgtgcctaccgtatcagaccactctcaagcaggggggtggcacaggggcttcagtgacctggggccgcattgagagcaccattgaaacctatgaaaaccccaagaagtacgactccagcgatgggcggccgc

SEQ ID NO: 506892 - DNA, 86 bp, Homo sapiens
cccctctgcttctggtgtgtgacgaggcccccgatgttcttgattttcccagagaagcaaataaacagcgtgaacagccacaaaaa

SEQ ID NO: 506893 - DNA, 110 bp, Homo sapiens
gttcattcattttgatgagcgagatggtgctgtcaaggctatggaagaaatgaatggcaaagacttggagggagaaaatattgaaattgtttttgccaagccaccagatc

SEQ ID NO: 506894 - DNA, 528 bp, Homo sapiens
ccctggcggatacaggtcgtcccgatatatgccaccgttgtaatcgttgtagttctatgtagtgcagatgcctgtcaacatggtgaacccccctctctattatgaatcaatacatagctagttgtcgtggctcatgcctctagtccctggtactcacgaggccgaggacagagcattgcttaaccccaggaggcgggggttgcagagattgtgccactgcacttcagcctgggtgacacagtgatactccatctcaaaaaatactaaataaaagcatttgaacagtataatgtctgtgctttcaatttcaattctaagttacagttttcactaagtttgagtcaactccttgagcataggacatcgtcaggcatgaattgtgaggcagtacattcagcaactatcaggtatcttaagttaactgtcatagaagcagtctgtctccatcctagaatataagacaatatacataatccttagtttgcatggtgctggcttgctatgaatttcaattatctcattcctcat

SEQ ID NO: 506895 - DNA, 1213 bp, Homo sapiens
  misc_feature (1210)..(1210): n is a, c, g, or t
acactgaacggtaggctaataccatcaacatctctggtgttgtataggatgttattttgattggaacaacttgacaaactgaggcgcagtggttcagctctagtgcgcacgagagttcccatggccatgtggtgagtataactgagtctatgtactaatggtctacggcattgctagacgtgtggcatggtcacaattttctgttctgtcgcatcacagttgtaagaactttggatagatgaacgcgcttcgtactcggtatatgagcgccttgcagtagtactagtgtcttattaactttactttgtttaaatcagctcgctgatagagctgatcatatacgattgtgttaaatatagttcctagtgacatagtaaacgatgcgtagttgttcattgtactacgttacaagatgttgaggccgtcaagttctgaaatgtcctgcatatttaaaggcgtagacaatgtaatgagaattttgtaactatttgtatgtcattttgaccagtgtactgctttatggtcaaagctgttgaccatttgttcacttgttctccagtattcgtgatcatgttggtctttcactagaggccattatcctgccactctttgaacaaagcagctggatcttaaaacagcggtaatggcttcttttaccctttgattccctttgggtaactgaagcttagcgtttagaatgtgacttttaaaggggtcgtcctaatggcgtttaaaacaggttgacactccactcttcttgtgaagggcagaattggcactactgcgtgttgacaggtgggcccgcgcgacattccgggaagtactcaacaagacattccccagagataaaggtcttggtggacccagcggaaacaacacaaacaacaacaggggggggggcgccacgaatagacaccccccaggggggcaaatagatgacacccccgtttattcaaaaaggggcccccacatcagtgtgttattaattagagacgaggggcgctacacaatagtcgttcgggaacaagcaacggcgttcgtgtggacgaccgaccatcggttgtatactgaaccccccgatcgtagcgccaaattatataaagacattccttgcggtggttactcctatagataccaggcgcatgatagccgattccatcgagctcagcagcagcaccgacaatgctcataatttagggggggggggagngtg

SEQ ID NO: 506896 - DNA, 153 bp, Homo sapiens
tgcaattcgacggttctccatgttgtcaggatggctcgaactcccgacataggtgatcgctgctcggctccaaagtgctgggatacaggtgtgagcgacgcactcaggctccctgttttgaaggattgacttcctaaagacttggtacgtgag

SEQ ID NO: 506897 - DNA, 130 bp, Homo sapiens
atattctaaacgctttatacttctccacgcttatatacttctcaacgctttatacttctcaacgctttatacttctcaacgctattgaggaagtcataaagcgttgaggaggacagtataaagcgttgag

SEQ ID NO: 506898 - DNA, 214 bp, Homo sapiens
  misc_feature (59)..(59): n is a, c, g, or t
  misc_feature (74)..(74): n is a, c, g, or t
cagtgttgccgagggcctgattgggccaggcactgttctaggccctcagggatctggcnctgatcaaagtttgnaaaacgccgggtgcagtggttcacacctgtaatcccagcattttgggaggccaaggtgggaggattgctttagtccaggagttcaagaccagcctgggtaacatagagagacccagtctctatttcaaatatatttatat

SEQ ID NO: 506899 - DNA, 1412 bp, Homo sapiens
tacttagcagtttaaatgttttaaaaagtccttccacaccctgagatgtgtgtgtatctcacacacacacacacacccaaattttcttctaaaaattttaaggttttgcttttcacatttatctttaattcacctagaagagatttctgtgcctaacgtaaggtaggatctaactttacattttcccatttgaattgccagttgtcccagcagcagcattttactgaacaggtactccttcccacccctaccttcccaactaatttgccatggcacttctttcatataaagtttcatatataattgtctgtgttttgggtctctattctgtttcttgagtccatttatctattcctgagccagaagaataatatgatcataatccttgatgtcatgtacattttttctacttctttggtggtcttggctattcctggccctttgctcttccatataaattttaaaattggcttgtcaagtgctcagataaatcctatgtaacttaatggtctgagctatgtcacagtacttgtactgtacatggaatataggaaatagtttcatatatttatcttatagtcaacctttttattaaactgtcttgttatttctaatatctagtctataggtgattttgagttttctacttgaacactgtttccattatgtatcattgcatagcaaactacctcaatacttagtggcttgaaacaagaaccactgatcatttctcactattttgtgatgtgactgggctcaactgggcagttctttctgctccacatggtgtcaatttgggaagcactggtctagaggcttgaccatgctgcagcactggtctagaggcttgaccatgctgcagcatttaaaaggactaactcacatggctgcagtaagtgctggctgttagctggaagcacaaccaaggctgttaacaggtgtgccttggttctcttccatatggcttctcttttgttttcagtactctgcagtttaattatgatgcatgcaggtgtgaatttctgtttattctgcttgggatgtgttttccttctgggatctgtgaatcggtttctcattatttttgtaaaacctgaagccagttatctcttaaaataccagctctccttggctgggcgtggtggctcacgcctgtaatcccagcactttgggaggccggggcgggtggatcacgaggtcaggaaatcaagaccatcctggctaacacagtgaaaccccgtctctactaaagatacaaaaaaattggccgggcgtggtggcaggcgcctgtagtcccagctactcgggaggctgaggcaggagaatgacgtgaacctgggaggcgaagcttgcagtgagccgaggtcgcaccaccgcactccagcctgggcaacagagcgagactcgtctca

SEQ ID NO: 506900 - DNA, 190 bp, Homo sapiens
aaaagggggcttggggggaattaaccccaaaccttcaaatcaggggggtcccacttgttttgtttccccgggttcccttgggcccccgtttcgttttccttccggggcgaaaggaaaaagggggtccgctttgggggggcccccccccgcccctttttttttttaaaccaacaaaacccttccaagggga

SEQ ID NO: 506901 - DNA, 142 bp, Homo sapiens
agcgtcccacgtgtaagcttctcggacccgttacatcctgggctcaagctgtcgcgccgaagctcgcaatacaacaactgtttctggatggtcactagccgttcttcctctgtctccattgccccagagtggccgggtagga

SEQ ID NO: 506902 - DNA, 129 bp, Homo sapiens
gcggtgcgtctagaggctcccaacatttaggtgtacatacttacgacgacttcgacacacctgttacaacagcggtagtagccaatacatagacggcatgccgtaggtgggcacaggaatgcagtttag

SEQ ID NO: 506903 - DNA, 115 bp, Homo sapiens
cagtgtactcacacaattgacggcgatcggatgatacgatggggctgtggtgaacatgttcagtccacaaggtctgtcgacgcttggagaccatgtgacggtaccttgggagaga

SEQ ID NO: 506904 - DNA, 481 bp, Homo sapiens
gctaaatgatttactgtttagattttaaattatttttgaaaaataacatacaagtataatttatatgtcataaaatactctcattttaagtgtatagtttgttttgataattttgtaaacattcccttgtaatccacactccaatgaagctactgaatatttgcatcactccagaaagttctctgttacacctgtgcaatccattcccctcactcctaatttcaagcaacagtgatatctctgttgccaaaatattgtttgttttgaaagcatggaagtgacaggatgcgctgtggactcttctggatgtgtgttttccgtcagcgggatgctgtaagatttgtccagtgtgtaaggttttgccaaagtggtacactgctccttatttctgaagggagcagcattgaatggatgtaccacaattggttttctatctcctatttttatgagatgaaaaataaaagtcatcacagccctaaca

SEQ ID NO: 506905 - DNA, 767 bp, Homo sapiens
atggaggagtcacttctttttttttgtttttcctttttgagatggtctggctctgtcacccgggcgggattgcagggtgtgcactcatagctcaccacagacctcaacctaggggtcacttctaagtggatgctgtggggtgtggtgcggaaggggtgaggaggtaggattgagtaactgtgctgtcacggctgtgtcctttgtatgacagcctgaaagtgtgacagtgacctaatgtgattggtggtgggatggactgtgatcagtgccgggggagctctctgcaagctggggtccccacctccagtgtgcttcttgctcagaaggttagcgtgtgcagtatgcgaagatgtagcttctgtggacctcgcggtattaaagtgcactttacgtagcccatcagaattccaagatctctagggagctgcatgatacctttcccttgggctcccaatacaccacccaaaaccccttgaacaggaccatcgactgttagtgatgtgctagacgtggactgtctcagtgtccccacgtccctgactctgtctcagaggtggtgtctgctcccccagccccttgacgccaaaaatgagtcccgtgcagccttccagtgagttcagcctctcccgtgggtatgtgtgcgggggcaccgccttgtcacgctccgcatttctttctggggagccctggttcctccctaccagtggctccccttagactctggcgtgtggcctcttcttccattgtctcttgcgccaggctcgcca

SEQ ID NO: 506906 - DNA, 102 bp, Homo sapiens
gtgttacaggtctctggatttataaatagaaaatttatgttggtatgtggttctcctatttgacattttcacacgggagatttaatcatagaatttaagaac

SEQ ID NO: 506907 - DNA, 186 bp, Homo sapiens
ccgctacggacgcactctccattgttactgcagatttctgaacggttttctttcgagcagtaagcatccatgtactatcactggttaacttcatcgtgtgcgtgcattcacaagtgtctagcgcgaaactacgcctcttcagggataccggagctcgtaattctgtaagtcattggtcctatgctt

SEQ ID NO: 506908 - DNA, 233 bp, Homo sapiens
acgctccttcgtttcccatgtgcaccacctgtgtgtcgttgtgcatctccgctgcgtctggacacccgatcccagcatccctgcctgcagtgacttgttcgtgttcagctcgcgtcctgccactgtccgcggtgctccagttggaggctgagtgttcccgggctctgtagctgagtgggcggtgtgcccctggtggcgctgccatgtggaatgacgtgcgctgcaagaactgc

SEQ ID NO: 506909 - DNA, 1092 bp, Homo sapiens
tcgtctgtcggtgttctttataagacacaacacccctcgacacgtgctgccagtgtactatttcgggctgatttactttcgttgatcgtggtgctctctgcgggcaacatgtttgtcgtctcctattggttcccccgcgcgtgttctctttttccgatgtttccgttaggtttttttttattagggcatcacaacaggtgtgttggctcagcgcttctcccgttggcctaaccccaaaggtgggggaagcttttggtatagacttctacgaggtgtctcaaagggttgctcccaaagttcgctgttggttcgtttttgaacggattctccttcggttcccgctggagtccagtgcccttctggctcactgcaacgtccgcctcccaggttcaacgattttcatgcctcgccctccgagtacctgggcccacaggtgtacgacatcatgactggctaatttttgtaaatttaatagagtcggggtttcatcatgttgaactcctgacctcaagtgatctgcccccctcagcctccccaagtgctgggattaccggtgtgagcccccatgcctggccctggtttgctcttaaagtttttaaggatggttgtgaatccccctggccccataataaacttgtaattttatactgcttactataatttttttaaccctgtaaccactttgagaccacccttctgaattcgtcgccacttataacctcgttgtagaattcttaaatgttaccccagcatgattgcccaatgaggggttggaattaaatgcacttaagtagtgaattcaatgtgtttgtttcccacttgattttcccactctaataaaggtttctgtccactcttattacactttgctgtagtaaatggtacttcccagcctctcttttgccccacttttggaatactccccagagtttgggggtgttcatgttttaaacaatgtaagtctgttggcactgaaggaccacttttctacactaatatcgaacctggatacttgaccccacaaaaaactgtttagtgctaatgagcagcaaaatgaatggttccataataaattgatatctgatttaaata

SEQ ID NO: 506910 - DNA, 248 bp, Homo sapiens
  misc_feature (25)..(25): n is a, c, g, or t
ggttttgcctacctgggccttacanaaaattattattattttatggccacctgcccacacccaacaaaggttttcagtggggacagtcttttaatcccatttttggtgcctttggccctgcctgggccagcctgcacccctgtgggggggaaaattactgcaggctttggggcaggttttgctcctttatgggacccgacatttttcagctttttggtattgaaaaaataaacccccctgttttgtga

SEQ ID NO: 506911 - DNA, 112 bp, Homo sapiens
  misc_feature (47)..(47): n is a, c, g, or t
  misc_feature (61)..(61): n is a, c, g, or t
  misc_feature (68)..(69): n is a, c, g, or t
  misc_feature (77)..(77): n is a, c, g, or t
  misc_feature (81)..(81): n is a, c, g, or t
  misc_feature (83)..(83): n is a, c, g, or t
  misc_feature (94)..(94): n is a, c, g, or t
  misc_feature (104)..(104): n is a, c, g, or t
  misc_feature (110)..(110): n is a, c, g, or t
  misc_feature (112)..(112): n is a, c, g, or t
agcataaattgctaaatataaattaactgataagaccaaaaattttnaatgtttaaaatanaatatgnntttttgtnaaantngaacctttgtnacgttttaantttagnan

SEQ ID NO: 506912 - DNA, 220 bp, Homo sapiens
  misc_feature (25)..(25): n is a, c, g, or t
  misc_feature (44)..(45): n is a, c, g, or t
  misc_feature (60)..(60): n is a, c, g, or t
  misc_feature (78)..(78): n is a, c, g, or t
  misc_feature (91)..(92): n is a, c, g, or t
  misc_feature (104)..(104): n is a, c, g, or t
  misc_feature (109)..(109): n is a, c, g, or t
  misc_feature (124)..(124): n is a, c, g, or t
  misc_feature (147)..(147): n is a, c, g, or t
  misc_feature (162)..(163): n is a, c, g, or t
  misc_feature (169)..(170): n is a, c, g, or t
  misc_feature (186)..(186): n is a, c, g, or t
  misc_feature (211)..(211): n is a, c, g, or t
  misc_feature (214)..(215): n is a, c, g, or t
aatagccctggccgtacgcctaacngctaacattactgcaggcnncttactcatgcaccnaattggaagcgccacccnagcaatatcaacnnttaaccttcccnctacncttatcatcttcacnattctaattctactgactatccnagaaatcgtgtcgcnntaatcnnagcctacgttttcacncttctagtaagcctctacctgcacnacnncgcgt

SEQ ID NO: 506913 - DNA, 332 bp, Homo sapiens
ttactgtgtgaatcacacataaaaaatatcttcacagaaacatccaaactggagtttgaccaaacgagggtaccaggtcccagacaagtggacgcagagaattcaccatcacacattatttgggaggaagatagtgactctgattcaacctcaaacccagagggctcagcacaatgtccactgtggtgccagggcgcacaccaacagttagtaacactggcaaacaagctaaatgacacagaacataaaccagaagagcaaaaaacagaggcaaacatagcaacagaagtgagcagacaaagagcagggtgaagtaaacaaatccaaacagt

SEQ ID NO: 506914 - DNA, 1313 bp, Homo sapiens
ggtttgcatccgcctcgcgggaaggaaactccatgttgtaacaaagtttcctccgcgcgcgctcgcctccaagatacgcgagcacagaatgttgcgtaccagagaggacatcgaccagacgacagggagcggaaaataagaaagaggagaagaagacaacacaaagaagacgaaaacgaaacgaaaaccagacgacgaagaactaaaaaagacgaagcaggcgacgaagcaagagagaaggagaaagaaagaaacgatggagaacacacgagacggcgacacggaacaaaggagcgcgagggcgagaggagagagagagaagaacagagagaaatagccaagaacaacgaagagaagacacacaacgaacgcggatggcgagatggggagaggagtgggagaaataacgagacaggagagaaaagcaacaaagcgcaagagggagcaagcagaaagagagacagaggacagaaagacaagaacagacgaagagaagagaacacacgaagaaaaagacgcagagagaagaaggagggagagagaaaagaagaacgagacgaccagagggaaaggagagaggaatcagccaagcacccgcgcggaggacggagaggagcaaccacagacaaagacgcagaggaagcagccagagcgggggggaggacagtgcggaaagagcgaagaagagagggaagggacaggggagagcggagagaaatgaagagcgagaaggcagagagaaagcgagcaggaagggagagcatacgaaggaggcgagaagagcaaaaaaaacgagaaaagacagaaaaaggaaaggacgcgaggcgcaacgcgaacgaacgagtagagacaaagcaacagagaaggcagacacgagtggagtaaggaccaagacagagagacgacggagagaaagagcaggacgagagaggcaggagcggggggagggcggcgaacacacacacgaacacaaaacgagaggaaggaggggggggaggggcaacagcggagacggcagaggcggcccagagaacggagagagaaatgaagacaagagggcggcaggagcaacgagggaggcgagagaaaggaaaaaggaggagacgagacacgaggaagcgcagaggaagacaggaggacgaagccagcgcaggcgccgtgcgcgaggactagaaacaaagaagagagaagagcgaaacagcgaaggagagacacgaagacacacagcaagacagccaccagcaaccagaggcagcgccgagaagagggaggagaggagagggaggaggatcaaggatcggacgacatacgac

SEQ ID NO: 506915 - DNA, 536 bp, Homo sapiens
  misc_feature (2)..(2): n is a, c, g, or t
  misc_feature (56)..(56): n is a, c, g, or t
  misc_feature (85)..(85): n is a, c, g, or t
  misc_feature (141)..(141): n is a, c, g, or t
  misc_feature (347)..(347): n is a, c, g, or t
  misc_feature (397)..(397): n is a, c, g, or t
  misc_feature (405)..(405): n is a, c, g, or t
tntttaaaaaatttggtaattgaggacctttttttttccaccagaatacctttttnccctggagcaccatcctatccagcagttnaggatagtagtccatggggaaaatgtccaggcctataacaaccctagaaacctagnttgtattgaaagttctgtttatatatatatataatgattgtaatgggatcatccttttccttgtctttgaaatatcccatgacatattgttatattaaaaagtaggtggctgggcacaagtagctcatgcctgtaatccccagcccttgggaggctgagacaggaggattgcttgagtccagaagttcaagaccagcttgggcaanatggcgaaacctcatctctacaaaaaataaaaatacaaaaattagctagncgtggcanacaggtatggtcccagctagtcgggaggctgagatgagagaattgcttgagcccaggaagtgaagacttcagttagccttgatcatctactgcactcaaaccctgggtgacagagtgagacactgtctcaa

SEQ ID NO: 506916 - DNA, 227 bp, Homo sapiens
ttaaactaaactaaaactaaactactaaactaaactaaactgctaaactaaggggtttggagggctcctggattattgaacacgtaaaggttcctggagggtggtgcagccagagacggcatggaagctcgtgcacccctcccccatatcttgccctatgcatctcttccttctggctgttaatctgtatccttgtcaatatcaaaaataataaatgggtaaacata

SEQ ID NO: 506917 - DNA, 693 bp, Homo sapiens
ggcgctaatggaacggggcatctcattacggcacgccgtttttctgtggcacgagggcgctcgcggcgcggcgggggggtcttgaaggttaggctaccatgcgtacccagcctagttttttttgcgagcaattcccacctctgtgagggtacgagctcatgaaagcgttgcgaagagcgacaactttacgctcccagcttatatggaccggcgtgaccaccccttgccggaggtggcccatgtcaagcaccctgtctgccagccagaaggcactgaaggagaaggagaaggccttctggagcaccctttccatggatgacaaagccgagatgtatcccattaagttcaaggagagctccgttgagatgaacaggggctcgaacgagtggaagacgggtgcgggcggtgccacgttcttcatcggttccaccgcgctcggcaacatgtggcagaacgcctatgggtccgcgccctctccgtaaagcttttgcccagagcgggcgcccaacccgacccagaggatgctggacatgcaggggaaacccatccagcgctgacccttcctgcgggaactacgaaagaaccagcggcccactccgagatgcggcccgcgctgtaccagcccccgcgcctgcacccccacgcaacccacggccagttaccggaaacctgtacccccacccagtgaccccc

SEQ ID NO: 506918 - DNA, 436 bp, Homo sapiens
gttgcattccggtaccgagcgccgagagcggtttgtctccgtctctggagttgtaggcgagaggtgatcatgtccggtcgcgggaaacagggcggcaaagtgcgagcagaggccaaatcccgctcctcccggcgcggcgctgcagttcccgtgtggcctgagtgcacagactgctgcgcaaagggaactacgcggacgagtgggcgccgggcggatgttacctggcggcggtgttggagtacttacggcggagatcgtggagctggctggcaacgcgcagcgtgacgaacaagaagaccaggataattcccgccacctgcagctcgccatcgcaacgacgaggagttaaacaagctgctgggcaaagtgaccatcgatcagggcggcgtcctgccaacatccaggcagtgctcgtgcccaagaagaaggagagtca

SEQ ID NO: 506919 - DNA, 131 bp, Homo sapiens
tctagaggatccctgggcaagggaagtacagacacacgatttgtcaggatggttttggtgactagaggctcagtggtgggagagatcctgttgaaccgaccaaccagtaacgtggtttggctttgggcgaa

SEQ ID NO: 506920 - DNA, 430 bp, Homo sapiens
cgtcgactgcacagctgtcgccacttgggaggctcagttggtttattcttgtcccccattggaacactgaagttcagcaatttcctcctctcccctctgcctccatctctctctctctctctctctctcctttcttgctgcttctcctttattcctgtcctcggcagtcttccagtcctggagtttctctttgtctctttcgttccctccctccgccttggcatatgattctctctcctctctcctctctgtctttgtatctgtgtctctgtctctcagtctctgtgtgtctgagtgcctctgtgtctccctgtctctgtcccctttttgtccgtccctttgtctctgtccttggcttctctgtccctctttgtgactctgcttcttcctacctcgtgtctgtgtatcccctttcccatctctcgtagac

SEQ ID NO: 506921 - DNA, 199 bp, Homo sapiens
atggcgtctcatagtctagggtcagaacagcaagtagtcactatgctaggtacctgaaagcttacattttcatacccggattatggtctactgtatatcgtttttctgaaatggttagtatacatttaggttagatcaatcagcatatattgggtccggtatttccaggtattagttttagggtgcgctaagcggtaca

SEQ ID NO: 506922 - DNA, 259 bp, Homo sapiens
taaggacagctatgataggcgatataagtatgagctgatgagagtcgtatcatgtataaactgatttagcttacaatatgtcagtttgcgttatgcgaatccaagtaaatgtcctgctagctagtaaggattgttttaaatctgttattttgctatttgcctgttagacatgactgatgacatatctgaaagacaagtatgttgagagttgctggttgtaaaactacgtttgaaatacgttgatctacaaagcgccatg

SEQ ID NO: 506923 - DNA, 188 bp, Homo sapiens
ggaactagctccccgctagccgtcaactactcaggagactacctgtgagatcctggggtgagctgtgattccatatccagtgatatgtgcatttcctgacccacttcttctttattcataattatgtgcaacatttggtcagtgtagaacattgaagcgggtaccgatgcgtcgcaattcgtaactca

SEQ ID NO: 506924 - DNA, 223 bp, Homo sapiens
caactggctgtcacccaagtccacgccattaactacacctggcagtagcatttgtctaattaatcactgcccccttgaagcacagtagaatgtcccttcgcaattaggaggagatctagcttgggggggacagatgggggaaggatgtgcctatcttgaacttgtgtgtgcctccacaggtctggaagtgactcacctggttttcttaaaacaacctgcaaca

SEQ ID NO: 506925 - DNA, 347 bp, Homo sapiens
acaaaaaggacaattccgaacattttgccagcccagcgaccgttctacctccgcctgttgaagcagcacccgtggtcgattcgagctctggacatagcgatccaagctctggacatagcgagtctctctctggacataagagcgttgtgcaggacaccaccctgggtcttaaagaacgcttacaagaattgcttgggcccggtccgcttcccgcgcggatgcccccagaccggatggaagagcttatagtgtccctctgcgacgaacagtttgtaacgctccgcgacctagcgcaggcgttgagtcgctcagacgcatcgttaagaaagcgctatttgaacccgttg

SEQ ID NO: 506926 - DNA, 223 bp, Homo sapiens
gtcgggatcagtctggggacatcagctcttatatattcagttggagcagtggttctaggtctgagtgagtgaacagaatctctaggggcatgtggtaagataatccatactatgtactggtagagttaagagaagagggagagcatgaagataaaccagtacaatccagtcgttcacattaccacttaatctacaagtgattactcccccattttggcttccc

SEQ ID NO: 506927 - DNA, 765 bp, Homo sapiens
gtccgagaggggctcagaatcaggacacgaacgacgattgttggcccagatacaggtcagcgtaaggctcgttgtgggcgcagacagcatgccgaagaacggcccgaggtgcggcccagaagcaggggcatgtaatggccgacgcgtggcccacacatcattgccagatggccgatggtgtgctctaagaaccaagcgttcaaagaagacgtcgatgggggtccggagagccagtggccagcaaggcatgagcgcgggccctcgtagaccaggaactgggaaggcctcacaggagctcagaaaggcaaaaggataactaaaggcctagaggagacccgatgatagcgcacgtggtctcaccatagagggagaagggtgaagcccacgaatgtcaagaggctagaaaaggagagaaagcgtggctcaaggggcaatccaggggcagcaacatgtgaggtcccagaccggagaggccacaagagatcggaaaacgtaggctcccaatttccatgtggcagaactcagtcgcaagagtatccgatggtatgagggtaaatctacaagtgttattcaaacaaagagttatcatagtggtacttactagaacccgaagtgtgcgatatacattagacgcagtttagggcgatcctgcccccagttcgatagcgttgactaacgtgcacgtatataggatctccacacatattgaagagcagatactggtacaatggcagcctgctcatagtgagggataccaaagtacat

SEQ ID NO: 506928 - DNA, 230 bp, Homo sapiens
ggcgcaatgcctatagtcctaactcctcaagtaggctcgaggcacgagaatcacttgaccttgggagtgtggaggttgcagtgagccgagattgtagccactgcactccagtctgggcaacagagcgagactctgtcttaaacaacaaacaaacaaacaaaaacaaccccaaaaaccaaattcctagggccctgttctaagccctcacacgatcagcacaaagggaaaca

SEQ ID NO: 506929 - DNA, 246 bp, Homo sapiens
taaatggtgtctgaaacttgctaatagattatatggagagaacacttacaattccttcctgagtcttggtttccgactcagaaaacatatggtgctgacctggccagtcgtggatctttcagcgatgcctctgaagatgcacggaagaccataaaccacgtgggtcaacaggacagacagaaggaaaaattccgtgaacgtgttcggcttcggggcagttggttgaataacagtgaccgaaacttg

SEQ ID NO: 506930 - DNA, 527 bp, Homo sapiens
  misc_feature (8)..(8): n is a, c, g, or t
  misc_feature (86)..(86): n is a, c, g, or t
  misc_feature (93)..(93): n is a, c, g, or t
  misc_feature (139)..(139): n is a, c, g, or t
  misc_feature (192)..(192): n is a, c, g, or t
  misc_feature (198)..(198): n is a, c, g, or t
  misc_feature (270)..(270): n is a, c, g, or t
  misc_feature (403)..(403): n is a, c, g, or t
  misc_feature (410)..(410): n is a, c, g, or t
  misc_feature (418)..(418): n is a, c, g, or t
  misc_feature (426)..(426): n is a, c, g, or t
  misc_feature (441)..(441): n is a, c, g, or t
  misc_feature (525)..(525): n is a, c, g, or t
aaaaaaantaaaaaaaaaaaaaaatatccagaaaaaaaaaaagtatatatttatgtttcttcttctggttctttttttctcttttngccctgnccctgccttttctgcgggtgtggcttcggtgctctcctgttcgggngcgggctccctgcccgcttcttttccttctttgcttctttttgtttttttgtntttgtntctcctgtggctttctccttcttccctttcctggcggcgtcttcttttccttcggggcgccttttgtctggnttcctctttctccctgtgtcgtctttctctttgtcgttcttctttttctcggcttgctctgtggcgctccttacctctttctgccttttccctgtttctgtttcgttcttcctcgctgttggccccccttggngtggggntgtggtcncgctcccnctctctctctctggngcgttctctttctctgtcccgatcccggtctcgctctctgtctctgtctctctctctttctcggtctttctctcttctggcctnat

SEQ ID NO: 506931 - DNA, 274 bp, Homo sapiens
ccttctcgacatctccatcacagaagaagaatctggatgctttgttgcatcctgcactcacctgccaggctgtgccaggcgtgctcagttgcagacttggaacactcccctccaccactccattgaggctaaaactgaccctgttctattatgtcttccagccttatgaccctgtctctcccaccctaggctgtcctgctttcctcccttcaagcccttgtccagttgaagacaccaaggaggaaaaaggccgagtaacttgcccacattactc

SEQ ID NO: 506932 - DNA, 191 bp, Homo sapiens
ggcggcggcatctcttatcagagtggtcatctgagctctgagaatggcggcctctcttcagagacccaggcctaataaaagagaagacagttagatgctttatggacggcaacattctttaaggattccctccagggtccatgcatatctagtctaaatcaacgatgaggggcaagcagcaataatgctta

SEQ ID NO: 506933 - DNA, 234 bp, Homo sapiens
ggatttgctggtgcagtacaactaggcttaatagggacatggtgaaaccccgtttctactaaaaatacaaaaattagctgggcgtgatggtgtgcgcctgtaatccagctactcaggaggctgagacaggagaattgcttgaacccgagaggtggaggttgcagtgagctgaaatggcgccactgcactccagcctgggcgacagagcaagactccatctcaaataaaccaaaa

SEQ ID NO: 506934 - DNA, 345 bp, Homo sapiens
  misc_feature (181)..(181): n is a, c, g, or t
  misc_feature (265)..(265): n is a, c, g, or t
  misc_feature (323)..(323): n is a, c, g, or t
ggctggagtgcagtggcaagatctcgactcactgcaacctctgcctgccgggttcaagcgattctcctggctcagcctcccaagtagctgggattacagtgtaccacaccaaggaactcccacactctgaatgaacagcccagtgatcaggagctttgaatcaattcttggcacctaacantttgtgaagagtctgctaaactccctctatcagaaatcccagaggactgagaacaggtcatccttggagctgtatctgaatggngtcaggatctggaagcccaagtctccttgtcaatgtctgctttggttcccaaggacanctgtaaattggaagaggggcat

SEQ ID NO: 506935 - DNA, 189 bp, Homo sapiens
tgtgtggcgatctagaggatcccaaacgtcagcactcctgccctctagaacttggccaacaccacatgctgccaacactgaccaataaaaaaaaagggtgggttttttttttttttttttttttttttttttttttttttttttttttttttttttttttttttttttttttttttctctttctcttat

SEQ ID NO: 506936 - DNA, 251 bp, Homo sapiens
accccgcgctccttcctcgcggccgctcggacatatcgcgtccgatcgtgtactccgtgcatccccgctcgtcgtctcgcgcggggatatattctcgcggctacgcctagcgcgctcgcgccaatcggagggcgcgctcgacttcgaccgaccttactggcgattattcgcgcagatctttccgcttaaatctgtagatccgagtcgatgccgaggcacgagtataacaatgagaacgagaatacgtttag

SEQ ID NO: 506937 - DNA, 152 bp, Homo sapiens
atggcactataggcaagatgtaacagcaactctgggttgaggacttcatccttggggaattgttgctgtggggcatttgcctcttgtttatttggctgctgactgtccaagactaattctttagattctgtatttcctgcagggagttgatg

SEQ ID NO: 506938 - DNA, 622 bp, Homo sapiens
cccatctgtcccctctttcttgcccgggttcttctgctatctgtcatcctgtcgtagcgtcttcggttggtccccctttttccctgtttcgcttgaggcatacgcttcgtgattcttcgccacctggtccaccgaggtttcactcatcgtatcgctttcctcatctgtcccaacccgggcggccccactattctccgcaagcccttcgtggctagtttcacagacgacccttcatagcccacctggtctctttcccagtcgccgcatcttcaatgggggggcacgtagggaacgagtccgattactctgaaggctgaggacggacgtcagaggtcaagtgcgtgtggtcgatcctcaggatgtcccacctcccacttctccaaaagtatagatctacgggtagctcaacgttagttcatggtttattattttattagtaattttttgtttttccagtatatgtaggttgtgttttaagaaaggggatagtttaatagtaaaaaaagacaaaagtgtttttaaaataatagctagaccacatactgtgtctgtatatagtcagcttatctcgtgttcaatcgtcctgatctctatataagagcaaggggaaatgctggtactt

SEQ ID NO: 506939 - DNA, 282 bp, Homo sapiens
ttattgcttgggacggcgggtcaggctgcgtactcgtggatgccgtgtgtgaactggcacttgtcccgtacttacaggcaccgttttcctcaaaggggcggccagctccgtcttgtagctggcctggagttgacctggccgcccccgggctgctactgggtgggcagcagccgctcgcccccttccgagaaggagcggctctcggaacagccgcgcctgtctcgcgatcctcagagcgtgtgtgctggctcaccccttgagggctgcttgaggacgctgggt

SEQ ID NO: 506940 - DNA, 204 bp, Homo sapiens
cacccgctgtctgtctgggttacccacgaattcaagcctgcgttcggccagcgtggtgtaacggggcgcctgagatcaagatcacaagcagatcaagagcaagatcaagagcggctcgcttcgcatcgtggtgaccgttgatcgcaaactacccctgctgctcctcctccaacgcctctgccaactcaacggcctacgcgggtg

SEQ ID NO: 506941 - DNA, 920 bp, Homo sapiens
tgtaatcctagcacattgggaggctgaggcaggtggatcacctgaggtcaggagttcgagaccagcctggccaacatggtgaaaccccgtctctactaaaagtacaaaaattagctgggcatggtggcacatgcctgtaatccagctactcgggaggccgaagcacgagaatcacttgaacccaggaggcagaggttgcagtgatctgagatcgcgccactgcactccaccctgggtgacagagcgggactctgtctcaaaagagagagagagattggccaggcacggtggctcacacctgtaatcccagcactttgggaggccgaggcaggtggatcacgaggtcaggagatcgagaccatcctggctaacacggtgaaacctcatctctactaaaaatacaaaaaattagccgggcatggtggcacgcgcctgtactcccagcaactcaggaggctgaggcaggagaatcgcttggaccaggaggccgaggttgccagtgagctgagattgcgccactgactccagctgggcaacgggagcgagactccattttccaaaaatagggagagagagaaattagtgaaagagagggagtataacctaacagatttgataaattctaggttattttaaataaaaggccgtatgtaacaattatggggggatcgatctccaacgtatgacaatatgaggtcctatttcccgcttgccaaatcaatttacattataacacaggcttagacccttctggcttatgtctggacttggactcctgaaacgatcctgggttggcggaacaccgactccactaacgcagttgtatgcggtttcacattccggactcagacgaaaaactctccagacaggttgccctcccgacaccgaattgggcagaacaccgtaaaccgaatgcagac

SEQ ID NO: 506942 - DNA, 121 bp, Homo sapiens
gtgccactttggggatattaattaaccttttaatctcagattgttttcatctataaaaagtatatgttgggtattttgctaggtttttttttttggggggggtttaattaattattttaat

SEQ ID NO: 506943 - DNA, 1227 bp, Homo sapiens
  misc_feature (3)..(3): n is a, c, g, or t
  misc_feature (5)..(5): n is a, c, g, or t
  misc_feature (15)..(15): n is a, c, g, or t
  misc_feature (45)..(45): n is a, c, g, or t
  misc_feature (81)..(81): n is a, c, g, or t
  misc_feature (112)..(112): n is a, c, g, or t
  misc_feature (116)..(116): n is a, c, g, or t
  misc_feature (121)..(121): n is a, c, g, or t
  misc_feature (146)..(146): n is a, c, g, or t
  misc_feature (163)..(163): n is a, c, g, or t
  misc_feature (169)..(169): n is a, c, g, or t
  misc_feature (182)..(182): n is a, c, g, or t
  misc_feature (189)..(189): n is a, c, g, or t
  misc_feature (191)..(191): n is a, c, g, or t
  misc_feature (196)..(196): n is a, c, g, or t
  misc_feature (239)..(239): n is a, c, g, or t
  misc_feature (270)..(270): n is a, c, g, or t
  misc_feature (272)..(272): n is a, c, g, or t
  misc_feature (281)..(281): n is a, c, g, or t
  misc_feature (328)..(328): n is a, c, g, or t
  misc_feature (342)..(342): n is a, c, g, or t
  misc_feature (352)..(352): n is a, c, g, or t
  misc_feature (400)..(400): n is a, c, g, or t
  misc_feature (515)..(515): n is a, c, g, or t
  misc_feature (549)..(549): n is a, c, g, or t
  misc_feature (582)..(582): n is a, c, g, or t
  misc_feature (654)..(654): n is a, c, g, or t
  misc_feature (795)..(795): n is a, c, g, or t
  misc_feature (863)..(863): n is a, c, g, or t
  misc_feature (886)..(886): n is a, c, g, or t
  misc_feature (925)..(925): n is a, c, g, or t
  misc_feature (941)..(941): n is a, c, g, or t
  misc_feature (1022)..(1022): n is a, c, g, or t
  misc_feature (1098)..(1098): n is a, c, g, or t
  misc_feature (1200)..(1200): n is a, c, g, or t
  misc_feature (1227)..(1227): n is a, c, g, or t
gtntnagaattatantctctagttcccgacgtcactgtttcgatnttgtcgtcttcagtcatcttgtctatactatatcgntacgacatctcactgtctctgtgtatgtttngacntcgtngtgctctctctcggtatatcgtacntctctatgacatcatcntctctnctgtgtcagcgcnatctccntntcgangatgacagtgcgtataacgggatgtctagtcctactacgtggncgtctcgctctatctcgcgcacactctgggngngagagatanggcgctatctactatctctgtgtggttgctacatacgatcacactcncacgaccactcgcncactcatatngtgtcgtctctcgcttcgatgtgcgagggcgtgcgagtgaggggcagngcgactacacaaacaccactcgtctcgcggcgtacagggtcgacgttggctacattacaatgaaacgcggtgtgggtcgtgcgtttactctctgtttcgcactaacataccagcncgcgttacgtgtggtgtcgtcacgccacacacanaaagctctacacgtagcgtcttaccacacgcgntactctgcgcggcgcgtcgcggcggcctcgctccgtctgttgtattctgtattatctattcatatgtgtcgntacgccacgacacacttctatcttctgcctttgtgatgcgcgacgagagagacatatatttattgggtgttcatccacacgcgcgtacctcttgtgctttcatttaaatgaggggagagaggggtgcgcgttcctcacganaaggctacccttctccactctagagaagcgcgccgctctcgtttttctatactcgtattataagtcantatactacacgaaacgcggtgangtctttatagatataaacacgcgcgttgtcaacatacanaccgtgcgcgctgcgngtctcgtggtatgtataaaatcacagaagaagtatatgttcttgtttcggcgcggcacctcctctcttcgctcctctgtgntgcgtgtagtacgaaagagacaaactatacacactcttctattgttgaaggcgtatcacccaccacctcaccgccnggtgtgtggcgcgcgcccgctctcgtgaagagatataatacttatatcttccgagagcgggggggcggcgggtcacagcgggtgtcgttctctcgcgccgcngcgtgcgcgagagggatgagcatactn

SEQ ID NO: 506944 - DNA, 117 bp, Homo sapiens
aaaaggcctggccccattctggagaaggcaaagctgccatgagacacagacttcttcctccttgcctcttctggactggcttccttttgagaaattgcacaaagcctagggagatgt

SEQ ID NO: 506945 - DNA, 133 bp, Homo sapiens
ggacacatatgaagaagaaattaattcggtcggacaaacggaaagaggtgagtgtggtggcacccagcgagctcgggtttctccgggggcgggtctgaagccatgatagtaactcctttcttcttatctaggc

SEQ ID NO: 506946 - DNA, 100 bp, Homo sapiens
ttgcatacggaggctcagccgttccatagatgacattgagaattctcacctttcacttggcacacgagccctttcgtgattggccctgtgttcctctcca

SEQ ID NO: 506947 - DNA, 137 bp, Homo sapiens
tctttacttttctgtatattactatgagattctaaataaccaaaaagtgattgggtcgcataaactgtacgtattgtgcttccaaatcactttatggttcataagaaatatcttgatcctcttataggcctccttgg

SEQ ID NO: 506948 - DNA, 222 bp, Homo sapiens
gatcacgaggcatattctgcaatgggtttttcaatcttgcttcatctgccttaagtttatatagagagatcctctacagagatctgagtgatatagggtgtctatatgtgagagtttctctctctatattacacatatattgtaaaatgataatatctaggggagagtagaaagagaactttatggggctctttagagtagagataatattattattaaaaa

SEQ ID NO: 506949 - DNA, 163 bp, Homo sapiens
atcacagctgacacactcgagtcgtatatcagcatagagagctctgaaaattgtcaatagggtcccagaaccatttattaaatagggaatcctttccccatttcttgtgtttctcaggtttgtcaaagatcagatagttgtagatatgtggcatcgataaaca

SEQ ID NO: 506950 - DNA, 1245 bp, Homo sapiens
gagtgccgctgagatcatgtaaggtcctgtgcataatggatgcggatcgtcctcgttctaacaacaggtgtttaaacaatcagcagtcgttgtttcaacctccccccggttttgtgtttctcttctcttgggtctcccccccgagggttttttcctggtgtattcccgcctcccctgcgtgcgtacacgtggttgaaccctggtggcttcgcagggggccccctattctggcttttggaggttttcaaccatggaccgcccaagtgccccaagtggcgaaacaacaagagtctaactcgtttccccgggttatagaaacccctttaaggttgcccccttgtgggcccaaatactcttttccgcgccaaaaggggtgggatcttttaacaccctttgagacccggggaaatttttgccccagagggtttctttttagcccggcttttaaagagaaatttttgggggcccccaaaacagaccgaaataggggtttcacccaaggcggcccacaagtgacacacccccgtagggggagctcttgtggaagattaatttttgtggttctccctgggataaacaggccccccggtgttttggggccttggggggatccccccccggggagctttaccccacaacattggtttatttgagtgtagcgcccccctcccctctttctcggggcagttaattgtgtcccccaatatatagcgcccccttgggtgtgttggcccccccccccggccataatgccatattccccgtcttatcctgcacgcctgcacaccccacatgagattgtggttatatccccaatggccccccgcgagtatttcctcccacattagagcctctttgaagaggaatatatggttaatatgtttctgttgtttttctactatagattggcttctttatatatttgtgtgtggttaatctcgacaccacaaataatttatatttatagaaacacactcggggaattccacgaaaaatggctccccgcggcccgcccgcgagaattttgtgggaccctctttttgcctatttgtataagttggagtattttctctacacattcctgtaacccactttttatggttttttttgtatactatgagaaaatgcccggccgctgtttttaccacacaaagtaaatgtaccacgctgagtttgtaaataccacactaaaatgagaaggccactgcctggccctccccattaaaaatatttgaagaactgtta

SEQ ID NO: 506951 - DNA, 815 bp, Homo sapiens
  misc_feature (8)..(8): n is a, c, g, or t
  misc_feature (75)..(75): n is a, c, g, or t
  misc_feature (101)..(103): n is a, c, g, or t
  misc_feature (105)..(105): n is a, c, g, or t
  misc_feature (109)..(109): n is a, c, g, or t
  misc_feature (130)..(131): n is a, c, g, or t
  misc_feature (159)..(159): n is a, c, g, or t
  misc_feature (167)..(168): n is a, c, g, or t
  misc_feature (176)..(176): n is a, c, g, or t
  misc_feature (179)..(179): n is a, c, g, or t
  misc_feature (195)..(195): n is a, c, g, or t
  misc_feature (207)..(207): n is a, c, g, or t
  misc_feature (222)..(222): n is a, c, g, or t
  misc_feature (224)..(224): n is a, c, g, or t
  misc_feature (229)..(229): n is a, c, g, or t
  misc_feature (232)..(233): n is a, c, g, or t
  misc_feature (256)..(256): n is a, c, g, or t
  misc_feature (260)..(261): n is a, c, g, or t
  misc_feature (305)..(305): n is a, c, g, or t
  misc_feature (337)..(340): n is a, c, g, or t
  misc_feature (342)..(342): n is a, c, g, or t
  misc_feature (358)..(358): n is a, c, g, or t
  misc_feature (361)..(361): n is a, c, g, or t
  misc_feature (366)..(366): n is a, c, g, or t
  misc_feature (392)..(392): n is a, c, g, or t
  misc_feature (401)..(401): n is a, c, g, or t
  misc_feature (407)..(407): n is a, c, g, or t
  misc_feature (418)..(418): n is a, c, g, or t
  misc_feature (425)..(425): n is a, c, g, or t
  misc_feature (431)..(431): n is a, c, g, or t
  misc_feature (439)..(439): n is a, c, g, or t
  misc_feature (443)..(443): n is a, c, g, or t
  misc_feature (464)..(464): n is a, c, g, or t
  misc_feature (489)..(489): n is a, c, g, or t
  misc_feature (496)..(496): n is a, c, g, or t
  misc_feature (507)..(507): n is a, c, g, or t
  misc_feature (510)..(510): n is a, c, g, or t
  misc_feature (539)..(539): n is a, c, g, or t
  misc_feature (541)..(541): n is a, c, g, or t
  misc_feature (544)..(544): n is a, c, g, or t
  misc_feature (715)..(715): n is a, c, g, or t
  misc_feature (745)..(745): n is a, c, g, or t
  misc_feature (805)..(805): n is a, c, g, or t
tcaggggnaaaactgagcaccatagtttacaagtagaaacgcccatgcttgaggacaacagaagttcactaaggntgcacgatttttctgagaagtttttnnncntcgncctcgccctcctcttcctcgnnctccccttgttcgtcggccgtggcgtcntggtattnntggtattnggntaccaggttgtttatnttgtttttggcntcggtgaattccatntngtccntgnnctcgcccgtgtaccagtgcaggngggnnttgcgccggaacatggccgtgaactgctcggagatgcgcttgancagctcctggatggccgtgctgttgccgatgnnnntngccgacatcttcaggncgnggggngggatgttgcacacggccgtttttangttgttggngttttntttcacgattntttgttntttttnttttgttngttntgtttttttttgttcaccttntttatggacatgcggccccggaggntgggagngaccgtgagtnggnggggtggtgcgggttgcaggcggccattntnttnttggtgtgtgaatatctgctgggtgagctcgggcacgtgagcgcccggtactgctggctgccccggctggtcaggggcgcgaagcggggcatgaagaagtgcaggcgagggaagggcacatgttcaccgccagcttgcgcaggtctgcgttcagctggcccgggaagcgcngcaggtggtgacccgctcatggtggccganaccaggtggttgaggtcccgtagtggggggtggtcagcttcagggtgcggaacagatgtnatacaggggc

SEQ ID NO: 506952 - DNA, 560 bp, Homo sapiens
  misc_feature (215)..(215): n is a, c, g, or t
  misc_feature (240)..(240): n is a, c, g, or t
  misc_feature (258)..(258): n is a, c, g, or t
  misc_feature (262)..(262): n is a, c, g, or t
  misc_feature (264)..(264): n is a, c, g, or t
gctgggaacggtgggagccgccgctgtgtgtgagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgttctctgggctttgggnaaacagtatgtggagagacatttcnaataacgaccggtcccangcgnangtctacttgccacctccggctggacccggcgcccgaaagagaggaggaccctgctacaggcactggagacccaccccggaagaagcccatcgcgtgctggctattggtgttgaaggcgggtttgaccttacgcgacggagacaacgtccgaattcatgacgaggatgtgaagattgtcagttttgccagattacctggagattgccctgggatggactggggggactgcctgtcgttgtcagatatcgggtgaccagtgcagtgtcaggccctactgtctgtcgtactcacctccc

SEQ ID NO: 506953 - DNA, 118 bp, Homo sapiens
atcgatacgacttttttttttcttttcctttcctttcttttcttttctctttctttctttttctttcttcctttctttcttttcttttctttcctttcttcccttctgtcgtcttctc

SEQ ID NO: 506954 - DNA, 125 bp, Homo sapiens
ttttttaagcacgctgcgaagctggaacgaaagcaatggccctggtgtcaggaactgagagttgtgtggttggcaaagcaacactggtctgtgcagaacccagcagtcctaatggaggtccaaag

SEQ ID NO: 506955 - DNA, 225 bp, Homo sapiens
atcatcatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacagttcgag

SEQ ID NO: 506956 - DNA, 115 bp, Homo sapiens
agaatgccacgtgttaggtagaatgtgcttaggcgaggggaaagtacaaaggaaagatttgagaactcgtaatagtaggcacagcatgggagccgtctgacgctgcacggtcaca

SEQ ID NO: 506957 - DNA, 164 bp, Homo sapiens
tccccatacagagtatgactctatctgagacaaaaataaaacttgtgtggctgggcatggtgtctcttgcctgtatcccagcactttgggagactgaggcaggaagatcacataaaccctgaggtttgaaccagccttggcaacatactgatgaccccactctc

SEQ ID NO: 506958 - DNA, 134 bp, Homo sapiens
ttgacccttttttcccagggggcccccccccttttgggggcccccgggttttttcccccccccccccccccccccctggggtttttttttggttttggggggggggaaagaataaaaaaaggggttttttgcca

SEQ ID NO: 506959 - DNA, 853 bp, Homo sapiens
gctagcttgcggctgtgtttatggtcgggcctctgcgttcagctgctccggaaccgtgctcgggtgtatggggccgtaggaaccggctcggggccccgataacgggccgtccccatatgcacccgggctgtcgtgagggtctcccttgatctgaaatggctacctctcggatatgagccagtggtgaaattggtgtcggtgcctatgggacagtgtacaaggccgtgatccccaagtggccatttgtggccctcaagatgtgaatccccaatggaggaggagagtggagcgaggccttgccatcagcgcagttcgggatgtggcttgactgaggctgactggaggcttttgagcatcccaatgttgtccggctgatggacgtttgtgccacattcccgaactggaccgtgaggatcagggtagccctggtgttatgaggcatgtagaccaggcacctaaggccatatcttggacaaggtcacccccaccaggttgcaggcgaagacgatcgaggatctgatgcggccaagatttctagaaggctagatttccttcatgccaattgcactcgttcaaccgagatctgaagccagagaacattctggtgacaagatggtggaacagtcaagctggctgacttggctggccagaatctacagctaccagatggcacttacacccgtggttgtacactctggtaccgagctccgacgttcttctgtagtccaatattcaagcacctgtggactgtggagtgttgactggatctttgcggagatgttcgcgaagctctcttgtggggaatctgagccgaccagtggggaaattcttgactgattggctctcagaggat

SEQ ID NO: 506960 - DNA, 338 bp, Homo sapiens
  misc_feature (213)..(213): n is a, c, g, or t
cgtatcctttatctctccgatttttgccgagtcgtgggtgtaatccagatccttctgtgatcatcctgttgttgcaatgtcggtggcatttggctgataacatggtcgttgccggtattgagagatgaggacttaccagtgggcaagcttcaaggacattcataccaccaccgggaagatcacgagagctgttctgcaagttaacactcctgnctacgctggaccctagtgttcgactggatttagacccccaaagtcttcttttcacgacgacgtacgctggagttgtacccttgttctggaggagacgacgggagtaccgatgctcgacattcgta

SEQ ID NO: 506961 - DNA, 1135 bp, Homo sapiens
atgagctagcgcctagtaacataaacatgctagcttttattccagttctaaccaaaaaaataaaccctcgttccacagaagctgccatcaagtatttcctacacgcaagcaaccgcatccataataccttactaactagctatcctcttcacctcctcatactactccgtgactaatgtaaccataacctaatactaccaatcaattcctccatccatttaataatcataatggctatagcacatacacactaggcaatagcccccatttcacatctctgagttcccagcaggcttacccaaaggccacccactctgcacattccggcccttgctctctctcatcacactgacactacaacctagtcgccgcatactccaagtcactattaccaagatcgtctcgcctacagctacacagcgtatagcgctatctaccgtccacgtactcgtcaactcgtgtataccatgcaatagcccatggccagctccggacgagctgtgactatagacacacacatatggcgcaatacgtaccgccctacgaacctccgtctacggacacttatcctccgcatcctatcgtctaccccgcaagctacttagaggacatgcacacgtcatacttatggcacacgcgtcatccgttaaccagccgtgttatcgccgactcccggccgtacaacgccgcgtctctaccggcgacggttatcggtacatcatattactctctgcaccttaacgtaccctacagtacgttatcacgtgcccgcttaacagtgccttaagacgttacacaccggcaaagattagaccgcggttaacgcagtcaaccggtcccagaaagcacctgtttttacgaatacaacaccttttccacacaaagtatcaacaccaccactgatggtaaatctaccaccgatctagactgccttaacagcctataaattctcattcggcgacacatccctacccgattgtgctaccacctaactacagccgctgccattaaactcgccatacttggtatcacagtaacaacgcaatccctcacctactactatatcaaaccatatcccccaataatatcactcatacttcacgcaattaccacatctcaatatccatccactata

SEQ ID NO: 506962 - DNA, 147 bp, Homo sapiens
  misc_feature (18)..(18): n is a, c, g, or t
  misc_feature (25)..(25): n is a, c, g, or t
gcggtggcggcgcgtgcnccggagncgcgcggccacaaaaagaagaaggctaccccacttacagatgcagaccatgtggggctccggagaactgcttgtagcatggtttctagtgttggcagcagatggtactactgagcatgtcta

SEQ ID NO: 506963 - DNA, 807 bp, Homo sapiens
  misc_feature (83)..(83): n is a, c, g, or t
  misc_feature (90)..(90): n is a, c, g, or t
  misc_feature (111)..(111): n is a, c, g, or t
  misc_feature (114)..(114): n is a, c, g, or t
  misc_feature (116)..(116): n is a, c, g, or t
  misc_feature (123)..(124): n is a, c, g, or t
  misc_feature (129)..(129): n is a, c, g, or t
  misc_feature (131)..(131): n is a, c, g, or t
  misc_feature (137)..(137): n is a, c, g, or t
gctccttgtgacttgtgaaaaccacacctcagccttagggtacaaagagatgtctgcttcccagtcaaacttagcagatccantcaggtnatttggatgggaaagaatctnatntnagcaagnnagaantntattcnaggaatatgggagagctcacaaaattgggctggaagctggcagagtccatctcaatgaggacaggaatcaggacagctctctgagcatgcgtaagcacgaataacccatagacaagttttgtaccaaccattttctatcttttgatttctctcagaaaaccaaaaagtccagagcagagcacggtctgattggcccaactttggtcaaatgcccacctactgctcggggaagggtaaaagcaacctgagggattctcttttcaaggctgtgtccaataggagaggggcagttcctcaaagacgaactcagggcgctgttagcagaatgcacagaaccagtgacaaagggggaaaaacagcagatgccgcatgtacagagtaatcagtcatgttaaactacccctctcttttccatgttgtcctgggtcagacaggggagagcaccagctaacccagccctgttgcgtgggtgcactggcaccggggatgaggtaaaatgggcgcttcagagaacactgggctccttgtcccgaaacagctagccaaggtggtcacacagacctgtggcctggcagagaggagaccggttgggcgtgattctgaccagaatcctgagtggaggatggtcatggtacctgcatacaacaggtcaggccaatttacatctaat

SEQ ID NO: 506964 - DNA, 827 bp, Homo sapiens
tggggtgatgaggaatagtgtaaggagtatgggggtaattatggggggccaaacggaatattagtgggggcattaatatggataatggtggtgatgaaatggatggcccctaaaatagaggagacaccggctagggtgtagcggagaagagggttaggctcatacggaggctccagggtggggagtagttcccgtgctaagggagggtagacgggtcacccggttccggctccggcctccactatagcagatgcgagcaggagtaggagagagggaggtaagagtcagaagcttatgtggtaatgcggggaaacgccatatcgggggcccgattataaggggaactagtcagtggccaaaagcctccgataatgaggggtatactatgacagaagatttttacaaattgcttggcgctggtgacgatacccgctggtaaaatgtggtcgtacctagaaggttgccgggctggcccacgctcggttcgaataaggaggcttaaagctgtgcctaggactcacagtaagggcgccgaaaaacagcgcatcagggtgcccaagcgtctttgcgggtctgtagcagcaacagtccaaccggtctggacgaaccatcagggcgcgcgtgcggccacccaggccccgcacatcgacaacttcgccacgccaatccaaccagaccggcggaagcaccacctcaacccgccccaagggcaatccaccacgcacggcacaatcgcaagaactagattcaaaccggcgggggttcacccgcctaaaccccggcgggaaaaacatgaacccgagacacgcggcccacgccccaccttg

SEQ ID NO: 506965 - DNA, 674 bp, Homo sapiens
cgagggttatcttgggtggatcaaattcaaaagcaaggtgcgaaggatgttgggaccctgtgcgattccgccagttctagagaagaaagttctcggctgatccaattagtgacccaattgtccttgggggaaacataaaagaagcgtgtagttagactttgcaagcccagtctcagaagttgactggggggacggaaaccacgccttggtccagctcattcctgagaaaggcttgttttgggtacgtgtcgtatgagtacacccccaattctttctgaggggcatggtttggtaatctaacactgggctctacctgtggccatttcttgcacgcgcaccgatggttggaccttcaagagtcaaggtctgatgatatgtgcatgggccgaatcttatagtgcagtaattcaatggcggattccgtctgcgtgcacggttacatgcatgtttaacagtgcttggcactaacatatgggttccataagcatgctagatgattagtcatgctcgtggatcgtgcagatgctgctccctaaagtcataaatgcaggaataagattcttgtgatgtaggcagtgttgtatattaagaagtcctggctgcgagtacatagggtgtccgtgaacgtaatgtagggcagaacgtctatggtgagcctgtaatagatagacttc

SEQ ID NO: 506966 - DNA, 213 bp, Homo sapiens
cgacgacattggcaactcatgccccttggaggcatgcaaccatgcagtcctagcctgcaggcgtgggcatccctgaggaacactacataagcgaggctgttggcagatgctcccagctacagaggggaaccgggatgcctgcaccattactgcatgtgtgcacagaaccgatctcccggaggtcgagatcataagcctcctggaggagcagct

SEQ ID NO: 506967 - DNA, 206 bp, Homo sapiens
tctccatgcctggacagcaaacctagactccatctcaaaaaaaaaaaggaaaaagtaaaaattttaaaaattagatgggcttggtgacatgtgcctgtaatcccaggtactagggaagctgaggtaggaggatgacttgagcctgggagtacgaggctgcagtgagctctgatcgcaccattgcactcccagcacaagacacgggc

SEQ ID NO: 506968 - DNA, 356 bp, Homo sapiens
  misc_feature (2)..(2): n is a, c, g, or t
  misc_feature (78)..(78): n is a, c, g, or t
  misc_feature (92)..(92): n is a, c, g, or t
  misc_feature (119)..(119): n is a, c, g, or t
  misc_feature (122)..(122): n is a, c, g, or t
  misc_feature (128)..(130): n is a, c, g, or t
  misc_feature (137)..(137): n is a, c, g, or t
  misc_feature (139)..(140): n is a, c, g, or t
  misc_feature (144)..(144): n is a, c, g, or t
  misc_feature (150)..(150): n is a, c, g, or t
  misc_feature (155)..(155): n is a, c, g, or t
  misc_feature (157)..(157): n is a, c, g, or t
  misc_feature (162)..(162): n is a, c, g, or t
  misc_feature (170)..(170): n is a, c, g, or t
  misc_feature (184)..(185): n is a, c, g, or t
  misc_feature (193)..(193): n is a, c, g, or t
  misc_feature (196)..(196): n is a, c, g, or t
  misc_feature (201)..(201): n is a, c, g, or t
  misc_feature (205)..(205): n is a, c, g, or t
  misc_feature (234)..(234): n is a, c, g, or t
  misc_feature (272)..(272): n is a, c, g, or t
  misc_feature (287)..(287): n is a, c, g, or t
  misc_feature (354)..(354): n is a, c, g, or t
tntctgttattttttttttcccttttgattttttattttttttatataaattttcttcctttcctttgttgtttttcnccccgtttcttggnaacatggaggcaggggttctggtcctncantctccnnncaccctntnntccnaccccnctctntnacccnacattctnccccatcccctccnntccccacnttnctctntccnccaacacacccacttctttcctccacatncaccaaccctcacctctaaaaaccatttcccctcacantcccaaacaaaaccnaaacccaccaaccccatcctccatctcctcccttttctcccctcccttttctcctcaccaatttacntc

SEQ ID NO: 506969 - DNA, 1166 bp, Homo sapiens
cgacaatacctattttacagtatcaaccggatgtaatacacgccgcgcagcggcatagagccagagcaccttaaactgtgccgcggtaatatccagcggagacagatactcgatcaagcaggcgatcttacttctgattaaccatatggattaagcagacccaatggcacatcatttcattgaacagatacgctggtacttttcacattagtagccctggcaagataataagattgcaggggatcaatctagcccaggcaaagctataagatcacatgactgaattgacccgatgcccacgtcaaagcactaacatcgagtatacaagtatctgtcacaatgacgatgcaaggactcagctaacagaagtgaacactataatcctatgtaacaacccatatatacctctacacgcctgataacaccagaatcaccactaggacttacacaaccaaccaacatggttaagaatataggttcaaaagccaatatggaacctggacggcttaggatgagagctaggcttgcccgctctagcattaaccccaaattaacaaaagtgggtcagccgattaacatcaacctacggagcacatgggacacagaggacaaacattgcaagcacagatggacagaaagaggataaatccagctcaaggatacgatatgcactaggccacatcggaagaataaccgataatataagacaccaactcacttgacatgcgatgatgcggataaccaaacaacacacccagggggcacaacgagcggacagacatggagaacaacaaatacgaagggcccaataaccggaaataaacaccgaggcaccagggacaaaactttgccgcgccccgaagccaaaaaccccgaaccgacgctacaaccagacggaaacgaaggcgaacgaccacaatgcacccggaaacgaacaaacagcgagaaaggaaactcaacccgaaaaaccaaaacaaccgcaggccacgcgaccgagacctcggcaacaaacgaaccccagaggacaacaaaacagacccgggcgccagcaacaggaacaggaacaaaaaacgtgcacgaaaccacagacacaacgaacagcagacaaaataccacccggacaccagaagaagactcacacaccaaccacagcgacaagaaaaagg

SEQ ID NO: 506970 - DNA, 381 bp, Homo sapiens
cggatcacttgaggtcagtagtttgagaccagcctggctaacatggtgaaacatcgtctccactaaaaatacaaaaattagctgggtgtgttggtgtatgcctctagtgaaaatgacatagaggcaggacccacaggagcctatttgaacttgtggcctgaaaccaactaggttgattgcatgataaaacaaaatgccaacattctcaatgggatttaaataagaccagtctcataacataatgtctaaatgtgcaggagacaatctaaaattactctgcatgtgaagaatcaggaaatccaacctgcaagagaaaagacaatcaacagccgccaatgccaacatgacacgaaaaccctcaactaattatcagcaaataga

SEQ ID NO: 506971 - DNA, 234 bp, Homo sapiens
tgcacattggaagcctcatgagtgcggctccgccacttgccagagggcacgagtggggatgtacttggccccaatggcatctgtatcagccgcttctcatgccaccactgtctacaaattcatcagcatttaacttcgtgaagccgcacttcttcaagatgtgtatcttctggcggacaggaatacttagaacttgtgcctgcgcaggggttcaatcacatgctccttgtacta

SEQ ID NO: 506972 - DNA, 116 bp, Homo sapiens
cagggtctcagattcacacttgagctacttcaggacccatacaggtaggctctgaatgaaaatgattggcagctcatcatgaaagcctacaactatattatacacgataagtaatt

SEQ ID NO: 506973 - DNA, 394 bp, Homo sapiens
tatttgttttcagttctgtcacccaggctggagtcagtgagccgagatcaagccactgcactccagcctgggcgacagagcgagactgcgtctcaaataaataaggcaacaaggagagtctggatgcagtggctcatgcttgtaatcccagcactttagtaggccaaggcaggcagatcacaaggtcaggagttcaagaccaacctggccaacatagtgaaaccatgtctccattaaaaatataaaaattagccaggcatgatggcccatgcctgtaatcccagctacttgagaggctgaggcacaagaatcacttgaacctgggaggcggaggttgcagtaagccaagattgtgttgctgcactccaacctagggggcaaagcaagcctctca

SEQ ID NO: 506974 - DNA, 207 bp, Homo sapiens
ccggaccgggaagagatgcgttgaatatggaaagctgtattgacgctgaaataaatgaagagagcctacaagtagaagatcatctgttggtctctcagttcactgccagcttatccatacatatggtattctggttgatagaagccaagtaagggcctggccctgcctgctcctagaactgcagcatgtaaataccatatggacaag

SEQ ID NO: 506975 - DNA, 453 bp, Homo sapiens
  misc_feature (182)..(182): n is a, c, g, or t
  misc_feature (206)..(206): n is a, c, g, or t
  misc_feature (222)..(222): n is a, c, g, or t
  misc_feature (264)..(264): n is a, c, g, or t
  misc_feature (309)..(309): n is a, c, g, or t
  misc_feature (332)..(332): n is a, c, g, or t
  misc_feature (344)..(344): n is a, c, g, or t
  misc_feature (359)..(360): n is a, c, g, or t
  misc_feature (389)..(389): n is a, c, g, or t
  misc_feature (445)..(445): n is a, c, g, or t
catcagccctcccctccatttattcctatttttctgtagttaagaatactgtaaaaatgtgactattccttaatatcagaaaagaatgcacaggctgagtcttccggtcaaaagttaaatactgatggaatcaagtattttgtatgaagttctcatttggtatctctaacgctattttgggntttgcatatagtattatagtatgngtatatcactttttgnatagagtaagcaattgaataatttggtagtaaaaataatccncattgactggaactggtatagacatagcttgagtttaaggctccnttttgctcatttctaagacttangaggaaagaatnaatctaaaatggccnnttaaaccattcttccattcagcttgctgnggtaacttaaggaggtttaaactatccttctctttaactgcatgtagttggctgtntgtgttct

SEQ ID NO: 506976 - DNA, 460 bp, Homo sapiens
  misc_feature (183)..(183): n is a, c, g, or t
  misc_feature (230)..(230): n is a, c, g, or t
  misc_feature (401)..(401): n is a, c, g, or t
  misc_feature (419)..(419): n is a, c, g, or t
  misc_feature (428)..(428): n is a, c, g, or t
tttcggcgagcgagcaccttcgacgcggtccggggacccctcgtcgctgtcctcccgacgcggacccggtgccccagcctcgcgctgcccggcaggctcctcgtgtcccactcccggcgcacgcctcccgcgagtcccgggcccctcccgcgcccctcttctcggcgcgcgccagcaatggcncccctgcaggtcctcgcgttcgggcttctgcttgccgcggcgacggngacttttgccgcagctcaggaagaatgtgtctgtgaaaactacaagctggccgtaaactgctttgtgaataataatcgtcaatgccaagtgtacttcagttggtgcacaaaatactgtcatttgctcaaagctggctgccaaatgtttgggtgatgaaggcagaaatgaantggctcaaaacttggggngaagagcanaacctgaagggggcctccaagaacaatgattg

SEQ ID NO: 506977 - DNA, 975 bp, Homo sapiens
cattaccaggtagcctgtcaaaaatactttgagatgatacacaactgtggatgattgtggcttttcatttgaatcatcctaatcagttctatttgtgagagccaacgttacttctaacatggctggtaccagaccataaagacaggaatcctagtccatacctagatacactccgtcaagcccaataccatagctgttccagacaaaccaacggactgcatcatctgctctggcctctttaaattcctctctggaacctggatatggaaggactagaagattactttagtgaagattcttaggcagtatttataacccttatttcctcaatagcctgtttcctgctcttacaagacttttgcctttgcttgttgaacacaagggtatacacatcatgatcaccaaggcttagctgcagctgacacaattacaagctgattgcagccctgaccttcccagctcacgtgatcctcctacctcagcctcccaagtagtcaggaccacaggtgtgcacctcatatccagataatttaattacaatatactaatagtagaggtggggggtctccctatgtagcccaggcagcatctcagacatcctgggactcaatgcgatcctcacaactcagtgtacaagagtgctgtggatcacagtagatgagccaactggttgcctggccattctatacacacgaaaacccactatgagtacaacataccaacactacagagggaatacacaaaacccatacttacaggcaatgacacacaacaatagacaaagcagcgatacgaacgaaaaacaacaagacaacattcccccaaacactaggcgcagtggcaagaaaggcaacaacctacgcacaccccatataagaagtacggcaacacgacacgagcgccacactcaacaccctacccctcgccaataaccaccactcccgcaccacgctcaaccccccccaccaccccacc

SEQ ID NO: 506978 - DNA, 918 bp, Homo sapiens
cggggtactgataggtgtgggtgtcgagccctctggcagagggttaacctgggtcaaatgcacggattctcactctcgatacagaatacgtctctcccgcggtggcacgtctcgcgagggacttgcaattcctgtagccgctcaagtttgtccagtagagttcgagtagaaggccaatgggaggatgaccgccgcaccggcaaccgcggcagctttctcgtgtagaatgcgattgttgcccatatttccccgaagctcttcgactgactcagaaggtctgagtacttgccagattcgagaagatccttgaaggaagtggttccagtaagcgtgcttcccatactgctgcctagcagacctctgattacccgcgatatctggtagtggggaccgctctccggcgagctggtttggcaaagatggaacagcagagaattacaataggaccttgctaatatctgtaagaccggtcagactacatgacagagcatcattggctggagtgtactggcgggaataccagcttctattcactgctaaagcaacaatacattgagcagagccatggcaggaaatttatcataaccggtttgatcgctgtgcaatctgcacatcgtgctgccacacgaggcttcacttcgttatggctggcgctggcgttggcagaactgcagtggttcgtcgcgtattattcaagacaggcgaacactagtctggacttgtatccgacactaaagatgccttaagcatctgcgtcattgccgggaactgcacgggcagtcttttacgataaacataggctgcgtggctgggggctggtggccttctgggggcttggcgtgggcacctctgaaagcaccagtggctcccaacaccccgagacatgcccccaccacaccaccgaccaagggcccaccc

SEQ ID NO: 506979 - DNA, 615 bp, Homo sapiens
  misc_feature (418)..(418): n is a, c, g, or t
  misc_feature (431)..(431): n is a, c, g, or t
  misc_feature (601)..(601): n is a, c, g, or t
agcggagcggtggctccgagaccgcgaggtgggtggagcgggtcttcctggaagggtgcgataaggtcggggcgaggtgcctgggcatgcttctcctccttccgtcgaggagagagatctaatgtggcgtaggagcgggatgtagactagacctgccgaagccagtccgcatgggcacctgcagcctcactgtggcgcgctcggcggagcgcaccaggccagagtagaagtgtgttcaaacgcggggctgcaggtgcgttgggttcccgtggcggtcctgacgagctgcgccatctctacgacccttgccctagacacgaatgcgggtcacggtcccggtgggcgtctggcgagagctgctacgctttcactgcttgatatgatcatactacacattcaccgtggtcttccgcgcgcngtgccgctcaagnaccatgcgtaccggcgagacgcaaaactccgacggcctagggcactatggatgcggtcgcaacaacacggcagaggagcgaaggattagcgtggcagctcgccgaattactcgaggaagactcctaaagactcatgggtagcacacatggtaatggtggaggtaattctntatacccaggcccg

SEQ ID NO: 506980 - DNA, 160 bp, Homo sapiens
ccaggaaggtgcgtcagcatctgcagccgcgtcgacgttgtcggagctccgcggaggacccaggagagccggactaggaccaggccctgggcctcccaacactccccatggagaagctggcggcctctacagagccccaataaacgatcccacagcctca

SEQ ID NO: 506981 - DNA, 569 bp, Homo sapiens
caaactcaataaataaagtcgatccagcagttagggcataaaaagagtgctgtggaaaccatgagatcgccaaacgaagagtctcaaagtaggctgaatcgcgatgctccaaacattgccatagtgtccttattctcacatgcagcttatcaaaataatgcccagtgcagagaaaagttacaggatgtaccatcaattgggtgatagtaaggatgaaagagttgcttccagtaacgatcatgtagacactagtggcacttacactactgactgcagtccagctagagctaaattccagaaaacaggtaaaaccaggaagggtctcacttcctgaagagaatcacacttagaacatggcagcgtctgcattacctatctagatacaatgaactttccagagctcaacgaagtggtcctcaatcttctgcttggcacgtctctctcccagcgtctccaaggcatccagcagggtgtggacagaggcatctcgcccggtttagtagaaccacttaatcagcatcgtgtacaaggtgtccctgtgacccgatgcctcagctatagccaactta

SEQ ID NO: 506982 - DNA, 391 bp, Homo sapiens
tggggtatccacaaaccactcccagctgagggcatgggagacgcgccctgtatgggagcggcccaggggactctgctcagggactccactctgccgtggaagtggaggggctgtgcggtccccccgacctggtcgtcctcccgcccaccccccccagcctgtccataggcacgtggtttctgaccgtggcaaccttgccgcggttcttcaacagtgggtttcatggtggaaacttgcctcctgggctcagccagatcctcccctggtgccagcaagctggagcgctcgctggaagtctgcctgggccacaggcccattcccagacacctgctgcttccaagctcgggaagcattccacggcctgcgctccctgcttcccagccgcggccgc

SEQ ID NO: 506983 - DNA, 179 bp, Homo sapiens
tggtcggcccatctaatattctcatctcactggcagacatatcttcacagtgctggtttagttctcggataggacccagtgctgcatctttgccaaagctgttaggtcacttcctgagtatccatcagtcattctagcaagttgtgctagttcttttagggcgaaatagtaatcctcca

SEQ ID NO: 506984 - DNA, 345 bp, Homo sapiens
  misc_feature (239)..(239): n is a, c, g, or t
gggcccccccccccaattttagggggccccccttttttttttggggggcccccaaggaggggggttttgggggtttttttcccccccccccgtggcccggggttttttttccccccccctggccccggggggggggtccccttggggggggttttgggttcttttccccccccctttttgggggggggggttttttttttttttcccccccccccctttgttttttttttccccccctnccgggccccttttttggggggggggggttctccccagggggggggttttttttttttttttttttttcccccggggggccccttttggggggggggccccccccca

SEQ ID NO: 506985 - DNA, 302 bp, Homo sapiens
aatcgtctgctcgtcaacatgctgattgtcagctcttgcttcggcgaaagcagtaacagggccactcccgatccagcactgattcgaagtagcgggtctggaatcctgccatcagcggagtgttggagcacgtctggtaccattccatgccagccctgttgatctcgctcccaccagcactccgtggcgtccccgaggctctgtggtgtgggcatgcaggcgtagttccattgcctgtcagaaccttccttcttgctgaagatgctcctcacgggcattatcacctgcccctggggacactg

SEQ ID NO: 506986 - DNA, 104 bp, Homo sapiens
cctctcggatgaactgatccgtacgtgtcacatgtagacgcgactacatcgaagtgataggcagacgtcgaatggtcgtcgcgcacgtggcgtcgatcggccga

SEQ ID NO: 506987 - DNA, 401 bp, Homo sapiens
tgaggatgtggcctgtgtgctgcttaacctggcctagaacttgctgcacctgctgttcttttgcttccaccttaacccttagtttatgctaattttctattctcctgcctcagaaggtctccttaggaggccaagcaggctcttacctgcttcaggtgagcaggtaaccaggagggagcggaccacagttgctatcatgtctatgattagtgtttggaaacctgtgcagacctttggctccacttggatgggatagccaagagaacagatatgtggtttttggatcatgatatgtctgaatatttgtgtaaccttatgtattaccatcagtttttatttgttaggcatggttattcttgctcgtattattattattattattattattattattattatta

SEQ ID NO: 506988 - DNA, 419 bp, Homo sapiens
  misc_feature (89)..(89): n is a, c, g, or t
  misc_feature (365)..(365): n is a, c, g, or t
  misc_feature (412)..(412): n is a, c, g, or t
  misc_feature (414)..(415): n is a, c, g, or t
accacaagcactttatgtgaaatgtgttcgcccaacgattaattatgtttattccccgagaagttttaacccagattgtggatgtgtantctggttcagcatatattcacaattacctttgttttttgttttgttgttttggagacaaggtcttgctctgtcaccccaggttggagtgcagtggtgtgatcatagctcactgcagcctcaaactcctcagtaggaaacttcctaccccagcctcccgagtagctgggactagtagcatgcaccactacacatggctaattttgttttttaaattttttctagagacggggtctcattatgttcgcccaggctggtctcaaactcctggcctcagngatcctcgcaccactgcacttcagcctaggtgacacagcgagagtcnanntatc

SEQ ID NO: 506989 - DNA, 501 bp, Homo sapiens
atgctgcaaaactgaaactgtcacttactttaattagtggaattaccattactgaatcatggtcgtaaaaggtgcattcatgtacattaccacttattttaaataaacaccaatgttgaaacaatcaactttgaaaagctgcataagtttttgttttaatccctgattacatttctatttattcacgggggtagcctgaaacattgtattttgagagactaactacggcttaatttcttttttaaaaaaaacaacaacaaacctggtgtaatatagaacaccagaaaagcaagaaaaatgtgtgcttgtcacttatcttcaccatactgtccataagaactctgataaaatatggtactggtgccacattagtattggggaaaacataattcactcatagcacagagcacatggttgaccaacttactactgtgaaatccaaggtgtggactttcacctcagtgctgtattcaggctaccagagcatccccccggaggtcc

SEQ ID NO: 506990 - DNA, 328 bp, Homo sapiens
gttttttttaaaaaaaagggttttttccccccgccccccaaaaagggggacgggggccttttggggggggcccaattttcggggggtccaccggccccctttttttttttgggttttcccccaagggccccccccccccccgggaaaaggggttttttttgggggggggggggcccgggggggcccccccccccggccccgggggggggcgcctggggttttttttttttttttttttttccccccctttttcttttttttttttttttttttttttgggggttttttgttttttttcccccccctatttcccccttttttggtttta

SEQ ID NO: 506991 - DNA, 225 bp, Homo sapiens
gagaaaccttatgaatgtcacgattgtgggaaaaccttcaggaagagctcctatcttacacagcacgtaagaactcatactggagaaaaaccctatgaatgtaacgaggtgttggaaatccttcagcagtagctttatatcttactatagcacaagaggattcatagccagggaggaccctacgagtacagttactatagaaaagaccttatattactctcatag

SEQ ID NO: 506992 - DNA, 138 bp, Homo sapiens
tgctctcgatctcctgaccttgtgatccactcacctcggactcccaaagtgtgggattacaggcgtgagcaccgcgcgcggcacaaagtatccttttaaatatagttgaaaccacaaagggaaatgtggtgtttttgc

SEQ ID NO: 506993 - DNA, 430 bp, Homo sapiens
cttacctaggctggagtgcagtggtgtgatcacagctcactgcagcctccaactcctaggctcaagagatcctactatctcagccttctgagtagctggactacagtgcacaccaccctgcctggctttttaaatttttttagagacaggggcatctcactatgttgcttaggctgttaccacaaatcataatcaaccatgtctccatttcttcatctgtcgcatggatttggtaatacggtatctacttcatagggttgtcatgaggataaaatgacctagtacttctcaagtgcttagaataggcctggcacatggtaaaaactcataattgtggctacttctatgcacccatctaaaaagactggaagaattccttcctccacccctggatttcttgggatagtggttttccaatattcctagtagt

SEQ ID NO: 506994 - DNA, 423 bp, Homo sapiens
  misc_feature (1)..(1): n is a, c, g, or t
  misc_feature (77)..(77): n is a, c, g, or t
  misc_feature (84)..(84): n is a, c, g, or t
  misc_feature (86)..(86): n is a, c, g, or t
  misc_feature (96)..(96): n is a, c, g, or t
  misc_feature (100)..(100): n is a, c, g, or t
  misc_feature (132)..(132): n is a, c, g, or t
  misc_feature (157)..(157): n is a, c, g, or t
  misc_feature (160)..(160): n is a, c, g, or t
  misc_feature (173)..(173): n is a, c, g, or t
  misc_feature (181)..(181): n is a, c, g, or t
  misc_feature (191)..(191): n is a, c, g, or t
  misc_feature (216)..(216): n is a, c, g, or t
  misc_feature (219)..(219): n is a, c, g, or t
  misc_feature (221)..(221): n is a, c, g, or t
  misc_feature (224)..(226): n is a, c, g, or t
  misc_feature (241)..(241): n is a, c, g, or t
  misc_feature (245)..(245): n is a, c, g, or t
  misc_feature (247)..(247): n is a, c, g, or t
  misc_feature (255)..(257): n is a, c, g, or t
  misc_feature (264)..(265): n is a, c, g, or t
  misc_feature (267)..(267): n is a, c, g, or t
  misc_feature (269)..(269): n is a, c, g, or t
  misc_feature (293)..(293): n is a, c, g, or t
  misc_feature (304)..(304): n is a, c, g, or t
  misc_feature (307)..(307): n is a, c, g, or t
  misc_feature (310)..(313): n is a, c, g, or t
  misc_feature (319)..(319): n is a, c, g, or t
  misc_feature (322)..(322): n is a, c, g, or t
  misc_feature (342)..(342): n is a, c, g, or t
  misc_feature (350)..(350): n is a, c, g, or t
  misc_feature (352)..(352): n is a, c, g, or t
  misc_feature (354)..(355): n is a, c, g, or t
  misc_feature (365)..(365): n is a, c, g, or t
  misc_feature (368)..(368): n is a, c, g, or t
  misc_feature (384)..(384): n is a, c, g, or t
  misc_feature (396)..(396): n is a, c, g, or t
  misc_feature (398)..(398): n is a, c, g, or t
  misc_feature (402)..(402): n is a, c, g, or t
ngtgaggatggaagaagatttagaagagtatgatagtattcttagattttttctaagttgccttttctgggtggggnagtttantnttagtgtctntggncatcacatttgaagaatgtttaagttgggggnggcaacgtgaattgcaaacagggcntgnttcagtgactgtntgcctgtngtcccagctnctcgggagtctgtgtgaggccaggngtncnagnnnaccagctagttgctntgtnanttctaggnnncattttnntntntgaaattttgagggttggtttaancgttttctggngcnttnnnntctttnttnttgtgggtttttttactttnccttttgngngnnttattgggtngtnggtcatttatgttgtngtcagttttttncnagtngtaagagcctatttaccatat

SEQ ID NO: 506995 - DNA, 87 bp, Homo sapiens
cccctgggcgccaggtgtttcggggtgcgggtctcgccgaccggggagaaggtcacgcacactggccaggtttatgatgataaagac

SEQ ID NO: 506996 - DNA, 267 bp, Homo sapiens
ccccccccaaagggggggggaggggggggggggttccccccccccccccccgaggggggggggggggggtttttttttttcccccccccttttttttccccccccaaaccggcccccccttttggggggggggggggggcccccttcccccccccccttttttcggggccccccgccggggcccttttttttgttgtgtgtggggggggccccaaaaggggcccccaaaagaagggaaaaaaacccaaaaaaatttttttttattta

SEQ ID NO: 506997 - DNA, 672 bp, Homo sapiens
ctgtcaagcaagatgttgtggcacgagtgagatgatcgacgtcctcggggtgagcaaggcagaggctacaatggggtatcagtcgttgtgacaccaatgaagctgccccaggaagaaccaccagaggtctgcgcaacgtggcctgtataggggcatggcatcctgctcgtgtagccttctctgtggcacgcgctgggcatgcaaaggctaccatctaacgcactgagatcaataagacgatttataagataggacaagggtaccttatcaaggacggtaagctgagtcaagaacaatgcctcgcattgactatgactcgtatctgacaagagcatcaaacctctgggtaggctttgtccactatggtgaagtgaccaatgactttgtcatgctgaaaggctgtgtggtgggaaccaagaaacgggtgctcagcctccgcaagtccttgctggtagcagacgaagcggcgggcctctggacgcaagatagaccttaagtaacattgacaccagctccaagtttggccatgggacgcttccagaccatggaggagaatgaaagcattcatgggagcacgtgaagaaagacacgaatatgcaaaggaaagaaggagcttaattgccaggaacagatatagcagtaggtgggggtactcaataaaagttatatcca

SEQ ID NO: 506998 - DNA, 295 bp, Homo sapiens
gagagagagagactccgtctaaaaaggaaaaaaaaatggatacataatgattatatatataactggggtacgtgtgatattttgatataggtatacagtgcgcaatgctgaagtcaaggtgattgggatacccatcaccttaaacatttatctttgtgctggaaacattacagttctcttctagctattttgaaatatatgataaattgttaactgtaatttcccctactatactgtgaaatactagagctaactgtttctgtccagttgtatgtttgtatccattaaccaactt

SEQ ID NO: 506999 - DNA, 155 bp, Homo sapiens
  misc_feature (42)..(42): n is a, c, g, or t
gatgcctcgtgtttgttagccttggcttatctcaataaccantagttctaacaaagtgctgaggtacaagtgtaagaggttgtgttcctggttcgccttttcgtttcctggaattgtttcttagatcttagagactttctctctttggtctaaag

SEQ ID NO: 507000 - DNA, 1499 bp, Homo sapiens
  misc_feature (392)..(392): n is a, c, g, or t
  misc_feature (398)..(398): n is a, c, g, or t
  misc_feature (525)..(525): n is a, c, g, or t
  misc_feature (562)..(562): n is a, c, g, or t
  misc_feature (697)..(697): n is a, c, g, or t
  misc_feature (738)..(738): n is a, c, g, or t
  misc_feature (826)..(826): n is a, c, g, or t
  misc_feature (883)..(883): n is a, c, g, or t
  misc_feature (982)..(982): n is a, c, g, or t
  misc_feature (1077)..(1077): n is a, c, g, or t
  misc_feature (1103)..(1103): n is a, c, g, or t
  misc_feature (1136)..(1136): n is a, c, g, or t
  misc_feature (1140)..(1140): n is a, c, g, or t
  misc_feature (1329)..(1329): n is a, c, g, or t
  misc_feature (1391)..(1391): n is a, c, g, or t
  misc_feature (1445)..(1445): n is a, c, g, or t
tctctgtgctgggccgtcagaatcccgtggtggattatggcgtggcaagtcttggtccagggaacacccaagacagtgggttatggtgggccactgtgtgccgttggcccgcagctaactcctaaacagttggttggtgggacccacaggggtcaatggggcagatggggcaaggtcattcatgtgacacgatccgtaacctgtgacaaggggtccatgtggagtcattcggcgatcatgtgggacgcgtgtctccagacagagacatcatataaatgggagccgacacacacaccacaaggatgagggtatcatagcacacctggatctacatctcacaggcagagtcacacatattacacaggcaggcacacacatcttcactgtcacanacaccntgtggacacactgtcacgcacccgatgtcgcgcgcagtcttcagtcattatagcaatatacacacgcgcacggtgacagtcacaatatatccctggtgatactcccagaggcaatacccgggacccnctatcccccgacacagtattggcgtggtgtccatttntccatcttcacaaggagggtgtttcatcggcgtcgagagcctggtcccacgttgtggacagagcgccatccttgtcaataatcgatcaatcaagagtcaatacattctcgacagcccgcttatctattgggtgtncctagtcacacaagttttgcagctccgcttgtgactaccangtggcgtcaagcccgtagtagacaggagcactgctattatttaaaggaaaccacagggtattcccgcagatactctatatataatatnataatcttctacaaccagcttattatttgtattccggttggtggccgttacactttnttacataccaggcaaaccacacagagtattagtatgtggggcaacccgggtttcattgggtcatgacacaaccccctttgacaaggtacaattttacanatccgttatcattatagccgcacagggatatattacgacacaggtatcttaagcagcgctcactttaaagtgggtttgtactatgtgggaaggcntcagcgaccaaatatcaacttagggngaacctagtcgagccacaggataatagagtgcncgangagactggtaacgattcacacacacacacactttacaagtggtggtgcttttcccgaggaggacaccatttctctacacacactcccttgtataccacacgaggggtattaaattcgagtgagggattaaggaaacagccaaacacttacaccactgtttccgctatattaacgacaccagttggtcgntctacggtgctacgagcctatgagacacaaccatgtggttgcacaaccaccaatctggtacngtaacatcattaacgacgacaattaactcctgcgacatgtgatggtagtgtacnacactcttgttcacatgacacatatactgagcgagctctatgtcagcacgtccc

SEQ ID NO: 507001 - DNA, 293 bp, Homo sapiens
  misc_feature (44)..(44): n is a, c, g, or t
  misc_feature (54)..(54): n is a, c, g, or t
  misc_feature (73)..(73): n is a, c, g, or t
  misc_feature (84)..(85): n is a, c, g, or t
  misc_feature (109)..(109): n is a, c, g, or t
  misc_feature (122)..(122): n is a, c, g, or t
tgtctgatcacgaaccctgtttcctgttaagatgtttatcaatnacaatttttncccagcacgacatggaccntcatcagtaanntctagtttcaccctggccttgtgntctcactctgccnctttgctgttgtgatattttactgcctttgaagcatgtgacccactccctattcgtacacccctccccttttgaaacccctaataaaaacttgctggttttgtggctcaaggggcatcaaggaacctgccaacatgtgatgtcacccccagagacccagctgtaaaatttc

SEQ ID NO: 507002 - DNA, 1804 bp, Homo sapiens
  misc_feature (1)..(1): n is a, c, g, or t
  misc_feature (405)..(405): n is a, c, g, or t
  misc_feature (914)..(914): n is a, c, g, or t
ngcatctatcatgagtgggcgatcaacacaatgagttgtctgtctcgtcactttgtgatgagatatcatttctcgtgcgtgcctggtgggaattcctctctaggtgtgggtgtggggtgagcctcgatttttttcttatcgggggatgggtgcccgctatcacacagatcgtttttgggtgacttggctcattagtggtacgggtcctccacatgtcacaaatggggggcggcctccccctggtgtgttctatcgggggcacacacctctgttgtgtcgtctcttcttcacgagggaccacaacttctttctcccgcacggagcgttgtttcgtactgaatcttttgtttttgaagtcccgcccctttgtctccacatgttgttggttctgtctcccccttcggngatactgggggtgtgattcctccaattctccctcacttcctcctgtggtggggggacaacacctcctgtggtgtcacaaatgacgtgtggtgcacacgaagcgccgcctggggaggtaggtagatgtacgccaccgtgttttatcattgtcatgtcggcggggattgtcgttgttgtccaagaggggacactctggtgtctctcgcccgtaaggccgctgcttgtggttggccgacgggaagcacaccaacaggccctcttttgtttggggcgacctacatgggaccaaccatcttttgggggtagacatcacaaacgggagggtttgagctcccccggggcgtgtacccccttgtggttaattttgggactacctgtaatattggtcccccccaccggggagattttttatagggaattaataagcgcgtggttgcgaacaacccacaagggggtctcccgccccacgttgtgactccgccgaagaggagccgcgccaccgtgggggngccacaacaccaacaacttgggggtatatacctacgcgtaggtctatctgctcttttgtgtgggcccttattatggagaaattgttgggaagtttttcccccttaatgatggtggcctatagttgtgttgtctggagttctaatctcttgggggggttttttgtataacaaatcggaggtttgtgaaataataaagccttctcgtgacacacactgtgtagacgctcttattatagaagaggcgggggagacccacacatatattgtttagaacaacatctgtctggcgaagttttgtcacggaggttatagagagctttttctctgtgtgtttgtgtctctctctcttcagagaagagcactgtagatcagcagtgttatagtgtttattttttcacggcgctcgctctctctgtttgggagtgggggggccccctcgggctctcttctttgtcgccccctctgttgggtgtggggggcctctcccccctctttgttttttggggcctttacacagggtcacactccacaggagaagaaaaatgagaggccttttctcccacatctttaatagtggcgtttccacaggcggagaaatgtgcacacctgggtatcacgcgcacacatatgggcacatgaggaggtctatagagagagaagtatgtgagcccggacacacagggcacgaagtaaggtcccctccactggccctgaatcctcctttggttcccagggctggcctttgcaagaagctgagttataaccaagtgttgtggctgtttcacatgggagaagagagctggggccccgagggaccttgagtcagaaatgttgcccagaaaaagtatttcctcccacccaaacatttccaattaaacccttttagttga

SEQ ID NO: 507003 - DNA, 1104 bp, Homo sapiens
gagtaacagcgggagctacagcggggacgcgagcggggcggtgacggctcgtgggaggtggtctcagtcttgggacaaactgctgggcacccggtcggtctgctgctgaaaggtggttcatgtaccttgctccagagttgtgcttagcgatggccgtggaaatccaggcggtcgccacgcgactcgacagcataagtccagcaatctcggcaaaacactggacatcattcaatgacaggatagaaagtaattcgacacgtgaatgactgggctcaccagtacgcgactccccactattgccaagacatggtaaccccgataccatgcgaagttcttcccaaaattccaatgaggttctccccacagccaaccaaattcaagtgccttcgcaacaacaatttgccgcgtgcctattacttggccggcctcaggacaaccctcccactacttattgcagtgcgcatggcatggcccctggacacacggggcacgcccttaagagccctcctatagaacggggttcacgggacatcctggggacacggttggcgaattctccgtctttatcgtcgccatgtgctcctcggggcacatccggttacatctgggcctcccgctgcattggtccccttgggtgcagagcacaccgttccgattaacgcgagaaacttctggaagtccaaccatctttaacaactcgaagcctttcacgtgcacaattggaactatccacaacatcaaaagcgccacagtcggttccacgcggcacaacgtgtgccaccgaagttgccacaaagacagcgtctacttagggtcagctcccaagggggaacgacagttaccaatgggcatctagcagtatcgctcgaggcgagcgcatctggtcgaatagtcaggtgatcgacttaggtggcgctagacaagaaaacgcgccccgtttctttccatcgtgccccaatttcccctttggctaggagcagagcacgcctttggtcgtgagccccacttgcttgtggtaacccccccaaggaggggacgtgtcataatgatctcaacgagttaaacggtcctcagtagatggacacaatctcaggacaacattgc

SEQ ID NO: 507004 - DNA, 436 bp, Homo sapiens
ttcaacacattagttcaatatcaatcaagtcacacaatactttctgtgtcaactgtctgcctagtgcactctatcatattgtgctattgatgatccacgttttagagtggtccctgtgacatgagagtcaatgcctcttgtgttcaaaacagaggaataatcccaaagttcttccgcagatgaactccattccagtaaatggtagatacatagaaattacagtaagccagacacttaaaaggacagccaagaagtcttccgacagtttattagaaagaatgtagacgtgtaaaaacactccccggcgtgtcatgaagataagtagaggttttcagcccgggtataagctgaatcgcaaataggaaatagaaaatccaatagtgtattagacattttccactcattagccagactgacggggcaaatagaaatcagg

SEQ ID NO: 507005 - DNA, 321 bp, Homo sapiens
  misc_feature (30)..(30): n is a, c, g, or t
  misc_feature (34)..(34): n is a, c, g, or t
  misc_feature (52)..(52): n is a, c, g, or t
  misc_feature (72)..(72): n is a, c, g, or t
  misc_feature (76)..(77): n is a, c, g, or t
  misc_feature (118)..(118): n is a, c, g, or t
  misc_feature (188)..(188): n is a, c, g, or t
acagacaaatggagaaacgggacaacttgnccancgtttcactgtaccagcncctgtagtgataatactcantatnntgtgtgtgatggctggtattattggaacgatcctcttaatntcttacagtattcgccgactgataaaggcatgaggatgtggcctgcatgctgcctgatcttgcctagaanccggctgcacctgctgttctcttgtttatgcaaactggctgcacctgctattcctttgcttatgcccctacccctggctatcctaattcccttttctcctgcctcactattactgtattctctacttctaaat

SEQ ID NO: 507006 - DNA, 102 bp, Homo sapiens
ggtgagctgcataggggcaggtactgctggggcatcatatcaaaggtcaggaactgaggtgcaggtgaggccgtacaccggatgctgtagtccagctccggt

SEQ ID NO: 507007 - DNA, 900 bp, Homo sapiens
agcgggtggagacagccgagcctgcggaaggcaggtggcggcggcacctgcgcatcagcggctggggcagtgttatggtagctgcgtgacttgcgtgtctgagcagtagcggcccacgggtgcccgcgcctggctgcctcgtggcgtgtccgcgtgcacgaatggtgcggacccacgtcgcgtgctcccaagacggctcgagggaccgtagtgagcgccgttcgggcctcgtgccttcgctcgcgcagaggcagggcggagcctcaaggaggggcaagacgatggtagcgtagagccaagatgtcgttttgtggttgctggaccgttcggcgagccagaagcattgttggccccccctttcggatactgcagcgacgcctctgtctgcgccttctatatgtttctttatgagtgcatgagactgaggggtagttcttgtgcctgcatccgacgctttgctacttgaagcgcaagaccatagttccgtgtccacccgaaaaggaaaagcctgggggcctaatgcatagggcccggcgtccccaaaggactggaaaccgggcccggaaagtaagaccaacttataagcgataagtgcctttcggaaattggtgcccctttcccaagagggggccaagtgctgggtaacgaaaaggggctgtggggaaattcttaccaccaccctgtcaaacatcacctaccagggtggtggcacttgtactccctgtagtttggcatttcgccttgcatcaattggaacgcgatggattgaatcaactctttgggaggaaagggagttggggtccaaagggaaccccaaaggaaaaacgggcccaatcggcctccagccaacccttgggtcttcccccccggggggggcccataagggaaaaacaattttcc

SEQ ID NO: 507008 - DNA, 120 bp, Homo sapiens
  misc_feature (44)..(45): n is a, c, g, or t
cccgtgtgcggacacgtaataggagtcctgagatgtagcagaanncgtgggaatgatcctcagtgtgctcacggggctgctgttcggcagcgatggctactacgtgtacgtgtccggcca

SEQ ID NO: 507009 - DNA, 211 bp, Homo sapiens
tacatataaatcagctcgtaccctcggatagggcaagatgggtcaccagcactgtactggagctacccgtcgaaaattcggaccaggtttctcgctcttgtcgtgtctgtcaaaccggcacggtctgatccggaaatatggcctcaatatgtgccgccgtgtttccgtcagtacgcgacggatatcggtttcattaagttgagacttatga

SEQ ID NO: 507010 - DNA, 177 bp, Homo sapiens
tgccctatgagacatcagttagagtgctccctctcctggtatacatgaagcatacaataccaccaaaactaaaaagttgaagaagtatgagttgtaattgacatattttcacattttccgtttttaaatataaagaactttatacttcgtatattaatatctaagtgctgtcattat

SEQ ID NO: 507011 - DNA, 323 bp, Homo sapiens
tgaggattcgggagtgcaggcagaggcgagattcatcaacccagagacgaccaggtacagaacaggctggtgacaacgggacatccctctcaccgcaggctagagagaggccctgggatacgagcaagaggttgctgtgtctagatgatttctatgggctgtgttttaccacagtgtttgtccttggaaaccatgcctggagtgccttctctggccccgagataagagcagatctccagtggagcactgtgggttccaggtcagggctcaaggctcatctcaagcctccacccttttcttccacgggataccggagctcgaac

SEQ ID NO: 507012 - DNA, 167 bp, Homo sapiens
  misc_feature (17)..(17): n is a, c, g, or t
gactggagctgtatacnatgctcatagggatagtacagcaggggtaggctatgtgtatgtcagcgggttgagaatgagtgtgaggcgtattattccatagtccgcctaggtttttaagagtactgcggtcagtactattgaccagcgatgggggcttcgacattggg

SEQ ID NO: 507013 - DNA, 436 bp, Homo sapiens
cacagtggctcacatctgtaattccagcactttgggaggccaaggcaagcggatcacaaggtcaagagttcaacgccagcctggccaacatagtgaaaccccgtctctactaaaaatacaaaaattagccgggtgtggtggcacacgcctgtagtctcagctattcgggaggctgaggcgggagaatcacttgaacccaggaggtggaggttgcagtgagccaagattgtgtcactgcactccagcctgggttacagagtgagactccatctcaattaaaaacacacacacacacacacacacacacacacacacacacacacaaataacaatattagaaagacaatacatgaacaaaatgaaaacaaagaaacaaataatagcaaatcttagagcggaagaatataatgactgaacctaattcaatagagatttc

SEQ ID NO: 507014 - DNA, 496 bp, Homo sapiens
  misc_feature (5)..(5): n is a, c, g, or t
  misc_feature (7)..(7): n is a, c, g, or t
  misc_feature (9)..(9): n is a, c, g, or t
  misc_feature (196)..(196): n is a, c, g, or t
aattngncnttggccgggcacggaggctcacgtctgtaatcccaacactttgggaggccgaggcgggcggatcacaaggtcaggagacagagaccatcctggctaacacagtgaaaccccatctccaccaaaaatacaaacaaattagctgggcgtggtggcaggtgcctgtactctcagctactcaggaggctgnggcagctgaatggcatgaacccaggaggcagagattgcagtgagccgagatggcaccactgccctccagcctgggcgacagagctggactccgtctctaaaacataaataaataaaaatatttaaagagtattgtcactttaaagaatacaatggctgggcgcggtggctcacgcctgtaataccagcgctttgggaggctgaggcgggcagattgcctgaagtcaagatttcgagaccagcctgaccaacatggtgaaaccccgtctctactaaaaatacaaaaattcgctgggcatgg

SEQ ID NO: 507015 - DNA, 114 bp, Homo sapiens
tcgactcagaggatccccatttaggtctgttgctaggcgatgagctgttataattatgcctcatacggatagtacaaggaacgggtaggctatgtgttttgtcaggcggttgag

SEQ ID NO: 507016 - DNA, 745 bp, Homo sapiens
gtgctgtgagaatgatgtttgtagattaataatccttttgtttagaattacaaaatagtttttaaatatgtctgagaaaagccaaagttaatgcaacctagtggaaactgtaagaccatttgagtatgtttgttttattgatgcatttggatttgttgtttgatggaatttgagccaaaaaaaaaatacgcaggctttcctatttctacaactgatggtacttatgcattttgtaccagtggaactttttatactggagattaaaaaaaaaattggaaattttgggggctggctcgggtggggccccttgacaattgactggatttcaagttggattccgggtggactggatggatggatggatagaaagaaagtggcttttctttggagaattaaaaacttggcttgatttctttttttcccttgcttatatctagcattagaattttggtcttaaaataacacgcggtaagtttcacttttaatccgggtatggtgcagttacacaataaggtactcacgatttagaagtactcagtcactttaacgtggataactgttttagtaaaaccttaaggggtctgcttatgggctgttagatcacagtttttctgattcttctgtcctcattgtgaactataacccgtgtcgttgaaacagtcaaactttattttcgactgtctgtcatcgtcggtgatgccagtttggcttctgtctccaatattaaaccattttccttattaaa

SEQ ID NO: 507017 - DNA, 230 bp, Homo sapiens
tcccccaaaaacacctggggccaaaaaaagggctggggggggtcacaagtggggggaaaaaagcttcgtggggaccgttcaggggggtaaaaaaagttttttgtgggagatacacccgagttagggggaaattgtgtttgtgggtttcaaaaaaaaccccaatttctccagaagtgaaattctccgaagagggtggaacataaccttatacccattgggaaacccggtgg

SEQ ID NO: 507018 - DNA, 1190 bp, Homo sapiens
tcgtttcgtccatgcgacgtgcgtcgctgcctcagccctggcgtcctggggcgattcgcgagctgtcctcgggtgagcctactgccttgtcgcgtcccttgatggctctcttctcgtagacattctgcctattttacctcatgcagtcgtctgagtctacacttgatccgacggcagggttgccgaggagaatgccctctagtgtctaaagctcaccggggtcccgcacccactgagacagagcttaggcaaacataacctcttctctgtttcaccaagcagtccatatgcaaaatcctgtaatttgggcagttcagaattatgatcgacacgggaaacagttggattactcgcaattgtgagatgtcgccgcaagagagtagttacccccattagcttggcttgcgctttccccactagagcgcatggacaattttgccaaacggccaacgggcaatttccccaggttaccttttgcgtttcgccaccttttgtcctgtcaacgctggcttcccaaagggggaattcggtgggagggtcttgcccatagcaaatgtggtggttgtccaacacgggaacgtctcccatcttcccatttttgcgactcctgccaggttccaaaagttgtgcccaaccagacacttcgctacagttactgaagcggaacgtaactccctttattggagttagatgcacccattttcaaattgccccaagctgaggggcgatctcccattgcgcatttacccgcaaatttaaagcctctggcctcccttatgcccacaatttgtcaaactgtttatcatatctcccaaggtctgctcctagcacatgttaactttgcccctcgtctcacatcacctctcttatcaagcccccccagagtgcatttaattccccaacgcctcctcaatatcctcccgttataatgctcacaaaatatcccccctttatcacaaatttgcctcgcgccaacctcttacacactctttctccaaccatgtccccggcgacacaactctcccgacatattaactgacattgtctgttgccccatatatgtgctgtgtctctccccctataccacacatcactactacccccctccggatttcattagtaaccctgcctatacgttgataacgcattcttccccccattttataagattttcaccaccaattctttgc

SEQ ID NO: 507019 - DNA, 945 bp, Homo sapiens
  misc_feature (13)..(13): n is a, c, g, or t
  misc_feature (28)..(28): n is a, c, g, or t
  misc_feature (33)..(33): n is a, c, g, or t
  misc_feature (59)..(59): n is a, c, g, or t
  misc_feature (71)..(71): n is a, c, g, or t
  misc_feature (79)..(79): n is a, c, g, or t
  misc_feature (83)..(83): n is a, c, g, or t
  misc_feature (121)..(121): n is a, c, g, or t
  misc_feature (129)..(129): n is a, c, g, or t
  misc_feature (195)..(195): n is a, c, g, or t
  misc_feature (249)..(249): n is a, c, g, or t
  misc_feature (340)..(340): n is a, c, g, or t
  misc_feature (410)..(410): n is a, c, g, or t
  misc_feature (414)..(414): n is a, c, g, or t
  misc_feature (435)..(435): n is a, c, g, or t
  misc_feature (453)..(453): n is a, c, g, or t
  misc_feature (459)..(459): n is a, c, g, or t
  misc_feature (473)..(473): n is a, c, g, or t
  misc_feature (481)..(481): n is a, c, g, or t
  misc_feature (483)..(484): n is a, c, g, or t
  misc_feature (502)..(502): n is a, c, g, or t
  misc_feature (639)..(639): n is a, c, g, or t
  misc_feature (667)..(667): n is a, c, g, or t
  misc_feature (685)..(685): n is a, c, g, or t
  misc_feature (694)..(694): n is a, c, g, or t
  misc_feature (748)..(748): n is a, c, g, or t
  misc_feature (773)..(773): n is a, c, g, or t
catctctgcccgnaggtgcaacccaacngcaantgatcaatattgaccagattcggaanaaactcccgganctccccantttnacccgaaaaaagcttgtccaacagtatgggatgctgcnggaacacngcttcactttgctgaacgaagtcggccaactgaagttcttccaaaatgtgataaaagaaactaggnagagccaaaaaaggtgactagttgggtcctcaacacttttctgggctatttaangcaacagaacctcgctgtcagtgagagtcctgtcacaccctctgcactcgctgagcttcttgacctgctgaacagcagcacaatttcttcntcggcagctaaacaggtgtttgagggactgtggaagagggaaggcaacactccagggcagattgtttcancaangccgcttgcactgatgcaggnccagggggcactggcgcngctctnccactctctgatgnaggcccancnncaagtgataatggatgtnaagaaaaaaaacaccagagctataaataaaatgattgggttggtccggaaagcgactaaaagccgagcagatccagtcatgataaaggagatcctggagaagaagctgtcattgtgagatgtttgggatccccttgnccaagggacaacaacaaacagtgcagcntgactgggaacaggatcntgtgaaagntgatgcccatgtgccctgagagctgcctttcaatccctgtccccaagccacagntatggcattaatgtcaccagtgttntcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgtta

SEQ ID NO: 507020 - DNA, 677 bp, Homo sapiens
agcgggcgacgacccgcggccgttgctgcccgggtactggggtctctgcctgagcgcgcaggctgccgtggactccacccgccccggagcctggtgctcgtctgtggactcgtcatggcgaccgacagagggctttccacctgctggtgtgcggcgcgtctggctgcaccggacaattcgtgaccgagaaggtggcaccggtagcatgtggacccggagcggagctcccgcctgccctggagtccatggccgggaccgactccccgtgccagaagctgtaaccgagggtgctgtcaggaagagtctggcacctgaagacttgggaaagaccaagcatgtgtcattctgcaaggttgagacatcatcaatctagtgaatattgcctaagtccagtccgtcgcttgattgacattggctttaaacaggcaactagttgtcctcaattgcgttggaccatatcggttttactggaagaaccttgtatctagaacatgcatgtattgacaaagtggtggccagttgtagtcgacatcaggttggataacctcagtgactggaactaatgcaactgaaggtactcactgagaaagctgcaagactgagaggggttaatatcattggaagacagtcggctttatgaacttccattccagcagatctgcgaagtaatatatacc

SEQ ID NO: 507021 - DNA, 109 bp, Homo sapiens
gtctggctgctggctcttgagcgcgtgaggaatggatctcctgcctgcgtgtgccgtgcggcccccgctatacatcggggagccctgctactgcatgttttcgactatg

SEQ ID NO: 507022 - DNA, 381 bp, Homo sapiens
acaaaacttgtaatccctactatcttctgtatagatacatacatctgattacaccattctcaactcctcatagatgctctactcttgtatacactgccagtatacaccttcctctccaagccatcacagctgatatctcctggtgctatccccaaaacttgtcatccctactatcttctgtctcagtcatactctgattcaccatactcaactactcatagatgctctactctggaacgtgcacttaccagagtagctgaattataagcacccaacaccacgtcgggctaatttaagtatattaagtagagacaggatttcaccatgttgcccaggctgtactccaactcctgacttcaagtgatccaaccacctcggact

SEQ ID NO: 507023 - DNA, 238 bp, Homo sapiens
cataagtaccacaaaccataccaggtgagcgtctacgctcaatctcttcttccctaggtcaaagcccatatcatcagatgtgtcacggatgggtactgattggcagaaattaatcagctaccaatgagagcccacggaactaagtagggtcccaagaaaaaaaacgggagctataacacagagctgagctactgccaaagatcatacctcaaaccttaagtagagggtaaatatgggg

SEQ ID NO: 507024 - DNA, 321 bp, Homo sapiens
atccagtgatacactgctatagctatggaagctgcagaagcgttagagggggctatactcattacaagggatatgaccttgggcgcatcccaaaatacatccgacaagcgcaaatgacttccagcgttgcctgtctttgtactttcttcattaccaccttagccgcaagtcatctgctttatcatggaccaccagtgtgcggccaatgatgcaatggtctcctgagagtgagatcacagaatcttcaataggcacatcggccacaccatctttgtcagcagtcacattgcaacacgtctcacattgcaacacggtctctca

SEQ ID NO: 507025 - DNA, 598 bp, Homo sapiens
gcgccccctactactactaaattcgcggccggtcgacgcgtgatggccgcgggctctcgagaacatgatccctggctctactggcgctgcaaggctgtgggcaaggtcatccctgagcggagcgggaagctcagtggcatggcttccgtgtccccactgccaacgtgtcagtggtggacctgagggggggtctagaaaaacgtgccagatatgatgacatcaagaaggtggtgaagcaggcgtcggaggggcgcctcaaggggatcctggggtacagtgagcgccaggtgggctcctctgacttcaacagcgagacccactcctccacgtgcgacggtgcgggtggcattggcctcaacgaccaagttttgaagctcatttcgcggtatgacaacgaattttggctaccgaaacagggtggtggaactcatgggccacatggcctgcaaggagtaagacgcctggacaacgagcccaagcaggagcacaagaggaagagagaaaacctcactgctggggagtcctgcaacagtcattccggaccacactggatctccctcctcagagttttcatgtagaccccttaaaagggaagggg

SEQ ID NO: 507026 - DNA, 170 bp, Homo sapiens
gtgggctaagtgcttatagacaagaaaaaaaaaagtgtgctagaaccaattatcatcatcatcatcttcgttcttcatcttcatcttcttcatcttcctcctcctcctcatcctcttcatcttcctcatcttcctcctcttccttcttttacttgcttttttttagcctt

SEQ ID NO: 507027 - DNA, 595 bp, Homo sapiens
gagtcagtatacacaaaagattgaaatgaatacatgcatgtatcagtaagcaaggcttaatcttcacgtagtgcttggatatcgacaaggtatccaaatgcgtgcaaggttttaaataaattgcagagaaaacagggtcttgccagcttcaattttcttgtaagtgagatccaccgacagggagcgaaagaaaactgatccatgattcctttcatattattggtctctgcattaaagtatttttttttcttcccagaatgatgacaacttaatcctgtgtgctcttgagaatgtgctgctggtcagtgcttgctgttggatagactttggccataactatggtttttcccaaaggcccgcatgctttctccagcttctggtggcaatctcacattggggacagtaaaactagaagacatgtcggtgagtccccatagccgtggcggcaggtcactaaaatactcgtggctcaaggcagcctgtgccgacagtctgttcttgggggaacatggtaggagctgggaggccaggtcctctgcatggttcacatagctgagctttttccatgcttgtctaaggttttaagagctgtaca

SEQ ID NO: 507028 - DNA, 1990 bp, Homo sapiens
agcactgtccctcggagtccgagacttccacctgggtcgtgtccaaggccccggcgactccccggactcggggtgccgggccaacctccccgccgaggcccacccgccgtcgctatggcgtgcagtttgcagaagctgtttgctgtggaagaggagtttgaagatgaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccaactgccttaacagttcccactcagcaactccactgggaagtctgtccgcaacgctccactgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaaccacctggtgcagctagtcactgctgccagccggacaccccagcagcccacccatccctccacccgagccaaaactcgccgtttccctggcccagctgggatcctgcctcaccaggcagccctgaagcagcttcctaggaacaaggtccccaacatggcggtgatgatcaagtccctgactcggagcacaatggacgccagtgtggttttcaaggaccccacggattggagtgttttctccttcacttcgaaatcactacctcaacgtgacacccaacaacctggtccatatttacagcccggattctggggatgggagcttcctcaagccatctcagcccttccccaaggattcagggagcttccagcatgatgtggctgcaaagcccgaggaaggcttcagaacagcacagaacctagaggcagaggcgtcccctgaggaagaactcccagaagcagatgacctggatggactcctgagtgagcttcctgaagacttcttctgtgggaccagtagttgagactgccccaacgcaggacaacccaccatgagcaggcagctctgggcacgtgtctggtcacatccaagggggagaagaaggccttcctttgccgttggcaccagaatccggccggagactggctctccagccaacaagaaaggcctgtcacccttgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgctt

SEQ ID NO: 507029 - DNA, 805 bp, Homo sapiens
  misc_feature (3)..(3): n is a, c, g, or t
  misc_feature (122)..(122): n is a, c, g, or t
  misc_feature (131)..(131): n is a, c, g, or t
  misc_feature (138)..(138): n is a, c, g, or t
  misc_feature (148)..(148): n is a, c, g, or t
  misc_feature (153)..(153): n is a, c, g, or t
  misc_feature (156)..(156): n is a, c, g, or t
  misc_feature (160)..(160): n is a, c, g, or t
  misc_feature (164)..(164): n is a, c, g, or t
  misc_feature (182)..(182): n is a, c, g, or t
  misc_feature (206)..(206): n is a, c, g, or t
  misc_feature (260)..(260): n is a, c, g, or t
  misc_feature (268)..(268): n is a, c, g, or t
  misc_feature (296)..(296): n is a, c, g, or t
  misc_feature (303)..(303): n is a, c, g, or t
  misc_feature (319)..(319): n is a, c, g, or t
  misc_feature (325)..(325): n is a, c, g, or t
  misc_feature (343)..(343): n is a, c, g, or t
  misc_feature (360)..(360): n is a, c, g, or t
  misc_feature (374)..(374): n is a, c, g, or t
  misc_feature (378)..(378): n is a, c, g, or t
  misc_feature (382)..(383): n is a, c, g, or t
  misc_feature (420)..(420): n is a, c, g, or t
  misc_feature (437)..(437): n is a, c, g, or t
  misc_feature (523)..(523): n is a, c, g, or t
  misc_feature (763)..(763): n is a, c, g, or t
canacttttaaaaaatgcctttttatcacaatggttcacaatggtgcatttttttttactttttattttcatttcaatagtttttggggtacaggtggtttttagttagatggataaattcnacacttganctcagcnaaaaggctgngaagnganggangganaagcgctttagtagcganttccgagattttagggcacctggnacctgagcagtatacaatgtacccaatagggagtcttttgtccctcacctcccncccaaggnccacccccccaaatccccaaagcccatnggatcantcccatgcccttgcanccccantgcgtagcccccacttanaagggacaatatacganattggggtttccantccngaannacttcacttagaataatggcatcgcagctccatccanggggcggcaaaagacantattttattcccttatatggctgaaggattccaggggggagatataccacattttccttatccacccattggtgtgaggggcactnatgtgggtttcatatctttgcaattgcctattgtgctgctataaatatgcacgtgtatttgtctttttcatataatgacttcttttccttaggtagatacccaataatgggattgctggatccaatggtagttctacacttagttctttaaggaatctccatattttttcaatagtggttgtactaatttacattcccaccagcaatgtaaaactgttcccttttcaccacatccatgcnaacatctattgtcttttgatttttaaattatcaccatttttg

SEQ ID NO: 507030 - DNA, 498 bp, Homo sapiens
ccatgtgctctgctcattaaacttttttcagctagaagtatatggacctatggggaaagtcattcatgttttgaaaaaatatctaaaggaatattaaaaccagaacttaatttatatgaagtttgattttttaaaaaatacctgaattattattgcctgccctggctagttttatatcaacttgatacaagctagagtcatttggggagagggactctgaattgagaaaatccctccatcagattggcttatgggcaaacctgtagtacatttttcttgattcatgattgatatgggagggtccagcccacagtgggtggtgtcacccctgggcaggtgatcctgggttcagtaagaaagactgagcaagccatggggagcaagccactaagtagcactcctctgtggcctctgcattaacttctgccgtgatttctctcagtgacaaactgtgatgttgaactgtaagctgaaataaaccttcttcttcccaaaaaa

SEQ ID NO: 507031 - DNA, 312 bp, Homo sapiens
ggcaccatgccagttatggaaaatattgagcccactttcgtgatcactgttcgctgtgtgtcccgagggcactaactcagagtgtcctttgactccttcatcagtgtgtcacccggccaattcgctgagctcactttctcctctctctctctctccctctccctgtctttctctttcattcttttctacctggccctggtctatcccaacataaaggcaataattcattacctcattaatggatctgtcctatttctttttaaacagttctttatgttagccatgaaatctagctggggctgtgtggtttct

SEQ ID NO: 507032 - DNA, 285 bp, Homo sapiens
cggtgttggtagagtagatggagataatgaaacagaattgataaaacctgtgaggctgagtggctaaatatctcccttttatatcaatacgaaagtctcagccaggcatggtggctcacgcctgcaatcccaacaccttgggaggtcgaggtgggtgggtcacctgaggtcaggagttcaagaccttcctggccaaatggcgaaacctcatctctactaaaaaaatacaaaatcagccgggcgtgatggtgggcacctgtaatcccagatactcaggaggctgag

SEQ ID NO: 507033 - DNA, 234 bp, Homo sapiens
cagatgtcataaggagtctgtctcttctgagctatctcatctatatttgacagtctgaataattaaaagccatttaaatttttttccttaccttttcatttgcatgtggatcaaccatcgctttattggctgagatatgcacatattgtagccaggtaatttgagagaaatatgaagaactgaggaggaacaaataaaacagaagcgaatctaaccaaaaccttcatgtgtgcc

SEQ ID NO: 507034 - DNA, 316 bp, Homo sapiens
cacgagggtggcggcagcggtggttaggggatgtaacggtcgcccgcctccggtgtgacgatggcagtcgtagggtccggaggctatgcgctgaacgatgcatgggagaaactgccctctgtcatggcgggagttccggcgcggagggagaagtcctccccgccacccgccccaccaatctgcctacggggacggatgcgactctcgaccgtctccgaagagacggtgcacaaccggatgtcactcgataaggtgcttggcatcacagcccagaacagcagtggcctaacctgtgaccccggcataggacatgtgg

SEQ ID NO: 507035 - DNA, 133 bp, Homo sapiens
cggatgtagtgcagatgtctctgcggatgataatggtcctctgcatcttcatcttggtcaccacgcccagcagaggatccgccctcgaatggaccacttaccagtgaagggacatttcttgtcaatgttcgtg

SEQ ID NO: 507036 - DNA, 343 bp, Homo sapiens
  misc_feature (2)..(2): n is a, c, g, or t
  misc_feature (67)..(67): n is a, c, g, or t
  misc_feature (109)..(109): n is a, c, g, or t
  misc_feature (115)..(115): n is a, c, g, or t
  misc_feature (118)..(118): n is a, c, g, or t
  misc_feature (162)..(162): n is a, c, g, or t
  misc_feature (274)..(274): n is a, c, g, or t
  misc_feature (290)..(290): n is a, c, g, or t
anggaccctgggcgtgattctccctccctggcacagacggagacccgagtgaccccggggtccggtngggcgtggggaatggacccatagacccgggacgagcggcggnacccangcntggccagcttcagccaccttgggagacgcatgcagctgccgctnttgacagacaagaccaaggctcggctgggcccaccccagatccggcctgagcgccttccgcgttgctcggcctcaaggcgttgagtcaccaagggcaagtcccgttgacttngtccttcagggtcttncggcctttggcacattaatctttcagaacccggtttttttggacgacgagttg

SEQ ID NO: 507037 - DNA, 348 bp, Homo sapiens
aaacctcatgggccccggaccctttattttgccctgttggtgttgaccagcccggcaaccacgctccttggcaacctgtttttttggcgggaactgcagaaggcccccctttccctggccaagggctggcagctttttttggcagcgctaacccagggtgtgttggagccccccccctacggggccctgttttttcccctgctgtccctgggcctctacccctgctggctgcttttttggaatgtgtttttttggaaataaaatttccctgtccgggttgggacaaaaactccccaaggacccccttttccctccttttggggaaataaataagtttttttttcacca

SEQ ID NO: 507038 - DNA, 234 bp, Homo sapiens
attggcccagaattttgcagattaggaaattgaggcccacaaattaagtcacttgcatcatggacagcccatctaaatgtgtgagaacaaatactccaccctgtgcacctctcctccagagcttctaaagaaattttcaaagaaattcaacaccattctaagcactcctatcatccctcagctcagccaaaccgatgctttctaagccggtactgaatttctgtgcccctttca

SEQ ID NO: 507039 - DNA, 779 bp, Homo sapiens
  misc_feature (37)..(37): n is a, c, g, or t
gtccgcgtctgcggctgcgttccccgaaagacgaggntgcgcccggattccggtccgcagggagaccgaagggcacagctccccgcgccgcgcacgccgcccgagcccggagtgcggacacccccgggatgcttgcgccccagaggacccgcgccccaagcccccaggccagccccaggcccacccggagcatgctgcctgcaggccatgaaagggcctcgagctggcgctgctggccgtcctgcatgtgctcggcgcccgctcatggccctgtggatgccaaggactgcacccatgagcacacaaactaccagaccattgcaaccccaagagcaaggtgccagccgcccgacaacggtgtgatgccagatgtccgaatcacccggatcccagcagacagccggaagcgatccaactcgggtgcacaccagatgtgtgccttcctcctgctgcactttcgctcaagacgaccactttcagcctcagacctatctgatgcggcgctccacatctaacctctgcggaatctcctaaacggtcagaccagtgggactggctgccgacaaagggattcacggcccacatcgggagcaggcaacggagccacggcacaggcccccatgggagcccatgtgccgagggagtgcatccatggcttccagacatggagggacttgaccactccctctgcggcctggggccctgaatggtctccctccattcccaacggtgccttcctgagcttgctcccccttaacccatgtggtgcccactctcca

SEQ ID NO: 507040 - DNA, 188 bp, Homo sapiens
cagtgtgacttagaggatcccccccgactagcctgacagggccccaaacagctgcgtaggctgccctggctccagacagcccggtggcccgaggacccattaagctaggcagggacggagcccctcgagttttgggcagcactggcttgaaggctgtcgggctagtcgggggggtacggagctcgaat

SEQ ID NO: 507041 - DNA, 1147 bp, Homo sapiens
actctagacgctaggacgtcgtctaccggagtagctgtgtcccacagggatccagccatagacataaggcccgctttaggtgactactcatagtcatacagacttgtgtaccaaggtacaatgccacggttggtatcaccgtgatctcgtgccagttgtaccgatgccttgttgatatgagaggactctcacgtgatggagtaacacaggtaagtgaagacgaacgaagagagcgtgtggatacttgacagtagaggctttaggagcttgcccttctcaagtgtggaaataccggtcggacacagtgcagtgacgcgtacacgcatattctgatctcaagaaaatatgtcttcatagtccctcgtagccaggaacagattatgaagacgagttcgtctgtgtaccaacgctgctcgtgacacgcgcaatcgagcacataccctatcgaagtcataagtaacgtaggtagtttgacgaaaagcacaacacattaccttctggccattgtggacgtttggaccgtataagctagtagaccaatatcacaaccacgcgtgtaacagactagcaaatcaagtatatcaacgctgcaaacctataacggacgcaccagcattggtggcagatggtccctcatcagagcaatagatggtacgatacactccaataagggatgatctctagagactggattggacgcccaacttgagattataagcaatagcgtatatacgtaagcaccatggatatccagtacagttcgtcactagatcttctgagtgttctcggtcgaacgcacatcatcaatgacaactacgaacggtacacaacgatttaaacacgctgtctcagcacacaccataagaacagcagagtcaatagaaagccagactcaataatgacaagtggaacccactagacatgcagcatcccacacgatgtccccagttaccccattccttcgcatagcgtatccgcctacagtagtggagatcgcacatacctcgctcgctactatcggcaagctatcaaaaaatatagagtcgaacattgtttagcagatagggacatacatcactaacactattatcacagtcagtataacaggcgtatcggccatcgtgaactggagatctacgaaccggag

SEQ ID NO: 507042 - DNA, 644 bp, Homo sapiens
gctacctggaatccattgttaagttaattttgtcagttccataggtctttgttatcatctcaaagtgcgtggccagtattattctatcaggagtcatacttctccaaaaacttaacaagcaataggtataaggttttaaaaagggaaaatgcaaagtaaattaataagcttagtttgtataaaagttttgagtcatggactaggcttaaaggctactacttgaataaatcaagtagtaggattgtgggaaatcctactgtgggaaatttaggtaggacttgtaaccatgtggcctgttttctccttttgtgtttatggatctcaactttcccagaggaatatacccaggtacagcatgtagtattagcaatagctacagacatctccttattagccaatagttaatattgagcaattttgtcatctaatatcttatgactggatttaatgaaagcagagagtgatcaatcattgtactggggatgatgccaaagtcacctactaggtggactaaaggatctccttgcttgggtgtggtggttcatgcctatattcctaactctttgggatcccaaggcaggaggatcacttgaggtcaggagttcaagaccagcctgggcaatatagtgagatcctgtctctac

SEQ ID NO: 507043 - DNA, 251 bp, Homo sapiens
taatctgtgatcacatttgcagccccaactcaccaacttgaaaaaaacctgagatgtcagcactaactgtcataatggttgcaagctgaagccggttggtgaaaaccttcctgagtgaattaaaatcctgactgcgggccctcgaggggaaagaagatgtgggtgaaactgggaactagccatgatttatacaggcagtgaaaagaccataacttagaatttttttttaaataaagagttttagtaatcta

SEQ ID NO: 507044 - DNA, 372 bp, Homo sapiens
gcacgagaaataaattgcattttgtgcggattgtatgagaatctttgttgctgagaagcattgataactttgaagtagtccctccagtccaacgccttggagctttctggcttgaaaggctgtttatattcatctctttcggtgggctgtcgcatgggtgaagataatgaaacattttgtaaggatgaatcagcagcgatcggcatttcatcgtcactgttgttctcatcgtcatctgtccgtcccaagatattctcctcatgttgagtagggtgttcatgactccattcgactttctcacgttctttcatctcctgtataacttctttaaccccgctctggtcgatgaaaaggcctctttcttgttgtttc

SEQ ID NO: 507045 - DNA, 896 bp, Homo sapiens
ggaactagctggcggaatcatgggggaaaggagtagcctgtggagctggactctagtgctggttcgtagctccctctcgcctactcctggtcgatctgatagagtggaggccggagtaggaacaggttggacacgagtctacactcggcttgagtggggaacatgatctccgcatccttggaagccctccgtagagctaatcattgttgcatccttatcagcgctaggcaggatgtctgctcctatctgtgagtggcgcgcgcatcgctgtatccgtcgctagcaagtgatgaagataaaatcgcctgcaataagctgttagcaaaagctcctcttgcggtcgtgaggccggatccgtaaatcacgaggaagtgccctacttctcttgcttaatactcatcggcacggccgtatgcatgatcgcgtgtcatataatagctatgctagagcagaccagtagaggctcaattagccagcctatctttcggagccctgtccggagtgggggcgaccgccatgtcgtatacacaaaaaccatagttgctggagtattgttcgggtcaggcctttgaaaagtttatgattcttattccgaccaggcttcggggataactctctcatatgtgtaatctttactagttccgtagagaaaaataagaacccatttggggatacgtagcgtatgggtccggagcttatgacttttccacggtgggctatcactacgggttatccggtggaagacggccgttatactttcccggtaggcattagacggttgacacactaacaatatttccacttccgttaccatggtatcggctgtcctccgggtcccatattaagtggtctggcccaccccgggcgcaatttcacggcttgccgggcgtgggcca

SEQ ID NO: 507046 - DNA, 626 bp, Homo sapiens
gcctgtggcttaatgacgtgggtcaccattatttcccttctttatctctttagctcggctgattccaggggtgtgtttcgtagagatgcacaccagagggaggttgctcatcggtttaaagattcgccggaagacaattctgatgcctctgcgttgagtgcctttgctcagtatctatagcagtgcgcatttgaagatcatgtatggttagtgaatgcagcatctgcatgtgcacaagcatgcgttgctgatgagtcagctgctaatcgtgacagatcacttcataccctatgtgtagacaaagtatgcacagttgcaacttttcgtgacacctatggtgccatggcagactgctgcgccacctctacggattgatcagaccagaggatgatgtgatgtgcactggtctatatgacgatgcagaggcactcttgcatccatacttagatgagactgccagacgacatccttacttagatgtccaggaacacactctctttgataatgggaatcaagctggtgttacagaatgttgccaagctgctgatgctgcctgcctgtagtcaagctcgatgaactccgccatgaagggaaggcttcgtctgccagtgactgaggggcgcgtc

SEQ ID NO: 507047 - DNA, 429 bp, Homo sapiens
tcagaggatcccgggccgggatgacgtgtcagtagtcgctgggattggagaccagcttataggatttataaagtatagtttttatccttggtgcatttcattttctcccatcttagatgaaccacggttttaaaatagtcctcttaagagatggtagatggattacaaaagggccctatttctctaccccggcctggatccatagtcttggcaatgtgacttggtttccctacctctggaatatgggtgggattcatgactggctttgaacaatagaaggtgttagaagtgatgtggaacctgcatctcaaaaagtctttcaggtttccattctttctggggaacaagcccagtgctgggccatctaacctccaacctgtttactagtggactgtagacacaagcatgaatgcatgagatgaaccagcc

SEQ ID NO: 507048 - DNA, 200 bp, Homo sapiens
gaggcggacgagggaccggctcaacgaaggttatctggtgagctgacatggcatgaaacattgatgacgatcattgtccacagtggctattgggcgggcttgccaggttgtgaccatgtctgtgtgtgtggctgttcgtccgatctctgtcttgcctccagtgctctgacatgcctccgttcttggtggtgttcttgcct

SEQ ID NO: 507049 - DNA, 487 bp, Homo sapiens
ttttgggacggaaaataattcacacatttggttacacataaaggaaaaaacaaaataaaacaaaaagcaaaaaaaaaaaaaaaaaaaaaaaaaaaaaaaaaaaaaaaacaaaaacataaaaaaaaaaaaagaggcgggggccgggttcctttgtccgggtgttgctccccgttcttcgcgtgcgaagtacggtcccgcacgccgggccggctcttttttttattagactaagccacgtggccgccctgccttgttttcataacaaataaacagggagtcgcggaggggccacgcactgctttctcgttgcgtttcgtcctgtggtgacgcgcaccacccactttggctttgtgcggtctcggtagatcatgtgcgggagactcccctcatttagcgtgagcttttctactcttcctcgtggtcagtactattttgatgctggtagtgcggtgtcgttgcgacgacccacgcagtcttgtggatcgga

SEQ ID NO: 507050 - DNA, 527 bp, Homo sapiens
  misc_feature (57)..(57): n is a, c, g, or t
  misc_feature (202)..(202): n is a, c, g, or t
agatcccccaccccggttttctggttgtcctcaccacaggtgctcttggccttcttntttctcttggcgtttcttttccccctttcacaagggggcctccccttttttttaaaattaggccccgggggttaaggggggggttgcccccccccccatcacccctcccctggagggggggccccggggttgtattttttttaanggttttttcaaaacccctttttatttttaaccccccaaaaagggggggacccccgctggggttttaaacccaggttttttgttttttttttatccccgttttggttttttttaaaaaaaaaattcccaggggctcccccattgttccccggttaattggggcctgggcccagaaaaaccctttccttcctccccccccccccccggcaggaaacagggggggggtgggtccccccccttttttatatttaatccccccggcaaaaaattttttggaaaaatttccaaggaccaggggggcccaaaaaaattttggtttcccccta

SEQ ID NO: 507051 - DNA, 449 bp, Homo sapiens
  misc_feature (57)..(57): n is a, c, g, or t
atatgtatgagtcgccactctcctgtgtccttctcagttctccccaacctccccttntccctagtttataagacaggagaaaaggagaaagcaaaaagttgaaaggaaacagaagtaagataaatagctagacgaccttggcaccaccacctggccctggtggctaaaataataataatattattaacccctgaccaaaactattggtgttatctgtaaattccagacactgtatgagaaaatactgtaaaactttttgttctgttagctgatgtatgtagcccccagtcatgtttctcacgcttacttgatctattatgactttttcatgtagaccccttagagttgctaacccttaaaagggctaagaatttctttttcggggagctcggctcttaagacacgagtctgccaatgctcccggccgaataaaaaacctcttccttctt

SEQ ID NO: 507052 - DNA, 1044 bp, Homo sapiens
cccgttgcctgggggcagattctgcttgtctcctcacttcttatggtatattgggggcttggtctcgcccaattctgggaacccttgggaccacccagtttgtatcctgagggcccggacacccaagctcacagcactggtgccctcggggttctctccagccgtgctccccaccttctctttatgtgggattgggttgaagacaggtgctgtctgtgtccggatgctcctcgccaacataccgccagagatgctttgggggtgtgcccatggcgggcccactacttggagctcaggcagccaaacgcccctgtgccacccggggcccgaggggcctgtgccggttcgccataccgcgcccaacaaatggtgctcaacacttggcccgagacccccggccagatcgcgtgaccgcggcccagcccaagttgccccggtgacacaacctgctggttccaaggttagccccggctgccacaaagcttttttcgggtccaacctgtcccccaggaaggaaggggtccgtgcctccgcaggccctgcccggccttttttccgaccctcagcgtcgtttgcacatgagtgaccacgcgcctgggtggaactttggccccggcacaacacacttggtgctcacaccacagctggttcggccttcacaggtgaacctccctccccacacggcatacctgctttccgcggtggaaagaggcacgcttttctgtccttcccacgaaggcactcccttttccctctcttgaggcacgatcggagcccctgggaggtttggaaactgccctcccagccttatggaccccggacccggtggcccggggcggcctcttggccccctgaccgctggctgagaccaggcccctggggccggggttttggggcgtggacaaggctggcagtaagtggacaaactgctcccctggctaaggccctgccctgccctcagcaccgaggtgcctggcacaagcctgcacactcctccccacattttaataaatggtcgcaaactaaacaacgaggaaaaaaaat

SEQ ID NO: 507053 - DNA, 180 bp, Homo sapiens
ggcattacactcttctggccctaataaatccattttaattcataattgccagaggaaagaagaaatatttgagtaagacgtgtagtttccctttaaagtcattttttaatccagcaaattgcaaagccaggccaggcacggtggctgacacctgtaatccccgcacgttgagaagcttga

SEQ ID NO: 507054 - DNA, 865 bp, Homo sapiens
caggagttccagaccaggctgggctcacacttgacaaagccccatctctacaaaaaaaaaaaaaaaaaaaacccaaatgtgggggcttgcttttgtagcccagctatttggcgcgcggctgaatttgggacggaatttactttgaaccccgaagaaggttggaaggcttgcaagttgaacacgaagaatctcgccctcccttgaaccctcgggttcttgggccaacagcaattagcagcaccctgtggcctgaaacattacaatctcgaatctaaattaacccctcaccctataacacagcgttgttgacattatctttgttacagttgtggaacaccccagacagttttctgtgcagcacaaacattccttatgtgcttacaatttctcatctcctgtatgtgaaattgtggcgtctcattctcatgtgttcctatacccaggccttacaacacccacgtagggcctatgtgcagcccaggtggacagggaaaacagcaagtctcaggccacacacacacatttgtgtttctccggaaaactgtggacttctcttctgtgacaggccctgtgaactctccctgtgaagacctgtgcgtgccattgtgttcacccctgtgaaaaaccccgagcctttttatctcccaacttcaggccttctctgtggccgaaactacagatgttgtggtgtgtcaacgctccttgggaactctccctgttgctctccaaaaagaggactaggcgatcttcacgcaagtttaggacacccttcccgaggtttccccgaggccctcttccttaggtgtggcccagtggggctttctacactaggggccaccgaaggcacctttttcctccccttgaa

SEQ ID NO: 507055 - DNA, 288 bp, Homo sapiens
tacgtgtctggactgggtggactggactccgtgggtgacgtggactgggctggctggactggactggactggaccggaccggactggactggactggactgtgtgacctggactgggtgacgtggactcgactgtgttgtcctcgactggactgacgttgggtcgtgctggactgcggtgtggcgtactgacactggactggactgacgtggactggactggagtgcacaaccattgtccgagacttcggaggactcctctacgacgtcgaccctgcaggcactgcaa

SEQ ID NO: 507056 - DNA, 90 bp, Homo sapiens
tatctctgtgccagcagccaggcgtcaaggactagcgaccctctagatacgcagtatttcggcccaggcacccggctgacagtgctcgag

SEQ ID NO: 507057 - DNA, 214 bp, Homo sapiens
gcacaggcggcgacatgcacacggtgctgcctggccacgggggcgctggcctcaggtttcaccggccccatgtcgctgggtgggcggcacgaaggcctggttggaggcagccaccccgaggacggtctcgaaggcagcaccagcctcatgcacaaccacggggccctcccaagccagccaggaacccttcctgacctgtcttggcctcccgact

SEQ ID NO: 507058 - DNA, 144 bp, Homo sapiens
gtcactctcatatctgcacaatgctaatctacatgactatctagaaatcgttgtcgccttaatccaagcctacgttttcacacttctagtaagcctctacctgggttaggtctacctgggttaggtctacctgggttaggtcta

SEQ ID NO: 507059 - DNA, 168 bp, Homo sapiens
agttaaaggaaacaataaagaaattactggccagtgctaacttggagaggtcacatgaaacagatttgcaaaaaggtctatgaaattatcctgctatgatttactgaagcaaagattcataaaaccacctgtaaagagctaattcctgagatagaggcagagagatga

SEQ ID NO: 507060 - DNA, 136 bp, Homo sapiens
  misc_feature (99)..(99): n is a, c, g, or t
gcatcgaggcactgaaacaccagctctgagaactctgctcatatccggggatgtggcttgtgttcacaaggaggacttacttagatcagggacatgttncttggcaataaggtgcagctgctgtccgtgctctgtg

SEQ ID NO: 507061 - DNA, 286 bp, Homo sapiens
aaaaacaccgaagcggacaatatagtactgcaacctctaagacggtaacaacatatgagaaatttagtggagggaccactctttccgagttgatgttggaaaatgaagaaaccagaccgccagactaagcctgaaacacaatttcactatgaaaaaagggtaacaaatgtcccatcagagcgagaggagttaaaaatgtggcatcgggagagtatcagattgcggtgtttgcaaacaccgcaatctgactaacattcttggcactcagagcccagggtctaccctg

SEQ ID NO: 507062 - DNA, 768 bp, Homo sapiens
tacttttccacagggcaggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagtgtggaaaagccactggcagtgattcaagtggtgtcattgatctcacaatggatgatgaagagagtggagcttcacaagaccccaaaaaactaaatcacactcctgtatcaaccatgagttcttctcagcctgtgtcacgacgcattgcacccatacaaccagcaccgcttttaaccatctgggtgccacaaggggaccatcttagacacatacatttactacctacagctccactaccgtgaatttaaaaatcggccagtactcagggacccaaggttcctttaccagggctccc

SEQ ID NO: 507063 - DNA, 139 bp, Homo sapiens
tggagtgcccacctgggagacagaccccacctccttgggtagtgacagtgaacaaaaaactgtgaacaggctgggcttctggaggtggggcgaggcagccgactgtattaaagtaacgcaataaacgcattatcaccca

SEQ ID NO: 507064 - DNA, 552 bp, Homo sapiens
  misc_feature (484)..(484): n is a, c, g, or t
  misc_feature (488)..(488): n is a, c, g, or t
tacttttccacagggcaggactttggtgactaatcaaccatctggcaatgttgaattcatttctgtgcaaagcccacctacagtgagtggtcttaccaaaaatccagtatccttgccatccttgccaaatcccactaaaccaaacaacgttccttctgtgcccagtcctagtattcaaaggaaccctactgccagtgctgcaccattgggaacaacacttgctgtgcaggctgttccaacagcacactctattgtacaagccacaaggacttctttacccacagtgggcccatcaggactctatagtccatcaactaatcgaggtcctatacagatgaaaattccaatttctgcatttagtacttcgtctgctgcagaacagaacagcaataccaccccaagaattgaaaaccagacaaacaaaacaatagatgcttctgtcagtaagaaagcagctgatagcacatcacagcatccacccaanccancagtatcaccaggaaaaactgtcaatgatgtcaacagcaataataacatgtcttacagaaatgc

SEQ ID NO: 507065 - DNA, 140 bp, Homo sapiens
ccgacggagcggtgacacggacccagcagggtcacgcgggaggagactcgtggacacccactctgctggctgccaccggtgtagcagaggggggctcggtcgccccctcccacatcagtctccagacccttgtggcttca

SEQ ID NO: 507066 - DNA, 869 bp, Homo sapiens
agctgaaattgaaaagtgtaccaatggtgcctcctgcgaatcaagtatcttatagccttaggaataagccagattgaccatattgatgaaaaggcctttgagaactgctagacttgatctgcgagctggctcattctagatcacagagccgttctacgaaaactccaagcatcaaagggagagttttcgtctagaattgaaacaactgaagaagctgcatataaaccacgaagaacctgacagagtctgtgggcccacttcccaaatctctggaggatctgcagacttacgtcataagcaagatcgactaagctgggctcttcttgaaggacttggtaatacctgaccttcatccatctccagcgacataacggctgaaagaggatgctgtttgcagctgctttgtaaacggtcttagaatcactcgaagtaccgttgacttgagcttcaatcgagatagccagactgccttcgtggtctccctgtctctcttctaactctctacttagacgacaataagatcagcaacatccctgatgagtatttcaagcgtttgaatgctattgctagtatctgcgtatatctcgacaacgaactggctgatagtggaatacctggaaagttctttgcaatgtgtcatcccctggttgagctggatctgtccttataacaaagcttagaaaagataccgacttgtcaatgagaaaccttgaaaagtatttacctggaggtcaatcaagttgaagaagtttggaccttaagagcttctgcaagatctttggagccatttatcctactccaagatccaggcatatgcgattaggattggaatcgcattccgaaaacaggtcttccaccggattttttga

SEQ ID NO: 507067 - DNA, 135 bp, Homo sapiens
tgcataggctgacagcgctccaaacagcgcatgctatggttgaccatttggaatcgtccccagggcactgtgggcctgtgattcatcatcggccaacattatcattgtctcatcctgcatccatatgcttgccag

SEQ ID NO: 507068 - DNA, 680 bp, Homo sapiens
ggggggtatagaattttaatgcaatgaaaagcaaagtaattctgcaggagacagctgtaggatgacatgtacatcgcttctgcgtccatcctacttaaacgacctagtcagcgtatttaaatcgtgtggaaccattttctggctatgcttggaaggtgctgtgcgcgggcagtgtgtgtagtgtgtagaaacgacgcgaagacgacactgactgtcacgtctacaacgtccgcacgcggacaaggaagaatcgaataacgggcacagcgcgaagtgcggacgcatgcggagaaacagcacagaactcctacccgcacccgagtgcgtagcgggagaccaggcagcccccccaacaccgcacacaccaccgagagagccaggcataacggggcgagagacacacccaacagccgagcaacatagagagacgtcaagataccgtccgccacccgggcgagaaggcagtagagaaacgaacagccaggggcgctacaccgaaacggggacgacgatgtcaaagcacaggggcacccacgcgagccgaaaacttacgtcacctaacgcggcgacaaaaccaaaagccaagtatcgccccgcacacggggcaccaactcgcgcaagcgtgggccccccccaagcggcacaacacataacacatacagggaggaacacaagcaacc

SEQ ID NO: 507069 - DNA, 519 bp, Homo sapiens
tcagtaacttcagcgtgacgccaaacaccgtcatgttgcgcgcgatctcgctgcctctgctgccgggaagcagcacaaggatgggcggcgaggcatcgcgtcgtttctgttcgtcgccgttcggccgcaacgcttcaagattttccaatagtggatggccaacataggtacagggcggaccgcccagtctgcgatgcacctccggctcgaacggcaacaccgccatcaggcgatccacataggcgcgcatcgccttggcgcggcgcggacgccagacccacacggtcggcgatacataattgacgatcggaattgacgggtcgcgcttgcgaacgcgcttggcgacgcgctgcgtaaaatccgggctgtcgatgatgaccagaatatccggccgttccctcagcacggtttcggtcgcctcccggatgcgcgccagaatcatcggcagcttcagcgggatcgcaaccagtccgatgattgccaatggctcgattggaaacagcgaggccagcccttcct

SEQ ID NO: 507070 - DNA, 155 bp, Homo sapiens
ggggtttttaaaaaaaaccccccccccccccgggggtgggtataggccgccttttttggggtcccttggttggtttttcccaaggggagggggaaaatcggggtccagggggggggttgcggggcccttcccctaaaaatgggggggggctccca

SEQ ID NO: 507071 - DNA, 363 bp, Homo sapiens
tttttttttgagacagagtcttcctttgtcaccaggctggaatgcagtggcaagatctcagctcagtgcaacctccacctcccggattcaagcgattctcccgcctcagcctcccgagtagctgggactacaggcgcgtgccaccatgcccagttaatttttgtatctttagtagagacggggtttcaccctgttggccaggatggtctccatctcttgacctcgtgatcagcccgcctcggcctcccaaagtgctgggattacaggcatgagccaccatacttggccaagtaatacctttcttaccacatctctaaatattcaaatcctatctgtctttaagacccaactcaatgttatatc

SEQ ID NO: 507072 - DNA, 186 bp, Homo sapiens
ggtcctaggcactgctttgtagagtgagcacacagtgaagtcggtttaatagtggatactaccgcctctgaaggtgatttagccagagacaattcagtgagcaagcgccaaggattcaaaacgcctcccttccatatccttgttctgcacctgccattaatatttcagaaaacatcggccgggcac

SEQ ID NO: 507073 - DNA, 112 bp, Homo sapiens
gagctacatatacaatcgagctctgtacccttgtttttataaccctgcacaatgtgcagaggtttaatgaccacaactgacctctctttccctcgtaagacataacctgcgg

SEQ ID NO: 507074 - DNA, 251 bp, Homo sapiens
ttacaggcacccgggtactggctggagagcagccgggtgggggagcatccgggcagccgagggctgagtgccacaaagcccacaggtgcaccccttccctgaagcagaggtgaggttggggggctgagtccccgacagcgttgtctcttgggtccccagactgtggcagaacctactccgtgtcagctgttgaagaccgactacgaccagtacgcgctgctgtacaagccagggcagcaagggcccctgca

SEQ ID NO: 507075 - DNA, 1190 bp, Homo sapiens
ggtacaggatgtgttgcagagtcgagggtgaggtcgccaggccctgcggtgggctgtatgtgtgttgtctggatggtgcaggtccggggtgagttcgccaggccctgcggtgagctggatgtgtggtgtctggatgctgcaggtccggggtgagttcgccaggccctcggtgagctggatatgcggtgtccccgtgtccgaatggtgcaggtccagggtgaggtcgccaggcccttggtgggctggatgtgccgtgtccggatggtgcaggtctggggtgaggtcgccaggcccttggtgagctggatgtgcggtgtccggatggtgcaggtccggggtgaggtcaccaggccctcggtgatctggatgtggcatgtccttctcgtaataacggaggtaggcatgtgtaaccaggcacgcccagcagcaagccgtcctagccgatagagtgacgacatcctgaggccacagatcaccatgccaccttgcgctgatagacgtgcgtacagtacaatcccgacgctgcctccacgcgtcctcacactcacactgtacacaggaggcacccacgttcacacaacatgcacccacggagacatacatcttacacatacccgcgaaaggcaaggttgtcattggaacgccaaaagattgaaaaagacgatatcgcgcaatccaagcacaccgccactttgcacagcacgtggctgtgccagcattgcagaggcaagcgttggtcgggggaaatgaaataagagttcaagggcagacaatcgaggacagaccatgtgaccacgaccccatgccggcaacgcgtcaccagaaacacccacggcagcacccccccggagcccgctgcacgccaacctagcgcggcccggacgagggcgcaaccacatagggaccacaacggcacgcacggagacaaccccacagcaccacggctaccacgagcaaaacgacacaagacccgggcacacagacgagcgagacacccacaacgaccgaccgggatgaaaaggcaacccggccacacaagacgaagcacacaacccacaaagaagacggcacacgagcacaaccagacccccccggcacaataccactgggacccgcccccacaggaacgcaccgaggcccccggcaacagaccacgcccacacgagcggacccggccacagcaccaagac

SEQ ID NO: 507076 - DNA, 536 bp, Homo sapiens
  misc_feature (50)..(50): n is a, c, g, or t
  misc_feature (156)..(156): n is a, c, g, or t
  misc_feature (176)..(177): n is a, c, g, or t
  misc_feature (179)..(179): n is a, c, g, or t
  misc_feature (198)..(198): n is a, c, g, or t
  misc_feature (223)..(223): n is a, c, g, or t
  misc_feature (232)..(232): n is a, c, g, or t
  misc_feature (303)..(303): n is a, c, g, or t
  misc_feature (405)..(405): n is a, c, g, or t
  misc_feature (491)..(491): n is a, c, g, or t
  misc_feature (522)..(522): n is a, c, g, or t
aggcacgagcatgttatgttgccaggttggctcatgagatcttgccttanctcccaaagtgcatgggattacagatgtgagacactgcacccaaaccccaccacatttttttttcctttttctttttttgagacagtcttactccgttgcccaggntggagtgtagtggcatgatnncnggctcacatgcaacctccncctcccagggttcaagcaattctcntgccatcgncatcccgagtagctgggattgcaggggcctgccaccacacccgactaattttcgtatttttagtagagacnggggtttctccatgttggccaggctgttcttgaactcctgacctcaggtgctccacctgcgttggcttcccagagtgctgggatgcaggagtgagcactgcnctggctgatccagcacttttcaaatgatgccgctcaaagccgtgacttggcctactttgaacagcaaacttgttgctgctgttgtnacctgaaggctctcaaatgccagcttcaagnagggtgtaattggc

SEQ ID NO: 507077 - DNA, 191 bp, Homo sapiens
cattcgtcttacaatgcacccgcaaattcactacgccttgtgaacgaggtgcactggaaatacgctgacgaaaactatttactcagggaagactctatctgaaaagccatgcagaaagagatatttgcctataaaaatatattaataacgtcttaggctgggcacggtagttcacacctgtaatcccagga

SEQ ID NO: 507078 - DNA, 147 bp, Homo sapiens
  misc_feature (16)..(16): n is a, c, g, or t
ggcccttccaaggagnacatcactctgatcagttacagatagcatgttctggaagcatctgcaggtgagtagatccagcagagttccttcccaccaactctagaaggaaagggacttatcagagttgaccctgagcctttggtaagg

SEQ ID NO: 507079 - DNA, 836 bp, Homo sapiens
  misc_feature (391)..(391): n is a, c, g, or t
  misc_feature (573)..(573): n is a, c, g, or t
  misc_feature (576)..(576): n is a, c, g, or t
agcggagggcgcagccaggctcgaccgccgcgccttaggcgggtgcggagggcgccagggacgggagggagcccgggttgccaaggcgcggagccgggctgcagtgggctagtgctggtgagcacctccaggaatttaccgcgtaggcgcggattaaacttggacgggaagaccaggactctcgggcttccgcgtccgcccggcagctagcgctccgcgggactgggaactctgcagccggtcccggtgtgattgctgccgccttgggagcagcctccggcgcggccgccgagttccaatggcccattggaaccttttgctaggttttggacgcttagcagaactttgacatcgctggaggcgtggagccctgttgcactcgaataatggnctctctttgagatgatcacgtctagggaacactggaaaatgctggattcacagtgcccctttgccttcgaaaaacttttacattggctttaagtactttatttggaggatgattctgtgatcttatctacactgttcacaaggcagcacttacacaggcccagaaccatggtcatgtaggantcnttcctggggaaacaaaagtccgctaacctggactttaggtgtatctggtgggacatggattaatagcaacacttaacgaattattgttaaggaacgattcattgccttggggcccgtacagtccttatgatatatgacaactgagagaatacggcgtggcaaaaccaacaaagtcctgcacatccagggcgaaggtactcattcaagggccctcaacattggcagacacttcccccacgggaccagtagctctgcgccac

SEQ ID NO: 507080 - DNA, 826 bp, Homo sapiens
ccttttattctctctctcttttttcttacttctttgcttgtttttatttttctctccctccctaactccctccctccatccatcctttcctcccttcctcccttgtttccttccatccattctccttccttgttttcctccttccttccttgtttttctctctctttctttccttttagggtacataatgagaatactttttccacaaaatcatttgacaataatttttctctatccgttcatgccaacatttatacagctagcttcaactgttcagttctctcatttttacatttcggaaattcgtcgtatcacttcgccccgtctcaaatctgtcccgtatatataacaactatttacatggccactgaagtcaaaatcataacaaggtgatgcattcgaccgcactcccagcttccatggtagatttcttgttcctcttttctccctgacactacaggtaacaatattctcgtcagttcacttgagctgtttcactctgtccgtcatagcagagtatgtactcgtccctatttcaatgccatactccactctcctcattctgactatcggccccatacatctcactcctcttatatcctcctgtgcaccccacccccccccccacccccccacccaccctatcgcacccccgccccccacaaaacccacaccacccccccctcggaccgagccccaacgtaacacacaggccacacggcgtccagacacacccggccaccaccagccgcactcccccaacaacccccggcccccacacctcacaccacagcgaccgcgacaacggccaccacaccccgcctat

SEQ ID NO: 507081 - DNA, 245 bp, Homo sapiens
  misc_feature (152)..(152): n is a, c, g, or t
  misc_feature (171)..(171): n is a, c, g, or t
cacgaggaaaatacaaaaattagctaggcgtgggagcgggcgtctgtaatcccagctacttgggaggctgaggcaggagaatcatttgaacccaggaggtggaagttgcagtgagctcagatcgcaccattgcactccagcctgggtaacangaatgaaactccatctcanaaaaaaagaaaaagaaaagaaagaaagaaaaccaaggtccctctccctctccctctccccacggtctccctctc

SEQ ID NO: 507082 - DNA, 304 bp, Homo sapiens
gtccggcatctagtgcagggtgtgatctcggctcatgcaactgtgtacctcccagtttcaagtgattctccgtgcttcagtctcccgagtagctgggattacaggctgggccattatgcctggctgcttgcttttgtttgtttgttggtttgtttgttttgagacgagtctcgctctgttgccaggctggagtgcaggggcatgatcttggctcactgcaacctccgactccctggttcaagcgattctcctgcctcagcctcccgagtagctgagattacaggcatttaaaaactttttaggc

SEQ ID NO: 507083 - DNA, 461 bp, Homo sapiens
  misc_feature (245)..(245): n is a, c, g, or t
aactgctcacaggtctttattcactaatggggtaacattttccctttcccaggctgcctttcactgagggttccaccgagctagtgtcctcttgtcagagggaaggtcctggtggccaggtttgcagaaggacttcatccctttctgggagttgctggtctttgttgtcagaaagaagatagggagggacacaggccatcaatactcagagctccacgatatccccagctgggaccgcagggtangtagggactgggggtatccccagcctcagcagcctgagggcttcaggaatcaggctcccgggatagcgccagagaagcagctctgggcaagggctcctgagtggtggcagggcttcgggaaaagtcacaggggggctgcagtaggggtggtcattatgtaggctgagtcgggagaaatgggtggccatgttctcctcagacaggaactgcttgtgt

SEQ ID NO: 507084 - DNA, 108 bp, Homo sapiens
gcggccgcctactactactactgctcgaattcaagcttctaacgatgtacggggacatgttaacccctccactctttctttcaataaaacgcagttgcaaacaaaaaa

SEQ ID NO: 507085 - DNA, 371 bp, Homo sapiens
tgactcactttaataacccgtctctcaaaatgagtccactagcatggtagaagcagtgaatacattcatgaggacagagccctcatgaccacttcttaaaggtatcctctcaactcttgtattcgaagattaaattttcttgtatgtttaagttctttgtagactctggatattagccctttgtcaggtggacagattgcaaaaattttctcccattctgtaggtagcctgttcactctgtatgatcgtttcttttgctgtgcagaagctctttagtttaattagattccgtttgtcaattttggctttggttgccattgcttttggtgttttagacatgaagtctgccctgcctatgtcctgaatgctat

SEQ ID NO: 507086 - DNA, 308 bp, Homo sapiens
gtcgactaaaaagcagtgaggggtggctgggcgtggtggctaatgcctgtaatcccagcattctgggaggctgacgtgggtggatcacttgaggtcatgagttaagaccagcctggccaacatggtgaaacccgtctctactaaaagtacaaaaattaactgggtgtggtggtgcacgcctgtaatcccagctatttgggaggctgagccaggagaattgcttgaacccaggaggcagaggttacagtaagccgagatcgcaccacagcctaggtcacagagcgagactccccatctaaagaaaaaaa

SEQ ID NO: 507087 - DNA, 238 bp, Homo sapiens
  misc_feature (207)..(207): n is a, c, g, or t
cctggccagattttcttttaatgaacaaacattttttttttaagagacagggtcttcttccatcgcccgggcaggagtgcagtggtgccatcatggcttgtggtagccttgagctcttgggctcaagcagtcctttcacctcagcctcccgagtagctgggactacagacgtgcaccaccatacctggttaactttttaatttaaanttttgtagagatggggtctcgttctgttgtc

SEQ ID NO: 507088 - DNA, 311 bp, Homo sapiens
agtaacaagatcaaaagcccaaaaggcctcttctacctagacccttacaaaaaccctctataaaaacaattcttgggtgaaggagaaaatactaacagaaagcacagaacatctaggaaacagagctaaaaaacactacatataaaaactaactggttatagattcaagcagcgtacagaggaaaatagtggccataagaaattatgttaattacaaaaaagaacaactaattaagtatctaactctgggatccaataataaagaataaactgtaattacagaatgccggatacaatgaaactgaaaacat

SEQ ID NO: 507089 - DNA, 102 bp, Homo sapiens
tgtgtgtagcaacaataaggaagggtccccaggttggggagagcccctagtgttgagaacaataatgaacgattattgattatgaacaagtgttaaagacag

SEQ ID NO: 507090 - DNA, 636 bp, Homo sapiens
  misc_feature (366)..(366): n is a, c, g, or t
agggtttctccatgttcgtcaggctggtctcgaattcccgacctcaggtgactgcccaccttggcctcccaaagtgctgggattacaggcatgagcaccatgcccggcctctttttttattcttgatattggttatttgtgctgtattatttcctcccccttgataatcttatcagagacttataaaacataatgggatctaaggtatatttgttttctatttcatcatatttgctcatctttaatattttctttctttaggttggttccttgagatgtatccctagctaattaatttgcagtttttcttttctaatataagcactaaaagctagcaacttctcctaggaagtctttaattgcatntgacaaatttcaatgtatgtagtactttcatgaacatccagatcaaaatgtcttctagttttatgatttatagttgagtatttatttatttagaagtgtatttcttacctttcaagcatatagcccttgcctttaaaattttacaaacgtctgtatccctaaacaatactgtaacattgtgttatcacacatggcttttaaaatctccataaatgtatgtaggtatataggatttatcctgatgtatttttagtgatgggactgtttttt

SEQ ID NO: 507091 - DNA, 206 bp, Homo sapiens
tttgtccactcttgaaggggacggtctccagaatgatgcttgctctggtgctgtggtttgaggactccaaggaagactttctgcttgcttcttgaagaggccacttactttcacagtcagcacacagtcctcaacctgctccgagaggtggtttgacaatatcacctgtatggagagtggctgtttcacaacggctgctcctagaa

SEQ ID NO: 507092 - DNA, 325 bp, Homo sapiens
agacgatcgtgatctgtgccgagggtgatctgtgtctcatcccgctaaaaggcacaaatttctggacaacaggtcacagaccaaaaactaaagtgcatcagtcaaactgaacattctatctactggcccgagatctctgggttgacacttacctaactggtgtccagttggtagacagactaaaatgcactgaaggactattaggattgctgcctcctaagttatcacagcctcgctctgttgatgtgaatgaggaactgcttggttgttaaaggagattttgctccctgctgccccaaacaggtccttatctaggtttgctccc

SEQ ID NO: 507093 - DNA, 897 bp, Homo sapiens
ggcgcattctgccattgtcacttggaagtgtttgccaccaggtctgtggtttctaataagcgcccctattttcacacccccgctgcgcgccccggttttcctgccgctccccgtgggggtgaaaaatcttttctgccacggttttcaaaaagctctctggggagccccgcgtcgtctcgcccaccggtcaccacgacctgtttgggcaacacactggcagtcggacactcgttcgggttgccggtcacatgtactccaccgacaggcccatatctcggcgttgcccgaaacaaccccccgctttctcgttgccacgccccccgctctcctcgtagtaaatgtcgtgcacgcccgccctgttttagcctgacttcgtctcgcccaccttgagtgggccccccccccaatgcaggcgtgtttcacgcctttgtccgccaggggggtcaccacattcgcagcaagcccgccaaggatgctggaccatggcaggggtctctggaacaacactcttcttgggtggaatctttgaaaaaggtaccgccttcccgggtattgggccctcccccgttgcgtggcgtgctacaacttcacccacgcggccgagtcccagtctcctctcttttcaaagctatatccccatgttccccaaaatttctggaacccccccactgcccataacactagtctagaattgccttctgcggcccaacacacatgttatttatagtcttcttctagcacccccctcgctgatgtatgaaccccctctgcactccctggagctaaagaaaatatgtccccaaattcactagtattattcaagccacaacttccacactaggcatcaaaacaaaagacaccacaaagacccacctaaaacccttcgcccacaagaca

SEQ ID NO: 507094 - DNA, 467 bp, Homo sapiens
  misc_feature (230)..(230): n is a, c, g, or t
aattgcgcaagacagaacagttcatcgcaaggtagccaaaggaaggaaatcatttgaaagactctcctcctgcagccccgcctctgccccagcgcccccagccctccgcccctccacgttctcacctgccgccgtggacccggcaggactgaggtcggaaggaggcgggcagagcggcctggtcatcttcgaaagagaagtggtcgcccagaaagtcggggcgggagaanagctgaatctggaggcagagaggggagatgaggggaaggaggacgatggagtggggccgagaacagcggggaggggaaaggtctgaaatgaggggagagacgtgagcccagcggctccctgcggagtccctgccttacctttgagacgaagtgcagatcgtgctccccgacctgaaggtagggaccgaatcgagaattagggagggtgccggcccctagccttgtcttctctaggtt

SEQ ID NO: 507095 - DNA, 537 bp, Homo sapiens
ataaactgacgtgatttcttgttctgttttgaatacacactgctctagtccttcaagaagcccatcacgtattttcaccatataatctgtaggcactttttctgcaatgttaatgtcttcactattaggatcacctttgattcagaaccgttcagctatttcaccatgggttgatgaacaactggagacccatcatcgatgttaaaaacttcaacatccacttcttccagcttactgacggactctgaaggtatattttttacatatataaggaggtcagacatcatttttttttctcacttgacatagggattccttccaagtcaccaccttgtttatcatcatcactgaacatagttgcaggccagaggttgtgctggacattcagaactgtgtctttagtcaccgtgttctagttgttggcaacagcatatggcatccttcatgctaaacttgttttggaaaccttctgtgccatgccctgttcactgctgctaacatgctattccaataaagtttttatatttactcattaaa

SEQ ID NO: 507096 - DNA, 123 bp, Homo sapiens
gcctcgaccgctctcctctcggctctttctcatgaaagagtttcttgaacctcctttttttgatttaaccaccttggtgttaattggccccgggaaaacgggccaagatttactttgggggaa

SEQ ID NO: 507097 - DNA, 1169 bp, Homo sapiens
ttttttttttgggccatatttttatttactacttttactataaacttatacaatactaatgctaccaaaaaaatatttttttttaatatttaactggtcaaaaaatgttgttatagtggtttataatacaatgggcactattgttttattatttttatttcaatattgggtttggctttatcaccttatttcaaacccatttaaccaggtgaaatgttttacttgtgtgtggattaatttaaaaatttattctatttgtgcatttatttaaccaattaaacaattctccaaacaaatttaattaagaatttaacccatgtgttcaaattatttagttatttcaaaaagatgtgggatttgtgcaagaaaattgatttattattaaaattatttgcaggccaattttcaggttttactttgtgcccaattaggatttctcacgcatttgtgcttatttttgtgggaagagaacatctttattaagaactattccttttgagattttccttgagaggggctatttaagtgtggccaacaatctcaaacgttcaaatatccagcccccaggggtttcctatgaaagcggcccctgggtattccactgagttaccactggaggagatatccctttaagagatctttagattttagcgcgcttggcctgtgttccccctctgtgttttttttcacattttttgttgtgcaacaagggagagactttttcccaagggcccattttttccaagaagttcccaaaaggagcggacaaacacgaacaaacatctaggggacacctattttcacaatattccagttctgggtgcaacccaggggtgttttttctcttaaacagatgcttaattttgctgggaattggccccataaacttttcccaggggcacacacccaaacgatattttcacatcggtggttgttcgttcggacccctttttcccgagggtatccactaccggtttccctaaccctttgcgacacttttttcgcacaaaggctgctctcgcattgtggcatttccctgtgttgttgattttaccccacgttgtgttcgttcctcttcccccgcctatcttttagcacccccccccctctgtggtgctctgtcccgcgggggccacacccatttttaccaacggtgtggtgtttaaaga

SEQ ID NO: 507098 - DNA, 1162 bp, Homo sapiens
  misc_feature (260)..(260): n is a, c, g, or t
gagtgcggaccccgcgtgaccgcacctgcgggctgaccctgcatggtggactgcggcgctgcggggcccgcccgttctcctcgtctcctggctgctgtgtcgtgccggatgagcgttgtcccacaggcaaggcaggtgtgcccctgatgaacacgagcatgcttcgtgaggtatgtgccgtggccctcgtttgggaagatgcgctgtgacgtgcgtagcgtgcacttggggcggaggcttgcggacgatcctaggatcgnctggtgactacccgtagtctggagctctacagtgctgtgatacatacttgaagaagtattcccaccaaaccttggcaccctgacggagtgcgaagggccaagtagatcaggtgcgcgtcgtagcataacctggtgctcctatccgcgcaccttgaggcgccacgaggtcgttacacttccacgcagcgtcgacttctctaccaaggggacaggctttcctatgcgtccctagagctgtgggcgaactcggggtgcctcccagggcgcgttgccttatttttgaggatgcgacccacacactcaacgtatctgcatgcgttttcccttccattttccaccgctttggaaattccgttttcattatcacctccggcttcgggtgtccgtcggagctttggattcgcctcgagtggcgtcttcggggcgcgttgggttggggattgctccgtggcgggccagaacaaaagcaggccaccggtatccaactgcctttcgtgttgctcgtagcgagttccctgcgccttgcacgaagtcgtgcaggcttgtgaggtccatcgagcctggccgcttaatagcttcgtgttaccagtaccggggcttttcgcgtggggccggattcggcgtaattgcctgcgattgggggctgctccgtcggggatcttgcccattcgtgacggtcgcttgtcgccaccgaagcgctccacgcctgtgctcctgctgtgggcgaggagtgcccaccttccggtttcctcgcgtggctttccctgttagtcctccattttgacgcgccccgggtgctgggggcccgtggggccccgacgtgcttcagcggtctaatccatggggccaaaattttctgttggctaccgattccttggggggccccaagttggtgggccgtg

SEQ ID NO: 507099 - DNA, 964 bp, Homo sapiens
tccgagaccctcccctatagttgccctgtcttcactccggcgcgaacgccgcaggtttcgcttttttctccagcgctatggaagtacgcgactgcctattctccaccctgtcgtcgtggtaacgagatcctcatccaaaggcgtgagcgtctgtattcaactatgaggaaagcgctccgaactctgttgtgtttgccttcgctggtctgggttgaaaaatgcacaactgtgtacgtggcgcttgttctgccctgacaggcacttatcatcgtcctcgcgacatgcgctacaattgctcgcccaatgccccgaggatgtggccgaaagttctgggtccacgtcgagctctagggacacgtaccactgacaatgcggacatggcttagagacaatgcgacggtccacagtagactatatagagatcaggatactccacgtccatggcccatccaagcgctagcagagtccgtagctgacaccgacaactacggtcgagacaaatggatgtacgagcccacgcaggacaggtgccacaagacagagcgtttgacaatcgagcaccaggggacatgatggcaacactgtcaccaggagcgcgcaggacagctgtcccagatgagatgctgagagatgcggcttctttggaaataaaacttcaaccaagacggatttggggaaaatttcgtacttcaaggctagaagataccctatataaagacccagtacagtgctgtggctcatgcttgtaatcccagcactcttgggaggccgaggcaggcgcatcacaaggtgcaggagatcgagaccgtcctggccaacatggtgaaatcccacgtctcatactaaaaatacaaaaattagcttggtgtggtggcacgtgcctgtaatcccagctactcaggaggctgaggcaggagagtcaccttgaagccagggaggaagagcttgcagtgatccgatggag

SEQ ID NO: 507100 - DNA, 292 bp, Homo sapiens
  misc_feature (52)..(52): n is a, c, g, or t
  misc_feature (290)..(290): n is a, c, g, or t
gcagccaagcagatggggctgtacctatgagagtgtgtcacccgtgggtgangtgtgcagtgatcagatgttgagtttggaagctcttttcctcttggtattgaatagagtcccactgtctggatgcaccccgctgacccacccactcaccgactgcagggcgtcccggttgctgccaggtgaaataggggcggggacaatccaggggacatctttcccagcatgcatgaaccagaaataacaccagcgtgttttgaggaagaaacggtgaaggaaattccaccctgggntg

SEQ ID NO: 507101 - DNA, 373 bp, Homo sapiens
gcgctagcagaatagtgactgacaccaggatggacatgagcgtgtctaactgctgtgctgcggggactaaggattttagtcaagtaaatgaacagcacgtcccaggcagcccttcactgctcgggtcacaggtgacgactccatgctgtagtgtcccaccgtaaaggtcggctctgctgccgacatccccatcaacatctcagaggcggatctcagcctgctgacggccactgtggtcccgccctcgggccgggaggagccctgtttgctgaagcggctgcgtaatggccacgtggggatttcattcgtgccccaggagacgggggagcacctggtgcatgtgaagaaaaatggccagcacgtgggcagcagc

SEQ ID NO: 507102 - DNA, 436 bp, Homo sapiens
gagactcctagtgcagccctctcggcagttacatgaagttccagacttaaacagtcttatgtatacagcatgcttcgggctggtcaggagctcactgcagtcacagctctttcacatcacacagttgcttactggttagctctgccctattcaagacaatcggttccattccttatttagacagcagtaaagagacaattggccaacaaaaccagcctgaccaacaaggtgaaaccgtcgctactaacaatgcaaaacttagctgggcatggtggcaggtgcctgtagtcccagctacttaggaggctgagacaggagaatcgcttgaacccgggaggtggaggttgcagtgagctgagatcatgctactgctctccggcctgggcgacgagcgactctctgtcttacaaacaccaaaacaaaacaccctcagcag

SEQ ID NO: 507103 - DNA, 768 bp, Homo sapiens
  misc_feature (22)..(22): n is a, c, g, or t
  misc_feature (30)..(30): n is a, c, g, or t
  misc_feature (33)..(34): n is a, c, g, or t
  misc_feature (40)..(40): n is a, c, g, or t
  misc_feature (43)..(43): n is a, c, g, or t
  misc_feature (114)..(114): n is a, c, g, or t
tattctctgtgccacgtgggangccgtganaanntgtaanatncaggattggccaagtccatcggggtgtccaacttcacccgcagccagctggagatgatcctcgacaaccanggtctcaagtacaagcctgtctgcaaccaggtggaatgtcatccttacttcaaccagagaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacct

SEQ ID NO: 507104 - DNA, 840 bp, Homo sapiens
gcacgacgccgtgacggcacgcgcgcgcgcgtcacatgagtgatctgcagctggactgtgccttggacctaatgaggcgcctgctccccagcagatcgagaaaaatctcagtgactgatcgactggtccccagtttatgtgaggatctcctgtcttctgttgagcagccactgaccaattggcagagacaaggtgatgggaactggattagcttttgtgtgatacaaagagatggggactcctataggtcaccatggcgtaacaagtatgaccctcccttggcaggatggtggccatgccgtcagcgtcggctgagaaagctggaggtggaagccaacagatgcctttgaccagtatcgagacctgtattttgaaggtggcgatctcatctgtctacctctgggatctggatcatggctttgctggagtgatcctcataaagaaggctggagatggttcaaagaagatcgaaaggctgctggggattccatccacgtggtagaagtgcaggagaaactccagctgggcggaccgcccattacacagttgacctccacggtgatgctgtggctgcggaccaaggcaaatctggctctggcacccatgaacctcggaggcggcttaccagacagatggaggaaggatgaaacctgtgccgtgaccttgtccccaaatatagtcaacatcgggcgctggttacaggaccatgggaacagtaacactcagacgtacggctgaacggcacatctacttttggaaaacgaaggatatcgtcaatgggtgaggtctgtgcgacttttgcagacaatcagcaccaagaggtctgacgattgacctgtg

SEQ ID NO: 507105 - DNA, 800 bp, Homo sapiens
  misc_feature (22)..(22): n is a, c, g, or t
  misc_feature (30)..(30): n is a, c, g, or t
  misc_feature (33)..(34): n is a, c, g, or t
  misc_feature (40)..(40): n is a, c, g, or t
  misc_feature (43)..(43): n is a, c, g, or t
  misc_feature (114)..(114): n is a, c, g, or t
tattctctgtgccacgtgggangccgtganaanntgtaanatncaggattggccaagtccatcggggtgtccaacttcacccgcagccagctggagatgatcctcgacaaccanggtctcaagtacaagcctgtctgcaaccaggtggaatgtcatccttacttcaaccagagaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcaccttaaaaaaacaacccacaacacacataacaaac

SEQ ID NO: 507106 - DNA, 168 bp, Homo sapiens
tatcagcacaacccctgacccctgagttccctagtgcacttgtctcatcctagaacacctttcttttacttgacagtagctccaattaaaaagtgagctcctgtgccacctaggcaccaagtggtgcctgctgctggattatattacagggcctcgggtggtgggcag

SEQ ID NO: 507107 - DNA, 265 bp, Homo sapiens
gcggtacatggtttgcagcgataactggtttgcagctggtactggtattgccagggtctgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaa

SEQ ID NO: 507108 - DNA, 519 bp, Homo sapiens
  misc_feature (95)..(95): n is a, c, g, or t
gtttgaacatttcactttgtgtgttttatgtgttaagttccaggcaggggaatagaattaaattattctttattttgaaaatacagatatgatanagtcacattcattaaacaaagaaacacagattctagagcagtcagaaaatgaacttcttaacatctacactagcggcagcttcctagaaatcactgcactacccgctagtaacggagtcattgccattcagagtgtgcatttttttttctctttccagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgttttttcattttgaaaaaattaaatgctctctcctaaagattcttcacct

SEQ ID NO: 507109 - DNA, 768 bp, Homo sapiens
  misc_feature (22)..(22): n is a, c, g, or t
  misc_feature (30)..(30): n is a, c, g, or t
  misc_feature (33)..(34): n is a, c, g, or t
  misc_feature (40)..(40): n is a, c, g, or t
  misc_feature (43)..(43): n is a, c, g, or t
  misc_feature (114)..(114): n is a, c, g, or t
tattctctgtgccacgtgggangccgtganaanntgtaanatncaggattggccaagtccatcggggtgtccaacttcacccgcagccagctggagatgatcctcgacaaccanggtctcaagtacaagcctgtctgcaaccaggtggaatgtcatccttacttcaaccagagaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatcttttacagtagagtgttttcggcctccctcgaaatatggtgttctcactgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaggaaagacaataattttgttttttcattttgaaaaaattaaatgctctctcctaaagattcttcacct

SEQ ID NO: 507110 - DNA, 683 bp, Homo sapiens
taaaatacagggggggggttttaaacacccagaaaaaaaatatccaaaggggtcgaaaaggcagtgaaaaaaaaagtagggtgtggactgtattttacagtggacgcagtgatatcactcgtgtgtaactaggtgggcaaaattttataaggtgacccttttcaaataaggggaattttttttacatcagatagagaaataattgtgaacagagtttaaagtaaccctacttatgagggaccgtgaaaaatatttgtggaaatagaaattttatatataataatcaaaaaaaagaacagaaagagtggaggtaattaaataagtgtgtatgcccgaagaggagtggatgcaaaaaacacacacaggggcgccactcagagcaacacacacaataggcgacgtgagcgcccacccaagaaagcagcagaggagaaaagcacggaaaatcaagacatcccaaaagcgggggcaagagaaacacataaatcacaaaaacaaggcagagcttcaaaaaaacacaccaattgtgagtggaaaacacaaaggaatgaggggagcaaatatccccaccacaggggccacagtgaggagatcacaaacaaacagacaaagaacgacaaaaggggagagacgggccgcaagaggagaagacacaccgaggggcgcaaaaagagaaagagacc

SEQ ID NO: 507111 - DNA, 138 bp, Homo sapiens
taggctagtacctacgagggctatagtaggcagatatagaagagtatagcaatcgagcgataaaaggtactgatagtacgtacggcagataggagctatagattataaactataacgcctacataagaggataagtaa

SEQ ID NO: 507112 - DNA, 906 bp, Homo sapiens
aaagatgaaggagaaagagcagagtagactgacccctaaagtcgtgaaacgccgtgtctgagtttctgcggcaatctggtttcgtcgaatctacgtggtgccaaatgcccggggggccctcccgctaaagatggctacgccctcatagtcctcgaaactttctagtgttcagggcctctaagagcctttcctgtgcccctaattggttcctctgcggggcatttcctaattcttacagtgcggtgttaatttgcacttttctagctaacagggcgcgctgaagttaatggaaacctatccagcccccctttttaatggggggctcttttctcccactccaccctgctaggcatttagagttcaacagccaacgtttgtttacagcaaaaaatactagtcatgctcaagggcctccccttccctgaattattccccccgtggaacaggtccaaccatttgagcgaaactctaacctacggggcacgacgagatggatggtgtggcggttgaaaagcgcggcgggagcacaaggtgttgttatggatgggacacacgcgcaaagtgcagacaaggttactagtaggcactcaagagagaaagactaaattatgaccacttcagtgcagagtctacaaactggagccgcatttaaatcaaacgggagaaacgggatatccagcctttcagtggctggcttcgcctctctactcccggtggttttccatctaagagatgctttccacgcacccgcccggcgtgatagaaagggcaggaacacggcggtcctctgctggccacaatatatgtaagtctccctagtggtgataatattcgctttccaaacactccaactttttaacttatgcccccggttaaaaaaaattttataaacaacccaacatgaca

SEQ ID NO: 507113 - DNA, 459 bp, Homo sapiens
agtgatgacaagccacccctttgggtagaggtataaaaaaattaatctacccttaattccagaacctgatccccaccaaggtttaggcagatcgtgttttcaaaaggatagtttcaaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttccttcgcagatgtgtatactcatgataggtcagaaagtgtatccgctacaataaagttctggttctaactaa

SEQ ID NO: 507114 - DNA, 1131 bp, Homo sapiens
gagcctgcgtgaggagctgtgcgaggagttcctggcgcacgcccgcggccggctggagaaggagctgagaaacctggatgtgcctgagctggtggccctcacctccgtgctccctgacgtgttagatgttcacctgaccatggaggcagttgtgcttctgtgtggcgtgcctctgccagtgtgtgctggcgtgcctaccaggagctgttttgcgtgcccatgggcccagcatggtgccgatgaagctggctggccttctgcccgtgcatgctgggcatgcctgctatttttgcgctggtgtggagcgtgctggctggctgcagtgatgcagggtggtgggtgacaactcacttgctggtgctgggctgctcggacctggttccacctgtgcgctttgcgtggctccctgtgggccctgctggccgctgcctgggctccgcaggacgctgccacgggaggatcgtggaactgagttggcccgcgagcgcctgggccaccaacttgcagggtctccggggcgagcttccttgggctgccttgacagactgtcccgcagggcggctggccagcacctcggcgttggctgggaacggaggggccctggcctgggacgagtttgcatggacaagtgtggtcagctccatccttgaggccaccattaagggcgtctctgggcagcaagttgcaaccttttcaccggcacaaggagggtgtccttctccaaacaaagcactacttccggggtgagttctgcagtcaggggttgtccgtgacgtgcctcatccgggggcttcgtccactctatgtgccagaagggtcagagattctgagagtggccttcggagagggggcgtgcaaaccactgggctgactgagtgacacaccgctcttgctggctcagtagacgggcacaattacgaaattacctacatctcactgtgtgtacacgagcttgagacccgacaagaccaggagagcacttatacacatcgtgtgttagccggtcacagccgggtgtgaacccaaaataaggtgaggactggaaacaaagctccaagcggtagtcaggagtaactcgacccaatgtagcactgacgagtgaaaacccaccgcagtgcttcaaaggagaca

SEQ ID NO: 507115 - DNA, 9638 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 507116 - DNA, 307 bp, Homo sapiens
caaaggcttagaagtagaatattcctggcttaagatccctgtagtaaccataaggatatataagaaaagacacagcacaggcgtgtgtaaggtaaaacatcctaaagtatagaaggaaactagctttggaaacaaagtatgtcctccacatctcttatcttctcccccattgtatctgtatagatgtaaatatctactatcgtaaacctttctttgaattcattactaccttttaaatgtaaaactcagttttaagttccagaaagtaatttttttataaaagtttggtaaaatggagtggtatctg

SEQ ID NO: 507117 - DNA, 442 bp, Homo sapiens
ccacctgtcctcccaagcatacgcatacgtttgctacctattctgacactgagccggcagtgctcattccggtttatgcaggcaagcgtgccgtgactatggctctcactgctgatcggaacgcagtgaacgctcatgcggaccggctgaacccgaggtggaactcagattgaagttactctggacgttgccgccaacggtatacttagcgtcactggtgtgaacggcactgcctgaccagagacccatgttactctgactaatgaccctgaccgtgcgaacgtggcatacttagtaggtatggaccaagaggcttgtatgaacggatctgcgaaggataagctgagggtcactgtgaactacaggaattgacttgactgctatgagttgaacatgaaagagactgacgaagatgacactatggagctgctagattatcgat

SEQ ID NO: 507118 - DNA, 776 bp, Homo sapiens
  misc_feature (19)..(19): n is a, c, g, or t
  misc_feature (705)..(705): n is a, c, g, or t
  misc_feature (756)..(756): n is a, c, g, or t
  misc_feature (761)..(761): n is a, c, g, or t
ctagaataaccactttagnagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagagaaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaacaacaggcctggcntacaagagctccagaagggaacacttaacacctttaagggaaaaccaattncaagncactggaaaaacctt

SEQ ID NO: 507119 - DNA, 9581 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 507120 - DNA, 9602 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgccccccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 507121 - DNA, 9423 bp, Homo sapiens
gcgcgagttaacaagcacaagccctggctggagcccacctaccacggcatagtcacagagaacgacaacaccgtgctcctcgaccccccactgatcgcgctggataaagatgcgcctctgcgatttgcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaactccagccggagcggggtttgtcttctctcctgttttggttttaaacctacactcccttgtttctttttgagccgagaacataaaagaacataaaaaggctttttctttcttttcatctgcctttacttctcatttcaaggtttcacagagtgctggtctcaacccacatcagtgatacttaactaacttgccttccccagacagaaacatgaaatgacttaaaaaaatagaaaatattcttctcgccaggcacacaagactgtacacccaaaaccagaaacgctgtggctttgcaaagtgtgctcccacacccgcgcacacaggcgcacttaaataaataacgcgcacgcacggctttccccatttcgaaacaggcagacggtctagtgagtttcagcacttgctgggaacaggcgtgtggccagggaggtgccccgcgggtggcaatgactactgacggacccctggtgaatcagaacagagctggcacctgagccgctgagcgggcggctacttctggctctgttgagttttggaagacctttgagaaatcaacagcatcaccgggcaggtcctgagtccatggcctgatatgttaggatcacctgtgggctgctaaaagcccacagtcctagccccatctgcagagttagttggcttctgaaggctgggagaagccctagaacctgcatttctaaagctgctcaaatccaggcctttggaggcttaagactaagcctgcaccatttcaaactaagtatagtcagagagaaagatcccagcacgccccctcgttctcacacttctggtacctcagcactctcacagcaggttcccaaaggtgatggttctggaagagttctggcctcatccttttgttaaaacctgctttcagaggtggcttagacaatggcagagtgggccgggcgcggtggctcatgcctgtaatcccagcactttgggaggctcaggcgggtggatcacctgaggtcaggagttcgagaccagcccagccaacatggtgaaacccccgtctctactaaaatacaaaaattagctgggtacggtggtgcacacctgtaatcccagctactcaggaggctgaggcagaagaatcacttgaacctgggaggcggaggttacagtgagccaagattgcaccactgcactccagcctgggcaacagaggaagaccccatctcaaaaaaaaaaaaaaagatttttgagataatggcagagtattagcttctgacctgcttttgccttcatgcgtgaccggggtgagctacatgaggcccagatctctttaacacgtcctgaggaccagcgtagattctcctttatggggctgggcctgatctccccagccgtagaggtgtggtgagtcatctattattttcttacctgcaaacaaaatcactttacagtagagaaagatgagggaattctcgtacccaagacccacttgaaaagtggagagcaagcatccctgaatctagagggtaccccggctgcctcggggagctgccagaactcagtctagggaggatacacagggtgggtcgcacgaggatcgaggcatcctgtcggacagtaggcaccaggtgaccgccaggcgccaggacccaggcagtctggcgggaggcctgggaagaaggttccctcgggaggagaacagtctttgctgggcccagatccaccagctggaagacttggggtgacaatcctcagccgagagccaggtgcagcctcggggggcccagcaccgccgctgcatgaaggaggcgtttccgtttatggctgtttagctccttaaactatttcaagtcataaataaataaccagtgtaaacaaaaggcagccatgtcggttctttcccgttaggtgcagttcaggctcttcagcccctttaggaccaatgtgcttggtccccacgacccgcagccgcctcctcttgggcccagggctgggaggagccactactgcctgttgtctttggacacgttgtgggccagccagttcactttggttttccagctctcacggagggcttcgttaaacttcactcggaagtgcttcagtgcctcctcctctgttttccccagtgccagggagtccttgagatactggatgtctttggagcagctgagctcaggcaggcctgccgcccgcatcagggcaaagaggtggaggaagagaagcccgtggcgccgcaggatggtgtaggccctttcacagtagccccggaaccgttcaaatttctcactattattagtcttcccctgctgaatcacatggacaaagtcgtaggtgaggatgaatgggacacgctcgcggttgattccaaacttggtcttgaaattccccagaaagtggccaaaatcaatgtggaacagctgcccactctctcggatcatgatgttgtcgctgtgccgatcgccaatgcccagcacatatgtggccacacaatagccagcacaggagagggtgaactcctcaatggctcgatccagggcctcccccgggttcttggacttcagccagttgagcagggcatccttgttgaaggcggctgtggctgccatgttgctcttgttgagttggatgttggcgatggtgtctgaacggagtaccacctcaatgaggcctgtgcggtccccggtggggaggcagccatagggggtcatcctcaggtccagcccctcctgcttccacaggacgtccatgagctggatcatctgcagggtcagcatgtcctgccggaggtcatccccgttcttaaagatgatgcccacgctgccgccgctgcctgcctcctcgttgctgtacatgatccacaggggcttcatcttggagtccatgaaggtgcactgctccacgcagacttcagccagcagggtgctggggtcgagtggggactgcaggtgggagagggcctctaggtaggcctcctgccgcatgcacaagtgcatcagctccttggtctggggcttgggggtcttctgagagctcagcttgacgaagtcattcagggccttcagtttgctcagtgcttccccctgcttcatcagcaccttcatgtggtgggtgctgcccctgcagtaggcctccaggatgaggccgaagcgcagggccaccgacggcacgtgcatctcggagcggaggtgccagaaaaggaagtggccgatcttgcggttggccagggcccggtccagcaggaatttggtcagctcgcagtccaggtaggactcgtacttgagcacctgcaccagctgcagcaggtactggaacagctcatcgtccgtcagtttccgcagcgacttgatggcgaaggagcctacgtggcaatcggggaagctgaagtctagcagctccagggcgctcaggacgggcagctccggccaggagcacagcaggtagagcatctgggccacatcctcatgcttgttccacttggtgaccagcagcagccgggctagcgcctccgggaagtgctcctggacttcatgccgcagcttccacaccaggtccttctcgtgctcatacagctccccagacccccgccgctccaggatttcccgcagctgcagctgctcctcctcggtgacatgcacacactcgctgtgtcgccccagctccaagatcttctccagggcggggtagtacacggggtgcggggccacctcgggcaggcagatgagcagggcagcggcgctatccgtgttggggttactgcgcacagtgcccgtggggttcagcagctcgcccttctcatctgggacggagggccacatgtagaggcagcgttccccggtcttaagctggtccttgtagtcaaacagcatgaggttggcccaggcaatggggcagtccgccttcttggacttcttcttggtggagcgagccttcttggctttctcgatcacggcgtacagcgcaaagcagagacgggccatgcggggcaggtcgcagatgttgatgtcgaactccagccgctgcttccacacgggctccgagcacacgctcacctccgagctggacaccgtcttgcacagcatctcgttgccgtggaaaagcccggcctgcaccaccagcttcatccgctcgtcggcgttcactttgctgccctggatgagctcgatgcggaacggctgctccagggaccacagggacacagaggaaggcttcttcgcaggaatgggaggtggtttggcacgcggtttctggacctggggggcagggttgctctgctcatcccgcatggcgaggatggaggaggaatggaccatggtcaggtgaggggtcaacccactgtgcaggcagctgcagatgtactggaactggcagagcgggtagctgccatacaggtactcatgcctgccgttcacctgcagcgtgtagtcttccggctgctccaccagcggctgccggaacactgtggccttcttccgcagggcacaggccatcagcgccagcggcacgtccttggtggacacctggaaggtgaagctctcctcgctgccctcaaacttaacgttgaccagaagggcccggttcgggagccgcagggtaccaggcccccaggtttgagccgagggctccagctgcagggggaaactgtactgcagccaggcctcccagcccagctgctgccggcgggcggccgcctcctcgcagaattggcacatcttggcgcgaaagtcgttcacttctgggtcgcacaaggagtcaaactcgtggaggcctttgccgatgaggaggctgatctgtgagttgatgagcttcttcacgcggtcgccctcacgggccaccaggcgcaggacgggcaggaagggctgcacgtcacacagacgccgttgctcgtcctccagctcttgctgctccgctgtctggttgatgcaggtgaacacataggcctcggggccactgagcatgtggaagagcggctcatactgggcgcggtgccacagcagctgcttgatggtgctgaggttggcattgcgggacacagggaagttcaggtagacccctgtgggcagcaggaagtcaaccacaacgctctgattctcctccttggtccagaattccatggggcagtccaccccagggggcatcctgcgttgttacttcccagatgacagttgtcctctctggaatagtccaagaaagaccagcaaagccccctccgcctggcagattaaagatgctttagaatcaatgagtgtcatcccgccctggcctgactccttatcgtcccggcgcagctggcagggctgggcggctctgctcgcggccgctcgtgccgaattcgctgggcgcgaga

SEQ ID NO: 507122 - DNA, 960 bp, Homo sapiens
ggtcttcaacgccagaggaggtgaaggaagcgctggaaggcggtgctcttctgcctgatgctgagtggacaataatgaacatcatcctggaggagggcaaggagatcctggtgggcgatgtgggtcagactgtcgatgacccctacgccaccttggtcaagatgctgccagataaggactgccggtcgtatgcctctctatgatgcaagaggctatgagaaccagagggagtagcaagaagtgcaggcatctggtgtttatcttctgggtcccccgtagctctgcgtcccctataagagcaagaatgatttatgccagactccaaggacgccatcaagaagaagctgagagggatcaagcatgaattgctaaagcaaaagtgctacgtaggagggtcacaggatcgctgtcgtgcaaccactggctagtagatagctggggtgggcagtgccgtgccatctccctggagggggcaagcctttgtgagccccttctgggccccctgcctggtgtcatctgggcaggccccagcacctgtccttgggggttgcaggctggccccttacctgcctcgtaacggagggggctggggggatcgcagtaggggggaggtgcgatccctttcacccccagtttgggccagtacatgaagcaccaaatccgctggattttttctctgtctcgccctccatgcccttggattgggcttctgggcttcccacaaggtgtttgttgatcgggaggaatgcctgcttggcgtcttgaagcagagccatcgttcccccccgagggggccccatttcgtgaggggtggctgagctcgaacttgctccccgttgcgcaacctgggcttcccccttcgcgcggcgggcccgttctcatcgctgtgagtccgcgtggcgggccatctggcgcccaggattcgcgcggtttcgcgctgtcgggggcccccttccggcg

SEQ ID NO: 507123 - DNA, 916 bp, Homo sapiens
  misc_feature (428)..(428): n is a, c, g, or t
gcgtcgagaccttgttgccatgcagcttgtccctttatatgaaattgtcatgctttacgtcagaggacgtggcatgactgcgtcttccactcgattggatagtgtggatcccgcgcagtggcttcagtgctctctacgcgcctattccgggacgccacaagatacatggaatggacacacatgtagaggatatctcgatggtctgaatctgggcacaccaagcatcgatttacggatagtagctgcgactgcaaagaagcgaagactgccgactgcagcccgtatacatcgggccgttcgcctctgctggcaccgtgtgggagcggagaaatctcttgaatgatccccgtggtcattcgatcgggaatcctgtctggaccgtatccgtgccaagacccattttggcaccatgcatatttcggtggtangggagcgaacgatgcggcaacccgaatggcctggctaggcgaccttatagtcgcctggggatggtactcgcatctcccgtcattgggaccggacatttctcatagaccgatgacttggccaaaataagtcgccgctacatgaagcacggcaacgtgcaagggatgactacgataggccgcacctggagtgcagaaggcgtcctcctatacgtttcccgaaagccagaaggcaagcagaccttctgtgccatgtgaggatcgcatcacccaaggcacggcctgtgtaggaccctccgcgtccaaacaacagaacgcgtgagatgtcatgggcgctccatcaaaacctcaggtgcgctgggtcgcagggccccccagcgcgtccagaagcaatgacttggagctcaccaacgtgtgtccacagtaaaagtagcatcccaagagcgccaaaaagaacagaccctaggggggcggggcgccctgaagaggga

SEQ ID NO: 507124 - DNA, 437 bp, Homo sapiens
  misc_feature (68)..(68): n is a, c, g, or t
  misc_feature (430)..(430): n is a, c, g, or t
gatatatatgtaccatttttcaatccatgtaaacatttagattttacctcattttaaagtcattaaanatcatcccagcaaacaaaaattttcccagaaatttttttccacaattacagttttagtctttaaacccaaaatgaaaaaatttctgccgggcatggtggctcacacctgtaatcccagcactttgggaggtcaaggtgggtggatcacctgaggtcaggagttcggagccagcctggccaacgtggtgaaaccctgtctctaccaaaaatacaaaaattagcccagcgtgatggcccacctgtagtctcagctactcgggagactgaggcagaagaatcatttgaaccccaggaggcagagattgcagtgagccgagatcacgccactgcactccagcctgggtgacagagtgagaccctgnctcaaaa

SEQ ID NO: 507125 - DNA, 800 bp, Homo sapiens
ggatgggcgtgctttccgaatccgagaaggaagccttggggggtcaggccctctatcctcatgtcctggtgaagaattgcgcagtggagttcaacttcggactagagagcagtagccctacgtgttcttgtccgtcaccgggggtttaccgttcatccgagcgacgcttccccttagttgagtcgtatccggggtcaccgtttggaccaaagagcatggcagaatgtgagattctgatgatggtgggcctgctggtgctggcaagaccacagtgggccatcaacacatgcagtcctccgagaggccttccaagaagtacaacatcctgggtaccaatgccatcatggatcagatgcgggtgatgggcctacgccggcagcggaactatgctggtgcgctgggatgtcctgatccagcaggtcaaccagtgcctcaaccggctcatccagattgctagccgcaagaagacgcaactatatcctagatcagacaaatgtttatgggtcagcccagagacgaagaaatgagaccatttgaaggcttccagctgcaaagctatcgtcattggtcccacgtgacgaggacctaaaagaccgaacaataaagcgaatcgacgaggaagggcaggatgtcccaggatcatgcggtcttagaagatgacagccaacttcacgttgccagatgttgggggacttcctggatgaggtactgtgcattgagctgcagcgggaccgaagcggacaaagctagtgaagcagcacaacgaggaaatgccggaagtctgggcaccccctgaaaag

SEQ ID NO: 507126 - DNA, 851 bp, Homo sapiens
tgggaacgccccggcaacatgggccaaactggcagggcccggagcagggcgccttcgtccacagactccctccaggggcacagttacaccacaccagcaccccctttcttggacactggggcaaagggtgtgtaggtcattacaagacaagcctggtcgtggagaagggcaagagaaatgagatgtgtggcacaggagatgtgaaactcacaagaaagggccaaaatcctccatccaggggcaagcgtgcgtgaaccaccaaaggacggccgaagaccctcgtgggagaaagtagaagaggggcacaatacccataataggtcataacactcaccaaaggagaagtgtaattcggggatagaatacctatctttctccacaattccagtgcccgagtgccaagaaatttcccagaggctctatttccaattcaagatatcgtgattccacagatgaacattcatatcgcgcatccccaattgttgcccgatcccctatacatctcgaataaacccgtctcgcaccgtggggagaacatcgtgaccgtggccccaggacaacagtgacatcaatataccaccaaaaatgtgaagataacgtgggggggacaacgtgaagagaggatccccccaatgaggagagaggtgatccataaacacccaaaagaagtgccccctcaccctttgaatgggcagagccccatccaaaaaatcccaaaaatggtgcacaacaccccgtgtggccaaggcctcagtgcccgacaacccttgaaagagataacctacaaaagtaacgtaggaatgaaccaatcaagagaggcaacccttgggtgtggaaaaatgcgaaaaaaa

SEQ ID NO: 507127 - DNA, 220 bp, Homo sapiens
ttgggccggggggggggggggggggcaattaccccttaaaaatggtttttttaccccccacccaaaagcggggaaaaccaatgggaaatggggggggggggggggggaaaaggggccccccccccccccgggggttttttgggtttttttcccttttgggattttttttcccaaccccccaaaggcccttaaaggtttataaaccccggccttttccgga

SEQ ID NO: 507128 - DNA, 452 bp, Homo sapiens
  misc_feature (1)..(1): n is a, c, g, or t
  misc_feature (3)..(3): n is a, c, g, or t
nanttcggcacaggtggaattaaaagttcctgaccttggccgggcgtggtggcttatgcggtaatcccagcactttgggaggctgaggcgggcggatcacctgaggtcagcagtttgagaccagcctggccaacatggtgaaaccttgtctctactaaaaatacagaaattagccaggcatggtggtggacacctgtagtcgtagctactcaggaggccgaggcatgagaatcacttgaagtcgagaggcggaggttgcagtgagctgagatcgcgccactgcactccagcctgggcgacagagcgagatgccatctcaaagaaaaaacaaaaagttcctgaccttttccacacaggtcctcgtggtccgcggacttccagagtggttctagctttctatttaatattcacacagtttttccttattttaagttatggcaaagggtcgtgtg

SEQ ID NO: 507129 - DNA, 322 bp, Homo sapiens
  misc_feature (144)..(144): n is a, c, g, or t
gtgacttagaggattttgacagcatcctaaccagaagacataatgtgaagcaggcctgtgcagagcagtgactcagagcctttcccggcagagggaacgcaatcaaatgctggctgctgcttcctgggaggagagaattcccanaaaggctcttgtcagccccctcttgatagggatcttgcaggggtgtgttgagagattttgtttttccagcccaggatgtgcgggagttacaaaattagacacctctaattcccttgaggttctgtgttcacactttggacgcttgttgcagatgccctatgtgctcccattattctca

SEQ ID NO: 507130 - DNA, 324 bp, Homo sapiens
ttatgagcatgtcaccatacattttctgcattaatttttgaatttatacatattgctttacatttacttaattcttgatcactgaaactttttaacatgtaccctcttaaattttgctcctgagacaaagtgttttacttgcctcagcctatcctgtggcctgagcgggcacctccttcagccttctttcctccaatctctccctcatccaggctgttttccgcaatcccacctcagccattttcccagcctgctatgatgtcaattcagtcccctcctcaaatgcactgttctgggcctcatagctctctgtccagagtccgt

SEQ ID NO: 507131 - DNA, 136 bp, Homo sapiens
tcccaagaatgaggaactgcacctggccaaggattttaaagatgagcttgagtctatatgtggataagtcccttgagataatcaagatcattgaataatcttatagtaacaccttcatccattctactaacagttc

SEQ ID NO: 507132 - DNA, 444 bp, Homo sapiens
ttatcccactattcgactcgaaaatgatgtattcgccctctgctccagagatcggagagatacgtacagggtgagacccgtgaccatgcgaaaggatgatgaggttgaggttgtacgtggacactattagggtcagccacattggcaacaatagtccgacgtttaccggacagaaatattttatctactttgaacgggtgcagcgtgaaaaggctaatggcaccactgtccacgatggcgttcaccccagcataggtagtcttaatgcagaatccttgacagaaggaaattcggcaattattgttgacatgattgtttacagagcaaggccatagaaatagtccttgattttacatgtgctggaaaaaaacattttaaagtaaatactactgcacttgtattgaaaattctaataccatttaaaatgtttctgacatcaaagtg

SEQ ID NO: 507133 - DNA, 389 bp, Homo sapiens
  misc_feature (35)..(35): n is a, c, g, or t
  misc_feature (63)..(63): n is a, c, g, or t
  misc_feature (70)..(70): n is a, c, g, or t
  misc_feature (74)..(74): n is a, c, g, or t
  misc_feature (83)..(83): n is a, c, g, or t
  misc_feature (85)..(85): n is a, c, g, or t
  misc_feature (94)..(94): n is a, c, g, or t
  misc_feature (101)..(101): n is a, c, g, or t
  misc_feature (113)..(113): n is a, c, g, or t
  misc_feature (115)..(115): n is a, c, g, or t
  misc_feature (128)..(128): n is a, c, g, or t
  misc_feature (137)..(137): n is a, c, g, or t
  misc_feature (143)..(143): n is a, c, g, or t
  misc_feature (153)..(153): n is a, c, g, or t
  misc_feature (163)..(163): n is a, c, g, or t
  misc_feature (169)..(169): n is a, c, g, or t
  misc_feature (173)..(173): n is a, c, g, or t
  misc_feature (176)..(176): n is a, c, g, or t
  misc_feature (182)..(182): n is a, c, g, or t
  misc_feature (187)..(187): n is a, c, g, or t
  misc_feature (190)..(190): n is a, c, g, or t
  misc_feature (206)..(206): n is a, c, g, or t
  misc_feature (212)..(212): n is a, c, g, or t
  misc_feature (219)..(219): n is a, c, g, or t
  misc_feature (221)..(221): n is a, c, g, or t
  misc_feature (228)..(228): n is a, c, g, or t
  misc_feature (231)..(231): n is a, c, g, or t
  misc_feature (316)..(316): n is a, c, g, or t
  misc_feature (355)..(355): n is a, c, g, or t
  misc_feature (379)..(379): n is a, c, g, or t
  misc_feature (382)..(382): n is a, c, g, or t
acaggttcgggggggtcttcaaagcagtgggcaanaaggctgctggagctgggaaggtccccnagtttgnccanaaaggtcanangggtaaatnaaaattntccctaaaaccngnccccccccttttnatcaggggngggagnacgggttcanaactggttgnttcaantggnccnttaagnttagnagnaaaagactgggttatnataacnatggctngntaaaccntcngaaggaaaggggaatgttttgggggcccccttgggttttttttttggggggggcaggtttaaggtattaggttttaaaaacaggnctttttaatgggaacaacttggcccaaaatttggcccanaatttttgggcccctttaaaaagnttnatgggga

SEQ ID NO: 507134 - DNA, 381 bp, Homo sapiens
attcaatagcattttccggctatacgcccgaaagcctgagtcgtgtcagtccacttgaacccgagaacatgctcaacatcggagcatggataaagcggatggcaaagtctcttgatttgggggtattttcagccacgccccctgcaacgaatcgcgaagcttgtacaaaatcaacgccctgctccagcgctgctataaagcgcggaatggcttctggatcatctttatcattaccatcgatggtaacgatgccctcataaccctgatcgagcgcaaaggagtaggcgcaacgaagctgtgcactaagttttcctgctgctgtcttgaccaatagcccccgcacgccaagcggcttcaactcgtgcaacttcagggaaccgt

SEQ ID NO: 507135 - DNA, 407 bp, Homo sapiens
aattttcacaatttttttctctccctttctccctctctttctccctctctctctttcttgtgttctttggctctttcttctttctctttctctcttaatctcttctcctttctctctcttatatttttctgatctctcccttcaattatttttcttatatcttttctccccctttcatctcttcttccctttcttcctccttcccttgcttcctctggccttccctccatactttatttctttctcaattgctttctcttccagtttttaatatttccctgactcactttcctttcctctttttctgttaccctctccttttcactctctctcatctccttccctttcatatctctatatctcacatagtaatgttgtgtgctaatacacagcacaacccctcgtgc

SEQ ID NO: 507136 - DNA, 266 bp, Homo sapiens
cgctctgcgagctcgctggagaccgagtcctcggctgcggagtcggcggtcactgctttcggttctggggaccgcgtcagttgcgcttctccctctagatggctgtactaggcctgggggccgtgtggtgtcgtgcgtgcgtgtagcatgatcagcttcccagtgcccgcaggtcggcaattagggtcaggagcagcaatgctattctcagcagggaaaattccacaacgtgtaggtacatgccccacagagagcagcgtcgggta

SEQ ID NO: 507137 - DNA, 392 bp, Homo sapiens
caaattttaataagtattaaagtaaaattttgtcagaaatgcgttttcagtgggatagatggggctgatttatttcaattattttatccatttctaaatattagaaaagatggggttctgcttgattctgttccttttttactttaatattgaaaagtgttgagaaacctcacttacgaatttagtagatggtcattaaaaagtgctttatattagcagtagcacccattcttctaggttgtatgcataaaacaacaaaataatccataatcaaaattattcttaatgctttgtcaggtagcaactggatttgattctcctttcattttcatggaagtggtgacaccttgatttgaaaaagaaccctgaacttaaaataaatgttaaaaaaa

SEQ ID NO: 507138 - DNA, 113 bp, Homo sapiens
gtgccaaggaaaaacgggccagaaaaatgtagatttgatgagacaagttctctccacagtggctgatgtattgaaataaaccaatagatccccaaaccaggaaaaaaaaaaaa

SEQ ID NO: 507139 - DNA, 373 bp, Homo sapiens
tatcccaggtcttagtgtctttcatgcgaggtatccaaagcatctggaatatatgcatacgttcttcataagggtgtacgccctagcaggacctctggaacgaattgcacttctcattgaaactagtaactggccgtcgtcttacattgcctaggcctctaatcatgagatctgggacaaattgactatgtcacaggttgctctccttgtaactcatacctgtctgcttcagcaactgctttgcaatgacatttatttattaattcatgccttaaaaaaataggaagggaagcttttttttttcttttttttttttttcaaccacccttgggggaaaaactttcccggggacctcaaaattccaaaaaggtgg

SEQ ID NO: 507140 - DNA, 954 bp, Homo sapiens
aatcgacaacaacctatttagctgtgccccaaacttttcctccgagccccctaacaacccccctcctaatactaactacctgactcctaccccttcacaatcatggcaagccaacgccacttatccagtgaaccacgtatcaacgaagagaagaactctagcctctctatactaatctccctacaaatctccttaattataacattcacagccacagaacgtaatcatatgtgcatatcctcgttcgagaaccacacttatccccaccttggctatcatcacccgatgaggcaaccagccagaacgcctgaacgcaggcacatacgttccgtatgctacaccctagtaggctcccttcccctactcatcgcactaagttgtgacactcagcaagaagccctaggctcactaaaccatgctactactcaagtctcactgcgccaagaactatcaaagctcctgagaccaagcaagcttaatatgactagcgttacacaatagcttttatagtaaagatacctctttacggactccacttatgactcactagagcccatgtcgaaggccccatcggtggagacaatagtacttgccgcagtactctgtgaaactaggcggctatggtatacatacgcctcacaaatgcattctcaaggcccctgaacaaacaccacatagcctaaccccttccttgggaactattcccctatggagggccttcatgcataacaagctcccatcgggcctagcgaacaaaacagaagcctacaactcggggcaatgcagtaacatcgtagacagagcaggcacaattacgcccacgtaggcaacaagcaaactcattccagagaccccctggacagcttcacaccgccggaaagaaattgagccataatcaggcacaggaaggaacatccacgcaattgacaatacggccaagcaagactcaaataa

SEQ ID NO: 507141 - DNA, 327 bp, Homo sapiens
gggatgtcccctgccctatggtcaagggtgtcctgcctgcctgggtccagggccttagggaaccccatggatccccagacttgtgttctcttggctgaaaaccctgaggtgctcccctctgtgcgtggcccctgagctgggatggtcctccaactgcccccaaggtccgcccctctgtttttgccccccctgtttgcataaaccccctttgctaccatcttgctagtgcgttttcttaaaagataatcttttttccgtaaaaataaattgggctttgccaaagccttttgaaggaaaagaaagaggattaaaaagaattgctggtga

SEQ ID NO: 507142 - DNA, 882 bp, Homo sapiens
ggatgaggtaggaggttggcacaaagtacagatcataaagaccttgctgataacacaatttgcagcaaagaagtcagctaaaatccaccgaaaccaagatgcccacgagggtgacctctggttgtcctcactgctacactcccaacagcgccatgacattttacaaattctatggcaatgtgagaaagttaccctatatggtctaaaaaggggaggcatgaataatccacccctcgtttagcatatcatcaagaaataaccataaaaatggacaaccagcagcccccaggctgctctgtctatggagtagccattcttttattctttcgctttcctattaaacttgctttcactttatgcacctgccctgagttctttcttgcgcaagatccaaaaaccttctcttgggatatggattgggaccactttccaataacaatagtactggaaatcctaaccagagcaatcaggcaagagaaaaaaaaaaagtcatccaaaccgggacacgacatatgtcaaattatgtctcttccctgatgattataatctatattagaaaatcctaaagttctaaccaaaaaggttcctaaaatggattaatgacctcatgtaaagttttcaggattacaaacatcaatgtgcacaacatccagtagcatttcctacccatcaatatgatcagccgggacccaatcaagattgacccttttacggtagtcacccaaaacaattcagtcgtggatctctctaccagggggaattctcgaagggctcccatctgcggagaccctttgccccatgggaattcccgtttggcacaaacaccttgtacgggctcccacagtgtacggtttccacaaccccgataacatcgtttgcgaa

SEQ ID NO: 507143 - DNA, 245 bp, Homo sapiens
cactatgaccagcaccgacacggggacgctcactattgcagcaccgacacggggacgctcactatatgcagcaccaacactggggcaccgatatggagactgctacacaattccagcaccgacacggggacactcactattgcagcaacgacacggggacgcacacaattccagcaccgacggggacgctcacttggtgcctgatcaatagctgaggggatccctctagatgtcgaccctgcatg

SEQ ID NO: 507144 - DNA, 379 bp, Homo sapiens
tccagatctaaactctgcaaacttgtgggaccagacttcagatctagcctagatatatgcccgtgtgcatggaaataaagactccaacggaaggagcctgtaggtgttaaatagtttacatttctatatacaaataatgtgcttacagtgccttagttacagctccctttctgtaactagtaccagggattctgtagtaagtagtgtgttccttaggtaaagtctcttttagctactgaaagggaaatggtctctaaacactggtcactgtagcaggtaaacactactctaacgtggagaaatgagcttcatgctgaggtagtgattgccttagagctgttatttatgctattgaaacttctaaaactaggggggatcc

SEQ ID NO: 507145 - DNA, 212 bp, Homo sapiens
gagagtgccccgacggacgtgaggtcatcctctgcgtgcagcgtgtgtcatctccatctgcgcgggatactggaacagtcgacctgtcagtgcatggcctgtcatatgcgcacatggaacgacgagtgacaaagtacttgtatgggcaagaatcctgacgcaccatagggcatgattaacaaagcaacctttcccttcccgccgtcatcagg

SEQ ID NO: 507146 - DNA, 152 bp, Homo sapiens
gagcctgtgtttaaggtgatttctgacgagaaatattcctcttatttatgccccttacaaactcatgtagaaaaattttgctatgtgtatatttaatacacaaatagatatgtctttatgcagtagagagtttcatttaaaataatatagga

SEQ ID NO: 507147 - DNA, 344 bp, Homo sapiens
  misc_feature (344)..(344): n is a, c, g, or t
gagagagctcgtgtcgagtgtttttttttgggatgctcagaccttatattatttcagctagtgaccaggtcaaaacttcggtatcttactctggtataacctagccaggcctttataattttttctctaccttccttttttcttctgggttgacatttttaggtcagattattaggttttattggacattagcagagtgatgaaaaacagattttttaaaactattcttcagaaattgagtagcgggctgttggcactgtgtatgactgagaactgtgcatacatattactcactgtgggtaatattgagcttccccagacatagatttcactttggtttttcn

SEQ ID NO: 507148 - DNA, 258 bp, Homo sapiens
tgaatcatgacagacaagatgctatccatgcagcctctgcctcggtgcaccctcatcattgaccccctggctgcggggtctcaccttacccggatccccatagccagctggaactctcacactaaccccctgattcctcaccctctgcacgagaacgaagttcttcgtcaccagatctttgctgccccttaccgggacctgccggcctccctttctgccccgagtgtcagcagatcatcagactgcaggccatgcacg

SEQ ID NO: 507149 - DNA, 218 bp, Homo sapiens
ccaccgctggagatccttctgcatttcgcatcagacctgtgtcactgtgtggaagtgctctttcccccacctgtagtaagctggaaaccccaccgtccaagttgggagagcttctgtttccaagttctttggttggagagactctgggaagtttttcaggaatgcgggttggccaatgcagttgattctacaaaacaaacctacccacccttgacgga

SEQ ID NO: 507150 - DNA, 942 bp, Homo sapiens
taaaaggggacgacatttattccttttccaaatgttacagtaaaaccaggtggaagaaaagtggtttagcagttagaaaaaaaaaaaagttacaaattcgtggggtttgggccattaaaaagtttatggacaacacattaaaaaaaaaaaaaaaaaaaaaaaaaaaaaaaaaaaaaaaaaaaaaaaagaaggggggggcgcgccaaagaaaaatccccgcgcggagggggccacacaagctaaagcgcgcgcacccgaggttgttagggaaacagagggggcccccaataaggggggcgatatataataagccgggcgagcgggggcgggggtcttaaacacacgcgggtccgcgaggggaaaacaacggccaacgacgggggaaaccctggtgaggagaaagagaccacctacatcgagtgagggggagggcgcaacaatagtggcggcgaacaacacctcctcacagagacaaaatatatataaaaagcgctctaaatagggggagaaataatatataaaaattcttagaggaggtgtgaataatcaggtgtgttggtaaaaaaagaagcgagagaaaaactcaagtgggtcgcagtggtatgaagaaaaattgtcgacgacatcctcgggagagatatgtagataatatgagagccaaaacatttattatcaccgccggggggggaccatcgtctgctatacaacacaacaaagacgaagcaacagagtaagaggacaataaaacgaaggggcgagaacagagagagagggaaacggagacgcgaggaggggagcgaggagagaagggagaggaggggggggaacaggaaggaggaagagagagaggagggagcggggagagaggggggaaagggagagaggagccacaaaaaacgaaggccgaacaaacgagaagccgacgagcaggaaaggcgcggg

SEQ ID NO: 507151 - DNA, 327 bp, Homo sapiens
  misc_feature (10)..(11): n is a, c, g, or t
  misc_feature (33)..(33): n is a, c, g, or t
  misc_feature (36)..(36): n is a, c, g, or t
  misc_feature (123)..(123): n is a, c, g, or t
  misc_feature (139)..(139): n is a, c, g, or t
  misc_feature (145)..(145): n is a, c, g, or t
  misc_feature (152)..(152): n is a, c, g, or t
  misc_feature (156)..(156): n is a, c, g, or t
  misc_feature (158)..(158): n is a, c, g, or t
  misc_feature (161)..(161): n is a, c, g, or t
  misc_feature (175)..(176): n is a, c, g, or t
  misc_feature (181)..(181): n is a, c, g, or t
  misc_feature (188)..(188): n is a, c, g, or t
  misc_feature (195)..(197): n is a, c, g, or t
  misc_feature (220)..(220): n is a, c, g, or t
  misc_feature (238)..(238): n is a, c, g, or t
  misc_feature (300)..(300): n is a, c, g, or t
  misc_feature (314)..(314): n is a, c, g, or t
atacatacanncgcgtatatacatacgcatgtntgngtacacatatgcgtatgtgtacacgcacatatacgcatgcacgtatatatgtgtatacacacatgcatacatgtatatacgcgcgtntacatatatatacgcntgcgcntacgcangcananacnaagcacgcgtgcgnncacgngcacacncatgcannntacgtatacatgtacgtgcgcgnatgcacacacacacgcgngcatgcgcatacgcgtatatgtgcacgtatgtatgcatatacgcatgtgtatgcacgtatgnacacacgtgcacgnacacatgcacgta

SEQ ID NO: 507152 - DNA, 204 bp, Homo sapiens
ctctagaggatgcctcgaatcgacggtttctcggaagtaattccacgtgccagaccttggtcaaatggtttcccacagcagactggaaaatctgaggatacgagagctgacagaagatggcttcaaaacaggaagccacactttcccaaaagaccaagaaatcttctattggtaatgaagttggagaaaatgacaggctctttg

SEQ ID NO: 507153 - DNA, 167 bp, Homo sapiens
gtgttctaacattagcttccattctggcagctggctacaagatgggtaaagacctactttttatactacttccatatttgactggtgcctggaggcttgagcatactcggaaaatgaattaggttgtttgcagtccccagcttgtgttcacatcgttcagcgtctga

SEQ ID NO: 507154 - DNA, 415 bp, Homo sapiens
  misc_feature (311)..(311): n is a, c, g, or t
ttattaaggaaatcataaggaagagaaaatatatttactgtttattaagtggaagttggtcacatcaccgtaatggttttcatccttatcttcttcccattgagtaggcttagggggtaggaggaagaggacggttggtcttgttatttcagggatggccaaggaggaagaaaatttgcctgtaagtggatctggacagttcacactggtggtattctcagctgtaaatggaattaactcttgacacatggataaacctcgcattatgctaaacgaaagaagccagacacatacagagacaggcacattantggctgtgtagggtagagctgggcatgaagattaattgcagtgagcatgagggagctggcatgttggcaagcatcagttcccagctacatcggagactgaggcg

SEQ ID NO: 507155 - DNA, 138 bp, Homo sapiens
ggtgttctgagtaatcgttagcgttttaggcgtacgggcacggactatatggttgaactgacgtacggctgactggtttcgactaactaacctacgtactggggactaccggggtgtacggtcgtgcctatgttggta

SEQ ID NO: 507156 - DNA, 123 bp, Homo sapiens
tacttgacctgagtccctcacacggagcccagtggccccatgatattaatgacccaggaaacttcgtttctctgctctcaacatagtaggaactcggtcagagtgtggggtacctgagctcga

SEQ ID NO: 507157 - DNA, 958 bp, Homo sapiens
  misc_feature (681)..(681): n is a, c, g, or t
ggactgtctcagtggagctggagtcatctcaggactcatgaggtccttgaacatttagatcggcatgtgcattcactcgaaggtgctctctgatgacatgaagaagctgagggcccgaatgcagctaggccatagtaaagattttactagataaagatgcaagatatgactagatactacttacgcgtacggtgtgactggttgatgtcgagcctggcagaagctggaggactgactgtcgaagagggttatctggatacagtggtggctgattatgaggagcatcatcactagagctcacatccgtcgtacattgaaaaagaatacgagatggatccacgagatagtccagagggcaacacgatcaccacgtgctggcaggatgtagaagagactcccgacaaaccggagagatgaccattggagagcagagtcgttatcagttcgaacgaaaggtccaatggaggaatgagtattcccaagggctcgagtagactcgtcgagacgagacttcgacaaggacccatgtgctagtgcaacggggagatcccgtagagatcatgggagttgagagggagaaaaggctgggttgggcccacgtgtgtatgggcaagtgccaagcctggcaagggtctcacgtgcatgggtcaaagagcagcgtttacgcagtaaagtgtatcntggtgcgtgaatgcttactgggtcaagcaagtgcgtacgttatcattgagtcccgtactgtctacgcagtgtttccgttaccgcgaagggcgccaaaagcgggggggggaacaacagggcaagcgaaagctaggactagtcgccaacggaacaagtagctgcttgaaacccccgcaaaatcccttcgaaagatggaaacggatcacttgtagggactcagccctttcggcacctgccccgcagtcacaccagggaccacccagaagcacctggaagc

SEQ ID NO: 507158 - DNA, 173 bp, Homo sapiens
tgctggggatgagtgtgtgagtgtgcgtgtgagtgtgcacgtgtgtgcatgtgtgtgtgcgcttgcgtgtgtgtgtgtgcatgagagtggatgtgtgtgcgcgtgcatgtgagtgttcattaatgtgcatgtgtgagtgtgtgtgcatgcgtgtgtgtgtatgagtgtgtaga

SEQ ID NO: 507159 - DNA, 529 bp, Homo sapiens
cagctgtacggtcgaatcttggatcgcggagtcggccgcaggcagacatgtgacctggtgagctggtggcttaacagcaggctggtggctggaacgcggtgcccagatgtcagttctgccctgtggctgctgcctggaccccggagagcagctacagctgctgccgtccccttctggacaaatggcccacaacatctgagcaggcatctgtggtggccccttgcccaggtttgattgcccacatgcgcgtcttggctcggggcgcaatccttctacagttgccagagttcttttttataacccgcgtggggtttcctttcctaggggcgggggaacccttttttccccctaatgggtttttttgggcgcgtttagggccccccccccccggtttttttccccccccccaaaagggaaaaggcgtggcgcccccctgtgggttttgggcggcggcccaaatttttgtgccccgtggggaggggcggcggggagaatttttgggggcccccccaataattttcccgaaggg

SEQ ID NO: 507160 - DNA, 780 bp, Homo sapiens
gccatttccaaatccctcgtcggggaaagcccatcaagtcggccagcctcgtgattcccaacaaccccgacctctgatccgtgtacttcccacttcgtaacaggaaaatctcccctgttcgttgcgtcgaacttctccgtgtactcgtgatgcacctgatctttggtccatccgtgggtatccatgctatgtcactacaatcactgcttgtgaagcctgccaatcgggtgcctttcctgggtggctagaacttcaggcttcagcctcgaatttccacagacgaagtactttctcttcttgtctgcaggcccaagatggaaactcgtgtttcagaagtcttgcatgcctgtagtgtgccagggccctacctgggccacaccacgaagagcatatgtgcgcaggtgccagcggtgtttgggctgtcgggtgcacacaaagcaagcaccatctgggattggcacagctggcagagccagtgtgatggggtatgtgttgcacttcccagggagaaaacctgtcagaacgtgtgccactacgaggatactcagaacacacccttcccaacggtactgtatgctctagttgttcctgtcctgtcttcactgagcgacaggggcggagaggcctgtcagacattatccttggtcctcgttcagactgcccactgtagtatccacagtgcccgcgttatcgctggttttggcaacctaaaccgtaccttcctaccctggtttagactacacgttacaaacaaggaaaatggcccctcgtgtgaccata

SEQ ID NO: 507161 - DNA, 826 bp, Homo sapiens
ttggggtccacccccacctggctgtggggggtgcgccaccccacacatcacatggtgggtgcggccgccccccgccctcacgtgcctgggccttctcactcctctccgatgagcagagagactccacttcgtgtggtgggcgcgcgcgcgcgtctctctctctctcacacacagtagcatgggtgcgcgccgccggccgtcgcttcgcctcacctgttctctctctctctttggttgtgcgacccacatcagagcagagcgcagggcgcgcgctactactctctctcctcgcggcgttcgtctctccgtccgcgccctcccgctcgcccgcccgcggcgctgagcagagagagcagaactctccccccccccgctcacactcttatactgtctttctctctctctctccagctgacagcatcccatctctgccccccccccctccccccgccagcagcagagcagagcactctctctctctctctctgctatgatatgacaagtattctatggtgcgcccccccccgctccgccgcgcgcgcgaccggggggcctctttcattctcccctctccccgcgcgcgtctcttttcagaaagaagagagaggaactcgtcgttgttctctcctcctccggcggaagacgaaaaaaattcttttcctcctcctcctttctgtttgtctcttcttggttgctccgccctccccccccctcgtttgttcgtcgtggctcccgcgccgctcctccttccccaccacgactgccccccccgcccgcgggggttggtgaagaaaaaaaaaaacccccccccgggggggtggtccca

SEQ ID NO: 507162 - DNA, 285 bp, Homo sapiens
gtggccccactgatcccttatccactcatcactaaggagggtataaatgctatagaaatggaagaagaccaaagagacctgatatctcgagagatcagcaaattcaagacacataattgtcagatacactctcggtgaaatgaaggaaaaaatgttaagggcagccagagagaaaggtcgggttacctacaaagggaagaccatcagactaacagcggaactctcggcagaaaccctacaagccagaagagagtgggtgccaatattcaacattcttaaagaaaa

SEQ ID NO: 507163 - DNA, 443 bp, Homo sapiens
tacccacccagtggtctgttaagatgtctcagatggggctgggcttggtggctcatgcctgtactctcaacactttgggaagcaaaggcaggcagatcacaaggtcaggagttcagcctaaccaacatggtgaaaccgtgtctctactaaaaatacaaaaattagccaggcgtggtggtgcacacctgtaatcccagcactttgggaggccgaggcagacgggtcacttgaggccaggagttcgagaccagcctgggcaatatggcgagactccgtctctactacaaatacaaaagttagcctggcatggtggcgcatgcctgtaatctcagttactcaggaggctgaggcaggagcatcacttcaacccaggaggcagaagctgcagtcagccgaggtggcaccactgcccttcagcctgggcaagactggagactgacatc

SEQ ID NO: 507164 - DNA, 987 bp, Homo sapiens
cgtgttggtgctcactggtgcggccaacagcggtgcctgcaggtgtggcgccggttgtgccccccgccctcgggggggacgctcgtcgctgccgtcgggggtgagctagttttgtcgctggcgacgcggctttaccagcacggcaggttgtgtgcgggtcgtgtcttagttgccgccccgcccgatgagagtgtgctccgtttatggtgggccggtggctggcacacctttgtttgctctggcgattcgtggctccggcggtatcgactgccccgtggggcgtttgacgtgggtcgtctgctccctgcgatgatggtctctaagcggccgtgcggttgagggggcccctcggcttgttgtttgcgccggggcgccgtgccgacatgagtgcccgcgcggtagtgtgaatgcaaggttgggggcgtttaacccccccggtcggcccgctgtgatgagtcggccccggggggcccccggggaatgatagatgggtcctggctaccgcacgtccctcttctgttgcgtagtcatgcatgcgcccccgcgtgcggttttattacccgcgctcgcgagggaagcccccgttctgtctggtgagggtacgctctcggtgacagctccacctctctctctcattgagcaggggcgtgaaggtaacgccttactcctacaccacagtacggtggggggatccgactcgcgggccgaccgatcctcgccgcgaggctgtgtggggtgcgccccggcgtggggtgctgcgggcggacaactactgtttcggggaaggtgcaaccttctcaggcaggcagttgtagaggacctctctcttgagccccggcgacagtatgtttagcaggccccccttcgcagaagtcataggggcgttgcggacgaaagagcttgcgcgccccccccaaagggaccgttcttcattcccccccaacccctggccccaagggaaaaaaacattttgaaaccaacaaaaaa

SEQ ID NO: 507165 - DNA, 1497 bp, Homo sapiens
gagcgtgcgctagaagctattcgatgatggcgcgaggccacagtgatggttagtgtggctgactgtgtcgtagcttgcctgacttaaagagactcctaggtcagtgacctaggtgggttgcgctcactctagtgagctatacatagcgcgcaacggatggacaaagcggacacgtgatagatggcacatcgcaggatgggagagtcctggaagtgacacaggtaaacctgggattgataatgtcaaacacgtttggaaatgccaaaggcgggaacgcattacggacgtaggcatggaagttggaaaggctcacccctgtgcaccatgtgtggtgggctggacaacattccatcacaggaaagtgttcagtgcacacccacgtggaacggaagcagcagaacataagtaaagacacagcgtatacactaaagtaaagccaccatacaaaaaacacagaacgaaggggaccgaataaaacaccaaaaaaagacaaaaaacgacgtgagaatggaataaacaaataacaaccattagcgaaaaacaaagaagcaagagacccaaaaggaaaacaagcagagaaaagacgagaccaaagaggaccaagaaaaaaaacagagcaaaagacatatggatgagcatggaacagaaaacagagagataggggaccacaacaacgatatcacagtacaacgtggccgatagagagaaacaacgtagatatcaggacaaacgaacaggacaacccagagaccacccaattagagacaatatcacggcggacacaagaccacaccccaagacggtagacacaaacagacaatgacaaaacgatgaggggacgcaccagagagggcgaacgacacgacaaaggaaataacgaccacaggaaaagtcacacaacactaagagacgtaggaaccaagcggatgaacaacgagacgaggagagaacaacagcaaacaacagagcagtcggagacaataacgacacaccacaaatagggacgaacacacacaaaacgagacagacggagacaagagaaaaacaaactatatgagcgagaactagagcaaaagaaaaggagaaagaaaaccacaacacagagggcaagacgacgaaggaagggacatcgcagcagtgatgcacacaaacccacacagacagacggcacataacacaaggggacgccccaccaataatccgagcacaaataacaacaacagggaccacaccacaagaagaaagagacacaaccacattaaagacagagcgagcatgaagagcagaaaagagagacgaaagaacacgaagaacaaagagcagacgcagagcggagtaagacagcccacagaagaaagggcaaagagcagaccgcaccacccgacacaaacaacaaccactagtgaggcagacaaacaaaaggtcaccagaaagaaacagaccaaagtaggagagaagaacaaacaacaacatggagcacgaaaaagtgaccacgaa

SEQ ID NO: 507166 - DNA, 926 bp, Homo sapiens
  misc_feature (4)..(4): n is a, c, g, or t
  misc_feature (69)..(69): n is a, c, g, or t
  misc_feature (82)..(82): n is a, c, g, or t
  misc_feature (122)..(122): n is a, c, g, or t
  misc_feature (165)..(165): n is a, c, g, or t
  misc_feature (221)..(221): n is a, c, g, or t
  misc_feature (238)..(238): n is a, c, g, or t
  misc_feature (272)..(272): n is a, c, g, or t
  misc_feature (311)..(311): n is a, c, g, or t
  misc_feature (354)..(354): n is a, c, g, or t
  misc_feature (375)..(375): n is a, c, g, or t
  misc_feature (402)..(402): n is a, c, g, or t
  misc_feature (420)..(420): n is a, c, g, or t
  misc_feature (425)..(425): n is a, c, g, or t
  misc_feature (428)..(428): n is a, c, g, or t
  misc_feature (435)..(436): n is a, c, g, or t
  misc_feature (457)..(457): n is a, c, g, or t
  misc_feature (500)..(500): n is a, c, g, or t
  misc_feature (525)..(526): n is a, c, g, or t
  misc_feature (553)..(553): n is a, c, g, or t
  misc_feature (567)..(567): n is a, c, g, or t
  misc_feature (577)..(577): n is a, c, g, or t
  misc_feature (585)..(586): n is a, c, g, or t
  misc_feature (594)..(594): n is a, c, g, or t
  misc_feature (607)..(607): n is a, c, g, or t
  misc_feature (612)..(612): n is a, c, g, or t
  misc_feature (682)..(684): n is a, c, g, or t
  misc_feature (729)..(729): n is a, c, g, or t
  misc_feature (743)..(744): n is a, c, g, or t
  misc_feature (749)..(749): n is a, c, g, or t
  misc_feature (751)..(751): n is a, c, g, or t
  misc_feature (757)..(757): n is a, c, g, or t
  misc_feature (761)..(762): n is a, c, g, or t
  misc_feature (768)..(768): n is a, c, g, or t
  misc_feature (774)..(774): n is a, c, g, or t
  misc_feature (789)..(789): n is a, c, g, or t
  misc_feature (806)..(807): n is a, c, g, or t
  misc_feature (814)..(815): n is a, c, g, or t
  misc_feature (902)..(902): n is a, c, g, or t
aganttgaagtgggtgtgtgatgggttacgggaggatttgggtaggaggaagagacagatgatggggtntggatttataagntgagggattaagagtgaatttgagattagtataaataganttaaactattggagaaaaagaaaagggaaatggaacagaaagnaaggaaggagattgatgaatatatggctgatgggaaagatgaaggagctcggatcngtgtggaggacattatnagggaagaatacatcgtggaggggatggagatcntggagctgtactgtgagctgatgctggctcggtttggcnttatccagtctatgaaggaactagattctggtctggctgaatntgtgtatacattgatctgggntgctcctcgactccagtcagaagtggntgagttgaaaatagttgntgatnagntctgtgnnaagtatagcaaggaatatggnaagctatgtaggaccaaccagattggaactgtgaatgacaggntaatgcacaagctgagtgtggaagnnccacccaaaatcctggtggagagatanctgattgaaattgnaaagaattanaacgtacnntatgaacntgactctgtggtnatggnagaagctcctcctggggtagagacagatcttattgatgttggattcacagatgatgtgaagaaaggaggnnntggaagaggagggagtggtggcttcacagcaccagttggtggacntgatggaacggtgnnaatgngnatgcgnatgnncatgcntatgcnatctgcaaatacgcntttctcatatccactgnnaaagggnncagtagatgacattaatgctgataagaatatctcttctgcacagattgttggtcctggaccaagccagaagcctctgcaaagcttcnttccagacctgcagataactatga

SEQ ID NO: 507167 - DNA, 363 bp, Homo sapiens
tggatcaagtgctttgcacacaagtgtgaagactgatgctcctaggacccatgtaaaagctaggcaggcacggccgccccttgtaattctacaacattggaggtagagaaatgctagctggctagagtagctgtattggcaggctctgggctcagtgagagatactgcctcagtaattaaagtggagaacaatgggaggcgatactggactgcaatcattctgtccacatgcacattcgtgtgtgtgtgtgtgtgtgtgtgtgtgtgtgtgtgtgtgtgctcgctcgcttgccaggtcttgccccaaatgacacatatccaactgaccccagaccagcccacaaatgagcaagccgtcgacgc

SEQ ID NO: 507168 - DNA, 498 bp, Homo sapiens
tcctgccacaccacatgtgagctcaaagctgattctcctccagtaagaccctgaaatgactctgtcccccgtggacaccttaaatacagcccttcagagggcctgagctgggggcccagctaagccacacagaaactggataaaaaacgttttctggccaggcacggtggctcacacctgtgatcccagcactttgggaggccgaggcaggtggatcacaaagtcaggagttggagaccagcctgaccgacatagtgaaaccccgtctctactaaaaatacaaaaattagccaggtatggtggtgcacgcctgcaatcccagctactcaggaggccgaggcaggagaatcgtccgaacccgggagacagaggctgcagtgagcccagactctgccactgcactccagcctgggtgacagagagagactccatctcaaaaaataaaaacaaacaaatgaaaggtttaagaccttctttgaacctgactgccttactttc

SEQ ID NO: 507169 - DNA, 492 bp, Homo sapiens
  misc_feature (431)..(431): n is a, c, g, or t
  misc_feature (437)..(437): n is a, c, g, or t
agagctgcgtaagatgaatgccagaggatttgtatcttttctaaaggacagcattccagttactgagctttgagtaagtgcaccttttgcccgccatgatcctccctcggaacggttttttttgtctccaatctgacctgtggcctagccatccccttgacttatcagcaaatcttttccagttcaaccaccatccactcactttctccacactgcgacccactcaccttccatttgctccccccctattacagacgcattcttcgccagctctccacgctcccctattcctcatctcaccacccgttacacctcctttatctcgccttttacttagatatttgtagaataatatcctttttcttttcccccccccccctccccctttcccctctctcccccctccttcccttactccacccttatatttntgtgtntttctttttttatattttttcccgctccccccctttctctctcccactcttcccc

SEQ ID NO: 507170 - DNA, 421 bp, Homo sapiens
gtgatagaggatccccatggcatgcagtgaggtaaaatagaggggtctgaattccaacggtccttcagctgaaaaatgcttcactgccaagtgatcttcccagtcatgggtcaagctcttatagaattctccgtactcctcattagtaatatcgtcgggatatcgggtccagatgggcttggttgggttgagctcttactggatcggacggtacttttccttaatcttcgttcttcttcttctacggtcacttctttcaggtaaatccttattggattacttttctggtggttctagctttatcttcccttctggtctcttcctttcccttctcttctcacctcctattctttcctcctcctcctcgatcttcctctccgtttccttggattgctttttggtcctcattacatgccagggg

SEQ ID NO: 507171 - DNA, 339 bp, Homo sapiens
cagttatggtgaatggttgcatggatttgaaaaaatggcaaaagagggtgtggggggaacttcagggtcaaaggaggttaaggttctaaagcacaagttgaaagaagctgatgaaatgcacacattgttacagctagagtgtgaaaaatacaaatccgtccttgcagaaacagaaggaattttacagaagctacatataagtgggggggggggaacaaaataagtggaaagttaaggtcgatgaatcacacaagactattaaacagatgcagtcatcatttacatcttcagaacaagagctagagcgattaagaagcgaaaataaggatattgaaaatc

SEQ ID NO: 507172 - DNA, 359 bp, Homo sapiens
atcagcaggatatccaacatgaaatactgctctgaaccccgttgtcctatggaacaagatagtattgacaggtgataatccgaagctgctgctgaaagatatgaaaacaaaatatattactttgacgatagcactgctctccagggaaacaggaatgtcactttgaccctgtactatggaacgtcgtaccaaatgctggaattctacctactatgtgacaggatcaggacacgtactctagtcccatttccagatacatatgaaataacgaagagttattaaattattctgaatacgaaacaacatatttttatacttaatgaatagtatctcattactctcttcccttacatcttcat

SEQ ID NO: 507173 - DNA, 131 bp, Homo sapiens
actctgacgagttccctcaagcaatccaatttctgcagcacttaagtgcttttcatactcccccatatcgcagcaggtctccaaggtgggaactcggtcagaggtgagaggtgggaactcggtcagaggtg

SEQ ID NO: 507174 - DNA, 1359 bp, Homo sapiens
  misc_feature (546)..(546): n is a, c, g, or t
  misc_feature (843)..(843): n is a, c, g, or t
agcgggtttcctccgcggtcttccgatcggatcgcgtgaactagcttcctgcatgctaggtccatgtgtgctatcactgtatccctaaaggctccgggcttggcccggatgctcaatggtagggagcgaaactacttttacaaggattagaagaggctgttgtatagaatacatactacatgctatgtcgtacggtaggcttgtccgcaataacctagtctgtacagacaatactgggagccacaagtggacaattgcacaccaataactaggcttcatcccaaccaacgctttgcgagaaagctatgatattggctgcacccacaaccggatcgcgagcaaacttcatgtgtatatagctacggacccttcaagaacgatactcccgccaatccgttgcctagcgcatcacattgcactctgtagatcgggcttcgtccaataattgccataggaggtcaaacgaaaagattagagaggagtaggcaacaagagctaattcggtctcataggaatatgtctctgaatggtgagagcgattcatcncatgtgggacatatgtaagacattgaagggaaacgtctcctcgaagggaattttggacaataggttcaatgctttttcacggaaagggctcgggtacgaatatgtgtttcactttgaaagaataaagttccattgtctacggaaaataaaaaggccttccaatttgggatggaattttccgttgtaccctttaaaatgtatctcggatcacttggtcttagtggtgcgtagcagaaatagacaaaaaccctttttcccggaacgtaaataccttcggggatacggagaagcgattcnttaccgaatacctggcttaaacggttttcccgatgaagcccctttcccaaattaatcttggcacgctgaaacatcgcgacagttaattgggggtaaatttgacaaaaggctaattttatcccatggtgggcccacaaaggggtattaatttttggctattcaaagagggcaaattagtcgggttaaaattccttaagtatatcattaaaccgcaattgtaaatttgccgctgggggaccaatgtgtttacctagaggtgggtttaggaaattaaaacgcacttccagggagagattttgaggtgtaaagaaatttccctatgggggccttacattgggttaaattcgaaagattaccggttcctatatcagggtcacctttgcccgatggcgccagtggggagtttaccaaacggagaaggggagaaacccacggaaagcggttgtaattgtgtagaacccatttcctggttgcaaagaagaatttccacaaaaaaatttaggacaaagttggtag

SEQ ID NO: 507175 - DNA, 363 bp, Homo sapiens
  misc_feature (301)..(301): n is a, c, g, or t
ttgttgttgtttggttttggagggttttttagttttgtttgagacagagtctcactctgttgccaggctggagtgcagtggtgagatctcggctcactgcaacctccacctcccgagttcaagtgattgtcctgcctcagcctcccaagtagctgggactactggcaggtgcaccacgcccagctaatgtttgtatttttagtagagacggggtttcaccatgttggccaggctggtctcgaactcctgacctcgcccgccttgcccacccaaagtgctgggattgcaggcgtgacgactngtgcctggcctaatgtccttttcttattggccattgtcctttatatattaataatctggtcg

SEQ ID NO: 507176 - DNA, 695 bp, Homo sapiens
aagccccattaggaaaaaatttaaatggttcctcttcatcgccttaatgtctaaagatcagaaatcgctgagcaaacccgcttttgtttccttcccagaaacaatgcaaaacaacaggtggagatagtctggcctttgccctgctgtgtgtgcctctgaagctcctcctgccaaacgcccgggaaaacagcctcaccccactctttttttttttcctcatttacttggagctttattccttgcatctttggggctactgaccagtggctgctgaggcgacaggggaggacaccagttgttctgttgcctatgacctgcctatttgcctttccataccatcttgccctcgactttgcccgtcttaaagatcactacctgactttggctttaacatttcgtctctttagatctaacctttttgattgggagatgaatagctctctcctatgactttgtcacattacgcactggacggcacatcttcacttttaatcaagatcttctggccacgcatgcagtgggaatgcacacctctgtatttcaacgaattttatatcttctattgatctgtctccttttggagaacagttttgtattcactcactcgcgtcccgtgatgacagactccttattgcctatccacctgctttccatcatttcttattttttagtcatcgatttgtctaaaccattat

SEQ ID NO: 507177 - DNA, 259 bp, Homo sapiens
  misc_feature (164)..(164): n is a, c, g, or t
tttgaaacatggttatatacttcatgcagaagtagcaaactagttactcaggctgcatctggtctcaaacatgttttgtttaatattttcttattagtcttctaatactgaaaaaaaagagtcagtgctttttcctaagaaaggaaacaactgactctttggtngctttggaaaaatctggcacctccaggcgcacatccccacgtggcagcagtgagctggagctaaggcgtggctgtcccctgtagacagtttccag

SEQ ID NO: 507178 - DNA, 329 bp, Homo sapiens
cggcatggggtctgtaccaaaaataaaaaaattagccaggcctgttggcacacccttgtagtcccagctactcaggagggtgagacatgagaatcgcccgaatccagggggcggaggttgcagtgagccaagatcgttgccactgcactccagtctgggcgacagagcaggactcggtgtcaaaaaaaaaaaaaaaaaaaaaaggggccaaaagttttggaaaaccggggaaaaccctttggaaaaagggtttcccgtttggggttttcccaacctaaaaaaaccaagggcccgttttttataaaaccttaaaagggccaaaaaaggaa

SEQ ID NO: 507179 - DNA, 535 bp, Homo sapiens
  misc_feature (2)..(2): n is a, c, g, or t
gngaccattgcctgagccgagtgagcgcgagaacagcccgggcaacgtagggagacctcatctccacaaaaagaaaaaaaaaagttagttagccgaatgtgatggaacatgcctgtagtcccagccatatcagcaggccgaggtgggaagatcacttgagcccgggaggctgaggccgcagcgagccgagactgcaccattgcactccagccggggtgagaataaggttgtgtcataattgattacggtcgttgacttaaacatgtacatagcactgattatctgacagagactgaggaagcagaaacgagtaagacaccactccaggccccaggaatctttcttgagggagattcacatcctcgggaaaccaagatgtataagtgaatgaaggaggtagcagaggggtctgcagtaactgagtaagggtatggagctagaggactaattacctccgggataaatgactttataccaagatttgtatatgagagacgaggtgaggaccactcacaagtagtttgagtgccctgaa

SEQ ID NO: 507180 - DNA, 621 bp, Homo sapiens
  misc_feature (163)..(163): n is a, c, g, or t
  misc_feature (189)..(189): n is a, c, g, or t
  misc_feature (220)..(220): n is a, c, g, or t
  misc_feature (272)..(272): n is a, c, g, or t
  misc_feature (275)..(275): n is a, c, g, or t
  misc_feature (450)..(450): n is a, c, g, or t
  misc_feature (513)..(513): n is a, c, g, or t
tactctattataatagagaggtttaatgattaagaattcggtattaaaaagtggggattaggatgaatttttaaaatatgtaaataaaagaagctaacgtaatatgggttaatttatatgaaatgtttaaaatatataaatttagagaatagttgctaggggntggagggtaggttgggaggtggtgantgctttatgggtgtgagattttcttgggggntgatggaagttttttggaactaggtagaggtggttgtataatattgtaaatnaantagatgatatacaattgtttactttttataaatttcactttaattaaaaaaacaattgttggttgggtgcagtgtttacacttgtaaacccagactttgggaggctgaggtaggtagattatgaggtcaggagatcgagaccatttgggctaatgcagtgaaaacctgtctctantacaaatataaaaaattagctgggcatggtggcacatgcctgtagtcccagctatcgggaggntgaggcagaaggatcccttgaacccaggagagggaggttgcagtgagctgagatcatgccactgcactccagcctgggcaacacagagagactcagcctcaaaataaa

SEQ ID NO: 507181 - DNA, 223 bp, Homo sapiens
  misc_feature (49)..(49): n is a, c, g, or t
ggggggggggggtttttttttcccccccccccccccccagaaaaaaaanccggggggggggggttttttttcccaggaaaccccctggggccacgcccctttttttttcccccttaaaaaaccccggtttttctttggaattttttttttaaaaaaggggtttttttttttttttttccccccccccctttttttaaagggggggggggggtttttgggggga

SEQ ID NO: 507182 - DNA, 158 bp, Homo sapiens
ccccccctaagtttttgggaaaaagtggaaagggcgaaggctcttcttttttctctttctgccctttttcttgctgattttaagcaaagggggggccttttgattgtttttttttcaggtttaacccttattttaataaagttttcaagccaaaatta

SEQ ID NO: 507183 - DNA, 179 bp, Homo sapiens
tggggcctcatgctgtagtcacatggacaagaatggacaggacatggtggatgctgatggcattcttgagctccgtctctgaaagggcctatcccatgcttgtactacctccttctgcaggtagaggatcatgcccttgaggatcccgtggaagctcttccagaccccgcattgcccct

SEQ ID NO: 507184 - DNA, 195 bp, Homo sapiens
gcgcgaattcatcatcctgctgcgcgaattcatcattctgctgcgcgaatacatcatcctgctgcgcgaattcatcattctgctgaattcatcatccgctgcgcgaaatcaacatcctgctatcatgtgcgagcagacgctcctgctccctggatgccagcctctcactgtctgctgtgctttttgccagcccag

SEQ ID NO: 507185 - DNA, 701 bp, Homo sapiens
ggtcccagctgctggggaggctgaagtaggaggatcatttatgcttgggaggtcgaggctgcagtgagtcatgattgtatgactgcactccagcctgggtgacagagcaagaccctgtttcagaaatacgaaagaaccctgggaaaagtgaagtatggctgtaagtctcactggttcagtcctagcaagaagcgagaattccgagatcctccagaaagtcgagcagcacccaccattcaacctcgggccagtgtcttcaggcatttactggggacctgcgagctggcctaatgttggtggccatgtcaagccaggccaatccatgggcgccacagacgagatccgagccagagtcaggcttcggaggccagaagctcagcattaggcccaggcactgattgtggtcagaggggccattacgcaaggtctagcgtaggcccaagaccatagttacccagatcagtgagaagcccctggaaggacagaaatagattggcgatgcatggcagacagggaagggaaacattttcagggacaagacatgtatcacatgtcttacacgatcgcaagtcaggtttcatgtagtccgagtgtcgctgcttgcgtgctccataactagcccagggctgtagcaaacggcttcacagtgatagtccgttcacgccgtgagtcatacctacacgcgcctgtgaacacctcgg

SEQ ID NO: 507186 - DNA, 1774 bp, Homo sapiens
  misc_feature (342)..(343): n is a, c, g, or t
gttcattcgagagtctccttctggagctttgacgcccgtcttccagtgcccgagcaggcatccctagtcgccaggtggagccatgctacgactattctatactatccgttcgagagtccagtcgggggtcgctgtaacgctcgcctagatgtgcacttagtgtaccaggcgggatacaaagtcggaccacactactcagtggtgctgtctcgtagtggagtagcttactcttccaccaatgcattggggattatcatgcaatcgtccgcttcaatgaccggctctactagaatcccatagctacataagactcgcagatcagtgagaagaggtgatggcagnncttacctaccgataggtcgctggacagtgaaagtagagtgtgtggagcgtgtcgagagaaacttacggggggggatcatttctcggttcgccaggacgaatggcttgtctagcactcgatttgcgcgaggcatttgcgcccggagggagaacaggttgcttcagaggtacgactttgtccttaggagagccccatcttccgcttgtggaggtcagtcccaaaatcggaattgcatacatagactaagttggcacttcgaagcaaaataatccgcgggcaagctaggttaggagaccctactaatgggtgtggcacctcttcgtcgacgaaatagggtcgctacttggacaatgatacccactccatgaatagaccacggcaccttggtaagttgccctgcacgacgccagtatggttgctccccgatttcactctagcaagcatgaggaggggccttgtcggttgcacccaatagggggccacaccttgcgtaggtgggaccagaggttccattcccttcaccaccctgaagagatacgcacggtagtgcctggactatggcgaagccaaccccaatttctatggcaggattccacaccttgcgaccgcaaggtgggcagcccctattggtttacattttcatatttggaaagagacgccagctgtagggtcatagacagagcgaaactccacccagaaaccatattatccggctacgatattacgccacacaccttgtgagtaccccgagagggaacgccaagtacattattcctcagtggaggagacacagacggcgacaacagctgggagacagcgcacagaggaatcacccattacatagggtagttagagatcaccaggaccgagtggacgagtaggttacaacaactgggtcgtgaaacggggtaggtcagaccccagtaacgggtgagaagcccacgtgttatagggccctaccgatgataggtgccgcaacacctacagaagagagtcagggatacgtgccacccagaggataaacaatacatagtaagaaaacctagcaacaaacacaagctacacaaacaacgaccgcagacaacaagagccatagaacagagcacagacaacacaggtcgcagataaacaaatgaggacgacacaacaacacaacagcaggacgatgggacgtaatagcatgcagccacgaggcagaggactgacgacacacaacgcgcacgcgaagacaagagtcaacaatccatcgagccaagcaacaaagaagaaggaagacaaagactagaagcaacactagaagcacactccaggcacgcgcgcgcgaacagtacatccctcagacaagaaagacacgataacagtagagacatgccgagctcgtggctaaccatgcaaacacaaacaatgtaatgtactagaaataaagagcag

SEQ ID NO: 507187 - DNA, 782 bp, Homo sapiens
  misc_feature (241)..(241): n is a, c, g, or t
  misc_feature (338)..(338): n is a, c, g, or t
  misc_feature (633)..(633): n is a, c, g, or t
aagacatctaccccagcaaaccctactgatgatgacttgagcagcggctcctccagtgaaaggagcaagcgtcttcagagaggttacatcttgtacaccgttttctactgtacacacccatcccagacggaagactgtccctggaatcaccgaaagcacaggacagatatccctgcgttccagagaccaagaacacattccaccccagttggggggtcccattacctatctcatgtgatcntgaatcagcctggacatctctagcatgaggcagtcataggaagcgtgagacgctaagacatctagacctcatggttcctcataagtgacaaccccanaattcccatcaatgagctgcatcagtcttggacaactccctcaatgagccttgagactttgatcttcttggcagtgtctgcattgccagtgctaagcaggtctggagacgaaggtgctgaggcctaggaagcattagagagtctagatgactcaagcgaggtgagacagagtggcatgcctagtgcgatgcgtaacagcaagtatgcccacagtggtgactctaacgggcagagagcacagactaagctcgtcacggtgacaatggttcgcactcttgggtggaaccaaggcagntcgctcacgaaaacatcgctagaaccagtcttagagtgaccaccgctcgattgagcaccacacggcaacccttgtccagtatatgctcggaccagtggacaccgactttggcgcgtgctaaccaacttatcacccactttactctttgg

SEQ ID NO: 507188 - DNA, 191 bp, Homo sapiens
aaaagtttagatagttgctgtgaactggaccaaggttcagttctcaagaaaaccactctctagtcacagctcaggtgaggccctgcccaggctgagctgcttcagaggcatctgaggccctggactgccagctgaaggcgtataatttttccctccgtgtgccccacctacccgtccatctgacccatctt

SEQ ID NO: 507189 - DNA, 127 bp, Homo sapiens
cctactctcctcgtacagttagagtctgtgtgttatcttgaatgtgtgagacagcttcaccttgaactttgaattatctcagtcatgctgcatagttgtgcattgctcgggatagatcttcgatctt

SEQ ID NO: 507190 - DNA, 593 bp, Homo sapiens
ctagtgagtatgcatctgtgggaagtgccagggctcttcccagaggctaggccagctgtatgctggcctcggctcctccccagcccaagcattacagagcactccaggctgtgccccagctcctgcctccaccctgtctctgaccttggaccagccctgggtctcttgtccttgcaatgacttctgctcacacttggccacgtggccctggacttcagctccctgtagccaccctggcacctcgcctctgtcctccatgtcctgggcctgcactgtctacctggttgtcagggctgacagggagacaggatggcacagggagggcaaaaagtaccttggggaacaagaacttcatacctgcgttcaagtcccagacacatccctttctagcctcaagtgtcccccaaaacgaggttacttactgagccaccatcttctcagctgtaaaagcaagaacagagttagcagaaggcgcgttggtcatgagtgcagatattgctagggctccattcctggttctgccacttcctgtgtgacctcgagcaagttacttaacctacccatgctaacagttccctcaattaaattctaaa

SEQ ID NO: 507191 - DNA, 826 bp, Homo sapiens
attgattgtctgaacttccccagattccagtttccggggaaacctgggatatacactagggaggaactttgcactatgttcataagggaggtagggacggtagctgtcccaggtatattcgagagtccataatggttcgagaaatacgtgtcgtcctattgccaagagcgtagtgattacgacattccgtttcgagttaaggaaaccataaactaatagatgtaatctccgatgtatagggaactgttgaaagatttatcaaaagaagcccaagaggtatttaaagccattcagtctctcaagaccacgagaggtgctacgtaatcttcaggaacttgtactgatttcatgttccaactgaatagaagataagattaaagagctgaaagagatgaaatgtacttatcgttattaattatatccaagatgagatcaatgcaagcttcagtgattatatcccgatatgttttgaagaggcgttgagagaaaacctatgccttaatcttcgataagtgcaactgaatttattcataaacgagcttcaggaagcttctcaagagttacagcagatccatcaatacattatggcccttcgtgaagaatatttgatccaggtatagttggctggacagggaaatattatgaacttgaagaaaagatagtcagtctgatcaagaacctgtgtagtgctcttagggacttccattctgaatatatcgtcagtggctctaactttacttcccaactctcagtcaagttgagccaatttctgcacagaaatattcaggaatattctagcatccttaccgatcccgatggcacaagg

SEQ ID NO: 507192 - DNA, 572 bp, Homo sapiens
taaaactgggtattttatctttgattctccttcagccctcaccccgggttctcatctttctggatcaacatcttttctgtgcctctgtccccttctctcatctcttagctcccctccaaccgggggggcatggggtgtggtggaggaagccacaggcctgagattcatctggctctccttctgggagcccagaggatgggcagacagaaggggggtggtgtctccaaccccccagcactgaggaagaacgggggctcttctcatttcacccctccctttctccccggcccccaggacggggccacttcggggtgtggtgcagtggggccccagatggtgctcacactggagaatgtaagaactacaaacaaaattcctataaaacttaaacttttggtgtctcaaaaaaaaaaacaaaaaaaaacaccacccagggctcctgataagtttttgacccaccgcgcaacagggggggggcgccaactacacctctgtgcgcccacgggggcacgccgcgcaaaccggagcaggaccgaggaagagagacgagctggacgcgcccgagcacggca

SEQ ID NO: 507193 - DNA, 184 bp, Homo sapiens
ctaattggttcttcgatgacgttcgatgacgctgcctttcacaagtcatcactgtgctaaatgcttcacgcctttgcaacaaccccatgcagtagctactgtcaatatctgcattttagggagttcccattgtggctcagtgaaacaaacccaactactattccgtcatcgaagaaccaattag

SEQ ID NO: 507194 - DNA, 443 bp, Homo sapiens
gaagagccctctgctgataacacgccagcgcttctgccactcggacccaaagaagctatgatctgtgcttttcttctccaggtacccttgcgtgatgacgctatccagctcttgagcccctcttaagatgtcttctattccctcgtcctgataatctgaccaaaaggatgcttctgacgtgaggggtgggccgtgagtcccactcagattgtcatcagagccgtcctggccaaggtcacctccttggggctgaaaatcccaacagtacctggatttgatttgctggaaaccccgaagaatgtgggctctctgatcctgtgccccagggctgaggttctcattctgcaagccttctgccaggaagtcttcggtatcttccaggagccaacagatctcctccgggagggcgacagcctgcatttggcgaagcgagtgggcggccg

SEQ ID NO: 507195 - DNA, 183 bp, Homo sapiens
acccttataccactaaactacctagattcttgtcaagcaggtgggaggaagttaaaagataaactaagcttgtgacttctaacacactctgacaaatttatactacagacaaaactagttaagaccctaaacactactacaagtattagaaagtagttttagacagaagtaagactatacgtc

SEQ ID NO: 507196 - DNA, 429 bp, Homo sapiens
cgggtaagtggggagtgcgctgggcaaaaccagcctgtggagtgggaaaggcacctttttgtccaccgggtcgggtttggaaacagaaaggagctgcttccaactagtgacagcaataaacctggctttgccgcttacaaatgtgaaagtaaccccaagaactcccaaatcaaatgcccccttctttttctcgggccaccagatgatcctggtctctttacagatgaagagatggaggcaagttaagttttttattctaagaaggcagggtaagaggtgggcataacaaaacagaacgcacgatattaattggattctaggctaacgggcctagcgcaagacccagccctgttcctcccctgtactgggactctgggctcagttccttcatttgtgaaactcctgcctcctccgggttgcggggtctgc

SEQ ID NO: 507197 - DNA, 119 bp, Homo sapiens
  misc_feature (110)..(112): n is a, c, g, or t
gctaaagcagacttttgtgtaaaaagcaaaggttacatgtgagtattaataaagcgggtaataaataaaagccccccccccccccccccccccccccccccccccccccnnngcccccc

SEQ ID NO: 507198 - DNA, 281 bp, Homo sapiens
gtgatttgattcactccaaatttggctgtcccccgggagtggggtttggccgtaggggctccccggcagcgccaggcaaagtttgagcaccaccccccgcctgcacgcaaagttaggagccagcctccccccccgcctcctcctgccggatcagagtaggcagcccagccagtccccatagttgtcacgcagccagcagggggcccccgcccccccgggcagccccggccctccccctgttttttgggtgattgacccgacccgcgcgggaggggagggca

SEQ ID NO: 507199 - DNA, 348 bp, Homo sapiens
agaggacctccagtcagcgctctgggcatgtggggaattcctaaggatctaagaagagtacaggctgggcacagaggctcacgcctgtaatgccagcactctggtgggccaaggcagggtggatcacttgaggtcaggagttcaagaccagtctgaccaacatggtgaaaccccgtctctactaaaaatacaaaaagttagccgggcgtggtagcattcacctgtaatcccagttacttgggaggctgaggaatgagaattgcttgaacccaggaggtggaggttgtggtcagccaagatcatgtcattgcactacagcctgggcaacagagtgagactccatctctt

SEQ ID NO: 507200 - DNA, 712 bp, Homo sapiens
tttttatatgcagtaacgcgagtgtaagcgccagggggtcgttctaggaacgagactgtaccgattgctcactgaaaagagatggatcccgggtatggaggatatacgtaggtttgataaggacaggatgaagattacgatgacacttgtcaagaacagtctgccaagcaatgagaccattgagcatgagaagcgataagtatcttattaacatccatgaaggatttagtccgatctacgtttgaagatctcaatcttgatgctgagcaagaggcacatgatagatggacacctgctctcgagataactgcgagcctggacattttcggccattgccacaggcctgtggctttttgaatggagatttctataatcgtactggccgatatatccatatttcccacagaatcttgatcgaagttcatgcggctgattaatgactacaccacacgcgctatatacaaactggtcgtccatcgaagtttcacttcgcctaatgatctatttcaccggtctaactataaatttgtatgtatgtcgatatgtgtatactaagaaaatcttaggtggccactacactaagcgatatggtttccgtatattaatctgcgttcatcttttgcagttttagctatcttatctctagatgcctacgagtcttaaagcctactctcttaatgagtgagcggtcctgtatggcgctatatcctcc

SEQ ID NO: 507201 - DNA, 171 bp, Homo sapiens
tggcctctccctcccttcacttctccacctgcgagccggtgtcttgggtgggctagataggatatactgtatgcctgctcttcatgctgctgactcactttatcatagttccatttactttgccttcgttggtgagactgtatcctgtcggactagtcgggggggacggag

SEQ ID NO: 507202 - DNA, 863 bp, Homo sapiens
  misc_feature (263)..(263): n is a, c, g, or t
ggcagttcggtggtcccgcgagtctgtctcttgcataacagacagtgatttgtgactggaacacgatcctggggactctcttctcagcactccgaccgccctccgatttcctctccgccttgcaacctccggtgaccatcttctcggtccatgctcctgcattctggtgacctgccagaatccgttcaggtggttagctccttcttgcaaaaccagaccgatgagtctacccagcattcagtcatgaagtgtattcgcaccgnacgatggatggcgagtccgacgaacattcctggatcaatattgtaccgtgctggacctctctacaccatatcctctctcatgtggcttctagtttcggactcgacgatagatgtggactctggaaggactgtgagctcactgtctattccgcgaagtctggccgaggagatagcgcagagggctacgaagtcgtctcctgaatgatgtcgaaaccagaggtggctatccggcgctctcttccatggacagtcaaagcaagccatgtcgtgactgattgagtggggtaaaaccccatgacgccactgacagctgccactgtgctccctggaggaaaaagtctgcaatctaggcccgtattagggatcttcatgccctgaggttctgctcgcaacggactcgccgatgtcttgtgtacttacctgagacaacttcaactttcgctagattgagggacttttgcacgtttgatccctgaataatgcgtgtgaaccagctctgaaactaacctttcattggggctggggtaggcccgggaaggctaggactttggagccaagttattatactatcgaagaaggttgtcatcttcaatgccccaa

SEQ ID NO: 507203 - DNA, 166 bp, Homo sapiens
gtgggagggttgcttgaacccaggagcttgaggctgcagtgagctgtgatcactgcatttcagcatgggggacaggtagacctgtctcacaattttcttttttactaaattccagactacagttttggattacagatgtaattcagcatgaaaagtttagaacttg

SEQ ID NO: 507204 - DNA, 1484 bp, Homo sapiens
cttatcctgtatctgctcttccttttgtgcggtcgtgggcgggggtgctcgggtttctgtggtgtgttgggtctgtgggctttcttttgtttgggtggtcgtcattttggtgcccgtgttggttctgttcttttgttcgcggtggctgttccctggctcgtttgtttcttggcctcgttgtgtggtttatcttctcgtcctgtgggggtcctttgtgacctgttctttgttcttgtatttttgttctttgtgtttttttgttgtttctccgtttttccttggtgttttcttgtgttttgttggtctgttgttttgttttttttttcagaactaaaaaaaatatttcatttcattctgaataaaaaacagaacagacagaactcttggaaattctgaaaacaatgtcatcgctacagcaaaatttcacagaaatcatcgcagagtggggaccaaggccaggccctgacccgccgtgaaggctgcctctccggggaggggcacgacgcccagtgggccagagaggggcaggcacaggcggtggctgtgcccctctgaccagccctgccgggtctctcgggaccgagctcaaagcccagcccccagcagctgcctcgggactcccaccggggctgggaggggctgcccgtcctcaagacgcccccgtgcgagagcccttcctgctgcggacgctccacatgcccctcttggagtggtagtggtgatagaaattccgcagtcggagccgctccacctccagccctgcctgcaggaccctgtccaggagctcccagtcttcacccccccactggtctcggaactcctccgtgttcattcctccaacccggtcaaagtccgacttgtagatcccaaaaaggccaaagccgttcacctcccagtaaccgtgggggtcccggggcgagctcccgcagctcaggcgcatgaccacgggcgcgaaggccagcctgccctccacgcagtgcttgcggatgccgtccaggatgttgggtgggaagtggatgtgcaggtcgcagaggaacacgatgctgctggcgtcctctaccgcgtccactcccgcctgcagcccggcggagcgctcgaagttcccggttcgtctcaggtactggtaccggggcaggcgcgcggcgcgcagggcccgctccacgtccatatcctcgctctcgaaatccaccaggacgacgctgaaacgcgagtccccggtgcgcgcgtgcagcgcagccatgtccgccaggaactgtgccacccaccgtgcctggtttttcactggcacgatgaagtgaaccatcacgtcctggcgccaggccaggcgcagtggccggcagagctcggggcggccgtcggggcgcacggaggcggcgggagcgggctcgggactttctccgtctgcatcccctacgcgggctcccggcagccgcaggaagacgtactcggacagtcgcaggcggccgcccccgcgctcctgcagc

SEQ ID NO: 507205 - DNA, 404 bp, Homo sapiens
ggatgttcacatcaatcatggaacaggccccgattcagagtgagccccgggatacggctggtgatggctcagacacatgatcagggatatacagaccttactatcccggatggagtgtcgaggagggcgctccagccgcagcatcagtcgagccgcccccgtcagccaccggctgtgaccccggagccagtaaccttgagctctcacacatcagaaccgagttgtaaagtgaacgtcgaccgtccccggagacggcccagtaggagagcagaaggcaagtggacggacgcgtgcccctagcccatgaatcccaggagactctactccgtgtgcccatgctccctagcggtgtcccaagcagcctgaccccaggaagatccaactgcacccaaccagtccttccc

SEQ ID NO: 507206 - DNA, 131 bp, Homo sapiens
agaggatcccctccacactggatatgtggtgacgacaattgtccaccatcatcattcaagtatggtgtatacagcctcccacgctggggtactgggggcatcagcatcagtcacttccagggtggagagag

SEQ ID NO: 507207 - DNA, 207 bp, Homo sapiens
ggggggtcccggggggggggcccttttttcccccgggggcccccaaaaaatttttggcccccccccggggggggggtttttccccctaaaaatgggggccaatccttttttttcccgggggggcccttttggttttttccccccgtttttcccccccccccctttgggggtgggccccctttttccccattttttttggggggggga

SEQ ID NO: 507208 - DNA, 703 bp, Homo sapiens
ggtgactgggtccacagaatgcccgtgtggctcctggaatagcacccctattggaccacttgtggtccccacaaggagaaggaattgaggaaatatagctaatctgaaagttcgcttaaagaggcacacgctctatatacttccaagccacttggcacacaccacggcacttatgaccacgagaagcctgtgagaagttgagaaatggtggagagttcccacactgtgcctggagccacgccttataatggtttctggctccctcggtgaaacgctgtgtgggtaatgccactcggagtgagctctgctctggggtatatggagagagagtcgcgcttgagactacaccccgctgtggaggcccaagtttttataaagagaagcccacaaggagctcacgagattcactgattgaaagaaaatgcacggcacgacctgttatccttaaactagggtttttaatgagcccccacccagccagcactgcacgcttatctgcttgaaaagggtcttgcctcacaccccagctagagtgcacgtggcctcttgaagcttactacacgcctccaaactttctgggctccagtgagtcctcacgccttcccacgtggttctttgtagagctgcctgatggaggtctcactggcacccagaagaatttaaaccgtgtttcccattttaataaatttttgccatccctcca

SEQ ID NO: 507209 - DNA, 212 bp, Homo sapiens
cccccccccccccccccccccagggggggggggggggggcccgtgccctttttggggggggggtttccccccccgttcccggggtttccgggcctttattttggggaccccaaggggggggggggggggcccccttttccccattttgggggggggggggcccggggggccaaagttgggaccccccccttttttgttttttccctccccca

SEQ ID NO: 507210 - DNA, 5356 bp, Homo sapiens
  misc_feature (15)..(15): n is a, c, g, or t
gattcgaggtgctcngtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccaggggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctcttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttga

SEQ ID NO: 507211 - DNA, 343 bp, Homo sapiens
  misc_feature (131)..(131): n is a, c, g, or t
  misc_feature (146)..(146): n is a, c, g, or t
gactctgccctgttgctgtcgcgccgctgctggttgctgtccctggacccctaccactggaggagaccatcacaagatcccccccacagtcagcttgtcttgcttggatcactggtcattttctctcaggntcatcttttaacagntgtgggagaaagttcctacattcccctggcaaggggcacgtcaaccatagtccatttcattcacccttttccacgcccaagccgatttctccaattcccccttcagattcgcaaacaggaaatttggggatcttgggccattctttatcagaaaggtgggggggtgggacaggaagaaacccccgttgcagttattc

SEQ ID NO: 507212 - DNA, 317 bp, Homo sapiens
  misc_feature (56)..(56): n is a, c, g, or t
  misc_feature (129)..(129): n is a, c, g, or t
  misc_feature (162)..(162): n is a, c, g, or t
  misc_feature (166)..(166): n is a, c, g, or t
  misc_feature (184)..(184): n is a, c, g, or t
  misc_feature (225)..(225): n is a, c, g, or t
  misc_feature (277)..(277): n is a, c, g, or t
  misc_feature (294)..(294): n is a, c, g, or t
ttcggcacaggattctcaacatgtccgagactgctcctgccgctcccgctgccggnctcctgcgagaaaggcccctgtaaagaagaaggcggccaaaaaggctgggggtacgcctcgtaaggttccggntcccccgtgtcagagctcatcaccaaggctgtngcgnctctaaagagcgtaggangtttctctggctgctctgaaaaaagcgttggctgccgcggntatgatgtgggagaaaaacaacagccgtattcaaacttggtctcaagagccngggtgagcaaggggcantctgggtccaaacggaaagggca

SEQ ID NO: 507213 - DNA, 5472 bp, Homo sapiens
  misc_feature (15)..(15): n is a, c, g, or t
gattcgaggtgctcngtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccaggggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctcttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttga

SEQ ID NO: 507214 - DNA, 5649 bp, Homo sapiens
  misc_feature (15)..(15): n is a, c, g, or t
gattcgaggtgctcngtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccaggggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctcttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttgaaaaaaaagacaaaaaaaaagagaaaaacagaacacaaaacaaggcgggggagataaaacaacaccaaaagcaacaaatgcacccatgtttgaaaggggccaaaaagatataaagagcgcgggaaaaaaggcagagagaacgacagaaagagacaatggtggaggtgaaccaacaaca

SEQ ID NO: 507215 - DNA, 102 bp, Homo sapiens
cagcatctcacctctgggcccagtgccttgtgctaatgcctgcccagctttcggctcctgaaacatcttgttgttttacgcatgttggctggggcatctctc

SEQ ID NO: 507216 - DNA, 5337 bp, Homo sapiens
  misc_feature (15)..(15): n is a, c, g, or t
gattcgaggtgctcngtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccaggggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctcttttttttttttttttgaggcagtctcactctgtcacccaggctggagtacaatggcgtgatctcggcccactgcaacctctgcctcctgggttcaagcaattttcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttga

SEQ ID NO: 507217 - DNA, 347 bp, Homo sapiens
aaagtttgtgcacatatgagggcatgggcagaatctgctccccaaaagcattgaaagcccaatatgaggcccaggtggtggctcatgcctgtaatcccagcactttgggaggccaaggcaggcggatcacaaggtcaggagcttgagaccatcctggccaacatggtgaaaccccgtctctactaaaaatacaaaaaaattagctgggcatggtggtgcatgcctgtagtcccagctactcaggaggctgaggtaggagaatcattgaacctgggaggcggaggttgcagtgagccgagattgcaccactgcattccagcctggcgacagagtgagactccatctca

SEQ ID NO: 507218 - DNA, 4967 bp, Homo sapiens
  misc_feature (15)..(15): n is a, c, g, or t
gattcgaggtgctcngtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccaggggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctcttttttttttttttttgaggcagtctcactctgtcacccaggcagaggttgtggtgagccgagatggagccattgcattccagcctgagcaacaagagtg

SEQ ID NO: 507219 - DNA, 464 bp, Homo sapiens
  misc_feature (2)..(2): n is a, c, g, or t
  misc_feature (7)..(7): n is a, c, g, or t
  misc_feature (15)..(15): n is a, c, g, or t
  misc_feature (201)..(201): n is a, c, g, or t
  misc_feature (213)..(213): n is a, c, g, or t
  misc_feature (305)..(305): n is a, c, g, or t
  misc_feature (320)..(320): n is a, c, g, or t
  misc_feature (357)..(357): n is a, c, g, or t
gncattnttcctttnccacattcccgtttgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacaccttagcagattgangagttcaaggangccttcatgctgttcgaccgaacacccaagtgtgagatgaggatcacctacgggcagtgtgggatgtcctgcgggcgctgggccagaacccnacacaggcagaggtnctccgtgtcctggggagccaagacaggaggagctcantaccaagatgatggacttgaacttcctgccatgctcagacattccagacaggacaaggaccattaggacttgtgagggctcggtctgaaagaggcaatgacttaagg

SEQ ID NO: 507220 - DNA, 134 bp, Homo sapiens
tttctgaaggctgattcttttattcaacaaaatgtcaaggagattattccctgcctacacatacacccgtgctgtgatggtttaataactgcataagactccattataatgatgattccacaatctgcataaaa

SEQ ID NO: 507221 - DNA, 172 bp, Homo sapiens
gagaccaggagtttgagaccagcctgggccacatagcaagaccctttctgtagtcctcactacttggaggctgaggcagaaggatcacttgtgcccaggagttcaaggttacactattccagcctgagtacaagtgagaccgtctctaaagaaaaaaaggaaaggcagtaac

SEQ ID NO: 507222 - DNA, 1759 bp, Homo sapiens
ggcacgagggaaggaccttggctctcacttccctcctccttccatcccaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctcttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttgaaaaaaaagacaaaaaaaaagagaaaaacagaacacaaaacaaggcgggggagataaaacaacaccaaaagcaacaaatgcacccatgtttgaaaggggccaaaaagatataaagagcgcgggaaaaaaggcagagagaacgacagaaagagacaatggtggaggtgaaccaacaaca

SEQ ID NO: 507223 - DNA, 464 bp, Homo sapiens
  misc_feature (2)..(2): n is a, c, g, or t
  misc_feature (7)..(7): n is a, c, g, or t
  misc_feature (15)..(15): n is a, c, g, or t
  misc_feature (201)..(201): n is a, c, g, or t
  misc_feature (213)..(213): n is a, c, g, or t
  misc_feature (305)..(305): n is a, c, g, or t
  misc_feature (320)..(320): n is a, c, g, or t
  misc_feature (357)..(357): n is a, c, g, or t
  misc_feature (442)..(442): n is a, c, g, or t
gncattnttcctttnccacattcccgtttgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacaccttagcagattgangagttcaaggangccttcatgctgttcgaccgaacacccaagtgtgagatgaggatcacctacgggcagtgtgggatgtcctgcgggcgctgggccagaacccnacacaggcagaggtnctccgtgtcctggggagccaagacaggaggagctcantaccaagatgatggacttgaacttcctgccatgctcagacattccaggagcacggacacaggcacctatgaggacttcgtggagngggctgcgggtcttcgacagag

SEQ ID NO: 507224 - DNA, 1368 bp, Homo sapiens
gcaccgctttgtgaaatggccccgctatgtcagtgttgctagcggtggagagtccgatcctgctataagcaggattgacagtgctcgtctctgttgattaatgcgagtttcagcctagtgccctggcagccgtcaagactagacgtactcacggcttgcttagaagctcggtcgtatccatgtacatgcagccagagcagccaacgcgaagacgcaaggagacgctcgatacttgtttggtcgcggggcacgagaagaacggatgcttgggcagaaggggacgtacccacacggaagtagacctaccttgtcccttcgagtcagcgcacgtttagcgcctggcaactagcctatgccatggaggaaacacagcaaaatggcatcaagcatggctggtctgacttaggcacatcgcaacgatggagatcccagtcccagttcttggccttggtactgtacttaccccctggcccctgtggcttcactacaaagtgcaggcgattgccattacctgagagttaaatccaggagggaacaacgggatagaagctctaggagtatcagttgctttatggtaccgcaaccatttgacaaagaacacctcggagagcaccaacgttgttacccggctcggtttaccagctacccaaggggtcgcaagaatcgtcctgggtaacacgcatccataaacggggcccgttccttttgtggggccgtcacaacgcccttgtggcttgccgaatatgggcttaattcggaggagggaattccctaggaggttatgacaaccgcactgtgggatcccagggactaccaaccgaaacttgtggaatggaacttccccaagtccctggatgcggaaacgtgggggcgtgattcgggcccacatatttcggttccccccatagtggggcttcacccttacacacattggctaccgtatgattgggggcatacccgtttacagtatcttggggcccacagaggggtacagcaatagaaaaaccgggggaacattaaagcaggcttttcaacagttacggaacaagccaattttgcccgtccaccacgtatggaaaccgctgggcaggggttctataaccacaattgggattatccagacacatggatattcggaacgcgtgttactccgatgggctgaggcggcattacaaagtaccgagtttgacgtcttgggacacagcattacactagtaggaagcaacaaacagacgtaggaatacaaaaacactcgatgtaacagagagccacctgtcgtaaaacgtatatcccgcagcgcgaagcggcaggaaaatagtaggcccgagcgcttgtctcgctggtacaaatatatcgtgtcacagcacg

SEQ ID NO: 507225 - DNA, 4970 bp, Homo sapiens
  misc_feature (15)..(15): n is a, c, g, or t
gattcgaggtgctcngtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccaggggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgatcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttga

SEQ ID NO: 507226 - DNA, 4394 bp, Homo sapiens
  misc_feature (15)..(15): n is a, c, g, or t
gattcgaggtgctcngtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccaggggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggtggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttgaaaaaaaagacaaaaaaaaagagaaaaacagaacacaaaacaaggcgggggagataaaacaacaccaaaagcaacaaatgcacccatgtttgaaaggggccaaaaagatataaagagcgcgggaaaaaaggcagagagaacgacagaaagagacaatggtggaggtgaaccaacaaca

SEQ ID NO: 507227 - DNA, 341 bp, Homo sapiens
caatgtaatggaatgtaatggaatggaatcaacccgagtgcaggggaatggaatggaatggaatgcaatggaatggaatcatccgatgcaatggaatggattggaacggaataaacccgagtgcaatggaatggagtgaaatggaatggaatggaatggaaacaaccagaatgggtaagggaattgaatagaataaatctgaatgtaatgaaatggaatggaacggacatgagtagagaaatcaaagaacagagatgagcataaagcatgagatgaaggaccacaaatttgaaaaataataccagcaactcaaggtgttaagtactttctttctatattaa

SEQ ID NO: 507228 - DNA, 2119 bp, Homo sapiens
  misc_feature (15)..(15): n is a, c, g, or t
gattcgaggtgctcngtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatctaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggtgaggaaaggagttggaacaagagactgggcctgcctggtatcctgccaggtttcgtttagggagaggtatcaggaatctccaaccaaccacccagctctgggtcccattctccatgctctgtacattctagacaggttcagggttggaagggtggaagcctgctgccgtgggatgattggtggtaagggtgcggcagcagttgacacaggaacacaccaaattacaggcccctttggaggccagggactgccctttaatgcctgaccaccactaggtcactgcttctccttgcaaccccggacacggatagggaacc

SEQ ID NO: 507229 - DNA, 431 bp, Homo sapiens
atggagtacaaaaggcgagagattagggaccaatgcaacctatgcatactgggttcaaacaatattcctacctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcctctccccgccttttcaataaaggatgaatgaaggttga

SEQ ID NO: 507230 - DNA, 270 bp, Homo sapiens
  misc_feature (134)..(134): n is a, c, g, or t
  misc_feature (262)..(262): n is a, c, g, or t
tttccggtttgtgcatccgatgaccatcagtcagcaagagtttggccgcactgggcttcctgacctaagcagtatgactgaggaagagcagattgcttatcgcatgacaaatgtccctgcatggaagcagagtnttggccaggcggaatcagcagatcattgagtgccagctacagctattggacacatcctgagccagccaaggaggatggatgattacgactgtgtatgcaggacccctgatgttccttcagacgtgtcnctagagaa

SEQ ID NO: 507231 - DNA, 266 bp, Homo sapiens
gaatcatagaggcatcccttaaaagctaccgcaggatgattcagagactacaacaggagcaagactgagacgttcaggtagatgcaggtatcagtaatagcagccgtataagtcgaggctccataagttctacctcagaggttcattcaccaccaaatgtaggattaagacgtcgtgaaaacattgaaggtgtacggcaaatgcacagcaacgcactcatgacgtgaaatagccacagagcgggtagcctctagagggtaccgagc

SEQ ID NO: 507232 - DNA, 2053 bp, Homo sapiens
ggacaaggctgagagctagcagagaccagagcgacaagatgaatgcgggctcagaccccgtggtcatcgtctcagcggcgcgcaccgctataggctccttcaatggtgccctgtccaccgtgcctgtccacgaaatggggacaactgtcatcaaagaagtcctgcagagggccaaggtggctccagaagaggtgtccgaggtcatatttggacatgtcttgacggcaggttgtgggcagaatcctactcgacaagccagtgtgggtgcagggatcccctattcggttccagcatggagctgccagatgatctgtggctcgggcctaaaagccgtgtgtcttgcagcccagtccctagccatgggcgactccaccattgtggtagctggaggcatggagaatatgagcaaggctcctcacttgactcacctgagaacaggagtcaggatgggtgaggtgccactggctgacagcatactctgtgatggtctgacagatgcctttcacaactaccacatgggcatcacagctgaaaacgtagccaaaaaatggcaagtgagcagagaggcccaggacaaggttgcagttctgtcacagaacagggcagagcatgctcagaaagctggccactttgacaaggagattgtgccagtgctggtgtcttccagaaaaggtcttactgaagtgaaaatcgatgaatttccccgtcatgggagtaaccttgaagccatgggcaagctgaaaccttactttcttactgatgggacaggaactgtcaccccagcgaacgcatcaggaatgaacgatggcgctgctgctgtggtccttatgaagaagacagaagctgagaggcggatgctgaaacctttagcaagaatagtctcctggtcccaagccggtgtggagccttctgttatgggagtaggaccaattccagccataaagcaagctgttgcaaaggcaggctggtccctggaggatgttgacctgtttgaaatcaatgaagcctttgcagcggtgtctgcggcaatagctaaagaacttggattaaaccccgagaaggtcaacatcgatggaggagccattgccttgggccatcctctgggagcatctggctgcaggattctagtgaccttgctgcacaccctggagagagtgggcgggacccgtggtgttgcagccctgtgcattgggggtgggatgggagtcgcaatgtgtgttcagagagggtgaactgcatgacagccaccaccttggacagttcttgttaaatcagtgcaacactaagcagaaagggaaaccagaggaccaaactgaggacaggaacccaggtggacagcttgctgtactttaatgtgagacacccaaggctacggcattgcacctgacactgttataaataagagggaaatccaatcagtcatcaagggctccagagtgaacagcattttcataacttccatgtttatcgtctttactttctgggtgtaattttctctgatcattgttttttgttttttttgtttttctttgtttttgagttagggtctcaccatatagcctcaaaatcgttttgtagatcaggttgactttgaactcccggagatccacctttctgtgcctcctgaatacttgaattaaaggcatgcaccattatgcagggcccccaaaatgatccattcaaaacatggggattcggcttctgttacgaacttcaggctcttcactttaactatggttggttcaaacgcccctgcgtgcctgtctctcggtttcccattgatcaaatcaagaccaatcctgtagtgaaagtcggattcagtgacctcttccaggctgaggtggggtaggtattccagctgttctagtcagaagactggcagtgccaacaagtgtgcctctggattgttgaaaggtgggcagcaagcagcatccacgtacttatttctctgcttgacgggatgggatgttacctgcttcagatatctaccttgacttccccaaaatgatgactggaactggaactgacagtcaaataaactctttcctccctt

SEQ ID NO: 507233 - DNA, 286 bp, Homo sapiens
gatacgtgtccggggttgtatccgtgtcggggttttctggatgattttcccattgtgatcaaacaccagtcgagtcccaaccttcgccgattcctgataggtagaaatgtagacatcattaagccgtctaagagctcgtctcctacccgagatccacagcgtgaagcttgaatgagatccattcgatagtccttaagctttagatcaacattagtggcaccagcatccagactgatttctactatcttcttcatccagtgcttagactcagtaccacctgcccaga

SEQ ID NO: 507234 - DNA, 885 bp, Homo sapiens
  misc_feature (6)..(6): n is a, c, g, or t
  misc_feature (23)..(23): n is a, c, g, or t
  misc_feature (62)..(62): n is a, c, g, or t
  misc_feature (78)..(78): n is a, c, g, or t
  misc_feature (120)..(120): n is a, c, g, or t
  misc_feature (131)..(132): n is a, c, g, or t
  misc_feature (192)..(192): n is a, c, g, or t
  misc_feature (231)..(231): n is a, c, g, or t
  misc_feature (282)..(282): n is a, c, g, or t
  misc_feature (297)..(297): n is a, c, g, or t
  misc_feature (303)..(303): n is a, c, g, or t
  misc_feature (316)..(316): n is a, c, g, or t
  misc_feature (594)..(594): n is a, c, g, or t
  misc_feature (625)..(625): n is a, c, g, or t
  misc_feature (692)..(692): n is a, c, g, or t
  misc_feature (722)..(722): n is a, c, g, or t
  misc_feature (745)..(745): n is a, c, g, or t
  misc_feature (756)..(756): n is a, c, g, or t
  misc_feature (760)..(760): n is a, c, g, or t
  misc_feature (766)..(766): n is a, c, g, or t
  misc_feature (775)..(775): n is a, c, g, or t
  misc_feature (792)..(792): n is a, c, g, or t
  misc_feature (797)..(799): n is a, c, g, or t
  misc_feature (821)..(821): n is a, c, g, or t
  misc_feature (876)..(876): n is a, c, g, or t
gaagtngtcggggggggagaggntagtagagcagcgcgcgcgtcaccagagtcgtggccctncggagtcgaaggggancgagggggggcccagggggcggacgtgtgtgcgcctcccgtncccccccaatnnccaaacgtgtcaccccggcgccgacggccctgtgcaggggaagcagaaggagtacaagcnggaggcccatcgcatcggcagcatccccctgggcaaganccacaacccgcggggccagcgcggcggcatcaagcagcaaaagaacccccngggcccgccggggcngcgcangcccgccaagacnacccgagcgacccgtgccccggcccccacccggccggtcccgccgggaccccggcgccgccaccgcagcagcagcccggggagccggcggccgggccacccgccggccggggagagccgcccccgcccgccgcccaagccacaaggccggagaccgagccgcagccggagcgccccaccgacacagacgcgccgcggggaggggacgaggtgccggcggccacggagacaggagaaggggacgtttttcagggcggagaggcggacgcgacggaagcngcctggagccgcgtggaggggccgcgcaggngcggccagagaagccgagggtacgccggagtggtggcgtcttcccgaggtatctgtgccgcgcgctncccctgcgctgtttccctaggcggggaggncccgccgggtacaccggccgctntccccggcgcngccngccgcngcgcgccgnaccagcgagggacgatntcccnnngccgcccgcggtgtgcccaggnaagcgccgcgcggcggggggtgggcggcggccagccggctgcccggcgcccggcncgaccccgc

SEQ ID NO: 507235 - DNA, 1007 bp, Homo sapiens
gtcgtcgctgccggcctgccggtcttccagtgtctacgtggcacctcgacgcgaatctcgagccagtggctttttcgcctcggcgcctcgtgtggctatctcgaggaagctcgagtgccgccggggtgttcattggtgcgccgctggtcgtcacagcgctccgtctgtatccgagtccctgggcccaggtcgttgctgcgtcagctcagcgagtgctgtaggcgccgttagccgggggacccgtgcttgagccgggcgtactgggatgaagggcgtgagatgggttctggtgagctctacacagacagcgtgaatagagcatatcgtcaagcagatctcttcaaggagataactgcgtccgcagttcgcgtctggtttggtagagggagagcgcgtcgaatgaggtcccaagcagctgtgagtgatatatgggctcaaggagggaactgcgaataaacttggcaatttgcataccgcatgtttgaacctccacaggttcagttgaaaaccgaggcaagaacgtagtaaagtagccggcatggggtcgtaaatcagtttcttgcctggctcaaatacggttggtcgtgacagaggaagtgagtctctcgcctaaaataggcacgatggtcctaaattaaccaaggacgccgggtatcgccataagagccattgtcatgtgccaatgcagctttggcctgtgtgttgacgtatcgagggaacggtatgcctggtgcttgatcaactccgaggatcgcccgaggaagggcatgatgtggctcaacccggggtatggtataacctgtagaaccgcagtttcccggaaacgaagtcttggccctctcggcgaagtgggccactgcaccctggggctccggcgaggagagcgtctcacgctcccggtcacgggcccgcgcacaaaaccgcagacgttttgcagcagggcccgaaaagccccaccacggttcacggcggcatgctcacggaggagataaacactgcgtgtcaaa

SEQ ID NO: 507236 - DNA, 328 bp, Homo sapiens
ttgtattgggaagggagtttgcagtgacacagtacagatgtgaggggacactgcagacctgtgtgttgggaagggagtttgcagtgacacagtacagatggtgaggggacactgcagacctgtgtgttgggaagggagtttgcagtgacacagtacagatggtgaggggacactgcagatctgtgtgttgggaagggagtttgcagtgacacagtacagatggtgaggggacactgcagacgggtgtgttgggaagggagttctttggtgcagaggcccgctcagtctgagttggcctagccatgcagagctgtcaacactctctggt

SEQ ID NO: 507237 - DNA, 639 bp, Homo sapiens
  misc_feature (414)..(414): n is a, c, g, or t
aactaggctgtcggagcggtgtgaatcggcgaggagaacggctgcaggctgccaggcacctgtggcctgctctgtgtcccttggcaggtctggccagaatggccgcggacgctgcttccggtagggagtgcagctccagcctgcccaacgcgcacggcaccctactcgccccctactgcgccttgtctcctactcctgactccctacctgcacctggaacatcctttgcaggcagcgcacaactttaaacattgacgattccttctctgaacacaggcagctttctagaagtttcccttcctccatcctatccactggcacaactgcaataacttctgacctttggtgaagctgagactcctgactgtacatatctgtatgaactttatctaaagaaaaataaatctgttctgngctctttcctctgaaaaaaaaaaaaaaaaaaaaaaaaaaaaaaaacctccggggctttttttcgggggggggaaaaagaggttttgaaatgggccatgggcaaagtttttccttggccccagtttttttttccaagggggaaaactcgcggggcccccccataggggggcgcggaaaaatttcggaaaagacccgggttacccttgttaaattcgagaaaaactc

SEQ ID NO: 507238 - DNA, 323 bp, Homo sapiens
ggactgtttttggtgggactagaacttaaaataaaattggaacaaggccagatgtggtgactcacgcctgtaatcccagcactttgggaggccaagccagtggatcacctgaggtcaggagtttgagacctacctggccaacatggcaaaaccctgtctctactaaaaataaaaaaattagctgggcgtggtggtgtgtgcttgtaatcctagctagttgggaggctgagacaggagaatcgcttgaatccaggaggcgaaggttgtagtgagcccagattgagccactgcactccagctcgggcaatagagcaagactctga

SEQ ID NO: 507239 - DNA, 408 bp, Homo sapiens
  misc_feature (2)..(2): n is a, c, g, or t
  misc_feature (50)..(50): n is a, c, g, or t
  misc_feature (57)..(57): n is a, c, g, or t
  misc_feature (70)..(70): n is a, c, g, or t
  misc_feature (114)..(114): n is a, c, g, or t
  misc_feature (188)..(188): n is a, c, g, or t
  misc_feature (327)..(327): n is a, c, g, or t
anctgtgggaggaggcggcgtggaaggcaggagctcaagccggaccaatnacacgtncgggccgcacccngaccctgcagcgtaccgggaagcgaaaccggccggatgggcgcntgagcccgaatcgcgacatgtgtggagccccctggagctgagatcaggatgttcgcttcatgagggacgtgganctgaggatccatgttactgatggatccctttgcctattcaaagtcagcatatgagccgtatgttgtcaggtggctttggatatagcccttcctcagcatcacagatggcaacatgccagggaccaggcctgcagccgcnggatgcagcaggctggagctgtctccccttttggattgctgggaatgtcgggtggttcatggacatgtttgggatgatgaa

SEQ ID NO: 507240 - DNA, 352 bp, Homo sapiens
  misc_feature (8)..(8): n is a, c, g, or t
  misc_feature (41)..(41): n is a, c, g, or t
gtaccgcnaggtttaccaatcccattggttttgaagacctntattggtacactcatgtgcagatgaaggttttaaaaatgttactgacggagtcaccatttgatcagtcattgtcttgatattttattaaattgtatatttctaataatattttttaaagttgagagaactggttggatgtttattctcctgaaggtatttttaagataaagcttcaccatagcctgtaaacttggcacataagtagtttttgatactttttgttgcatttgaaaaatcttgtgtattgtaaaatggttttatacaaaatactaaatagtagaaattgtataatttacaatcgtataattaa

SEQ ID NO: 507241 - DNA, 718 bp, Homo sapiens
  misc_feature (548)..(548): n is a, c, g, or t
taaaaaccctcatcaataaatggaaacttacaaaaatagtcaaaccacttctacaaaaggtcagtatcaggcgggggtttcaaacccaaagtgatgttgggatgtaaagggaaatattagttgggcggatgaagcagcatagttgaggaaagtggacccaataatgacgtgaagtccggtggaacccgtggtggctacacaaaaaagtgtcgacccgataaatgccgctcggaaagtggtgaagggagacctcgaagtcactctgaggcttgtaggagggtaaaatagagacccagatacattggtaatagagcaggtgctcgaactaactgcgggtttccggactggtctccatactcaaaactagtgggtgagcccagggtgatgcgaataaccccgtgcagtgcgacgtaacacacggagtgctgctccaaaggaggtggcgacccctccaatcaggggaactatcacggcggggagcctgcacctgcccaatgaatggggagagccaagagtgccccaccccaaaactgagggcggagcacacnggacgcacaagggcatggaagctggcataaaaagcgcgacacaaaacaccaactaccatgccgacaagaaacaaaacaccacgtctcatgaaggctaactacaaatacggcgacatctccacaagatattacgaaacagcacattatcgggaaccacgaaggatgcacag

SEQ ID NO: 507242 - DNA, 391 bp, Homo sapiens
ggaatagcgagcaggagctggctggatcgcgagcgcgagtgaggggagcctgagccgccgtcccggcgcctccgcctcccctccgggaacaggagcccgggtcggggcccggcacgccgcccagcccgtccctcgtgcgtcaggccgggagggtagcgcgcgcgagggaggcgagggggagggagagcgagcagagcgccggtgaggaggcggtcggaccgacgcgggctgcccgcggcgtgtggcgtgaggggaagccggtgtgcccgttcgataagggcgccccttggggcaaaaagacccggtaagcggggcgcagggctctaggagacgcaaggtggtggggcatggcacaacaggcgtgtaaacaggactggtccagcggccaaaa

SEQ ID NO: 507243 - DNA, 1049 bp, Homo sapiens
gggcttgcctctgggtgggtcctgctagtcgcggggcggcggtggcggtgcgggcgcgaggttcccagcaggatgccccggctctgcaggtgaagctgaagtgagaggcccggagagggcccagccctgcccgtgggcagtgatgaccaaggccctggctgtatccggctgtggcatggtgctggggtcggtgtatcatgatcctgctgatcatcgtgtacttgtgacagctgcagtgctgcctgcgcacttctacttgcaacacgtacctatactctaggcccgcaaaccgggggcctgccgactgccccactgccctgggcctggacatgtggacatggggcagctcacaggtgccgactccgatagtcggacgacgtattccttgggacaagtttactcatgtgcttggctgtgcaagcagaagcgacacttcccaggaaatgcgagacggagcagcgcggactgcgcctggcggacgcagtggagggagagccgatgagaaggcatacagactcggtccaccgatgcgaaagcccctggcagcaggaccaagacacaagggacctggaacgcacgcgccgtgacggcgcgaccgacgcctttgcctggccgtgaggacctttcgttggggcccacagtcgccagagactgacacacattcaccccagagcaaacgggaaagcaggcggaccatttcgcacggaacaagttcccctccaacatacggaatggcctgaacccgcgacccgtcgaatccgtatgcggaaccgaacgcgtgcaacggggggactccacaacatcataaacgcttgggactaaacccggattgtccccacaaaaggggctgcgtgcccctttgacacctgcaaaccgctgggggcaaaaggcgaccgaattggaacattggaagctcggtctaggactttgtcaagaccggggtaaacacgtactgcgttgcacctattcctaacccgcgcgtggcacatgccacgcccgcattacagcacgtaggggaacacccccggcatggtgcgcacagtttcccg

SEQ ID NO: 507244 - DNA, 196 bp, Homo sapiens
atcagaggtcccagtcggttctacataaatcttccagtattttgctacatagacgggtgtgccttttagcttgtcttaggtagctcgtctggtttccgggagtcttagctttgggtctccttggcaaagttatttctaagttaattccattatgcagaaaggtatacggggttacgtcctttgctatattattgct

SEQ ID NO: 507245 - DNA, 473 bp, Homo sapiens
agcgggaagaatatcgccaatctccctatcgcacgtgtcagtgtcctcatccccatcaccacaccatcatccacatctaccttcaccttcttcttcttgaaaagaagatctgcgttctgttgtctgaggccagcttttccattttgtactcagacactcttctccctaaactccagtctgcatctccttctccttccggccgagttcctttagtgtccacattgtcagtcccgaggctgactactcggcttgctggtccccctcactttgcttctgcaactttccgcgggtgagctcagtgtgctgttgcaggtcagcacagattgcatttcatagtctgttgtcttgcctggctctgaggcaacaggcagccacccaaggaggagctgctgtgtccactaagcatggagacttggtcatcccccaggcagctagccgctggtactgccttcatgcttgcaacagacggtgag

SEQ ID NO: 507246 - DNA, 248 bp, Homo sapiens
aacagccaagtatggaacggagaaggatgggaataggggggaacagtctcatcttgcccaagaacatgcaggagcctgcggctgccctgagtccatggaggccaccctcttgaaatggacgcaatgcagacccttgatgtccgtgggcaggtgcggagggggtaggtgcacggggccccgataggtgctcacactagaggacgaggtcatctcgcggtctcctgtgaatacccaccatttgcccaagg

SEQ ID NO: 507247 - DNA, 436 bp, Homo sapiens
gctctcgtgcgctctttctcttacaagcacatctctctcacagtctctctcacagtgttcgtgtgtctaatgatatgtcatgtgacacacgtatcctcctataagaggtatctcacaacgcagaagagagagtgtgatagtatatgtggggcacagacccgtagtgtcatctcacgcactcagagagtgtgctataagatatcgtgcgcttttgtgcaaatgtgctatagaccgcaacactgtgtatatattttctcatagtgtatatcccagaggtgttaaatatggtcttagtatagtgtgtccttgaagtgtagagcctgattcctatatgtctcacttctgtacctctgagagctctgccctctctctctttcctacaaagcacagagagtgaccgtacaaaaggtgtcctcgtgagtcacagctcgtgccg

SEQ ID NO: 507248 - DNA, 301 bp, Homo sapiens
  misc_feature (31)..(31): n is a, c, g, or t
  misc_feature (57)..(57): n is a, c, g, or t
  misc_feature (129)..(129): n is a, c, g, or t
  misc_feature (195)..(195): n is a, c, g, or t
  misc_feature (234)..(234): n is a, c, g, or t
tttttttgccaattgattttttttccactgngcctggcctgaagctattctttacanaagctcttagtttttgtttgtttgtttgtttttttcttttgcgacggactctctgtcgccaaggctggagtncagtggcctgatctcgggtcactgcaacctctgcctcctgggttcgggcggttctcctgcttcagnctcccgggtagctgggattgcaggcgcctgccaccacgnccagctgatttttgtatttttagtagagatggcgtttcgctttgttggtcaggctggtctcgaactt

SEQ ID NO: 507249 - DNA, 139 bp, Homo sapiens
ctgaagttggttgtgggtagcctcaccctgtctcagggtgatatctggcctaggggaggggaagggaggccacttccttctttgggcacaggaaacattggctgtggctgtccctcaaatggcggcagtctctaagagg

SEQ ID NO: 507250 - DNA, 97 bp, Homo sapiens
tcatctacgttgctgcaaacaacagaatctcacttttttatggatgaatagtacttcattgtatgcctcagagcatattggtgaccggcctgggcaa

SEQ ID NO: 507251 - DNA, 804 bp, Homo sapiens
gggccagactgtcccagaagcccaggactgcaaggaggccccctccagctacgaccactagccctctctgagctacctggactcttttgatggtgaaatgctagacgctgtggatccacaacacaagggtgacacaccccttcagaaggtgccctgggttgccgagtgtcagaatatactcaggaactccagaggtgtcccacgtggaaaattgacaggagacccgccaccgtggtaggccagggggcaaagaaatcaagaacgcatcaagagcaccagccctgggccaaggaagacaggctcttcctgcagtttctcgtgacactgctggctgtgcgggcaagttcggtctccaggtacctgtgtgtctcttttccgatgtaataactacttgtgaccttacactatatgtggctagtagttcactgagcttggtatattggaacagtttcatatagggctagagattttaaggacatgactaaactgaaccttttctggtcccaatgtgaagtggtagtgcggtgcctttccccccagatcatgtttaattcttttcctttcctgtgagaaaccaacagtttccatttatgttcaatgctaaatccaaagtcacttcagacgttggtttccacccatgtgggaaatcagcattcttaaatttccgttaagcgttgtgacttgtatgactgtcaaggtttacagcatattcaaggaagaaccacaggtgggtaccatttagcagatatctgccaattttttctattaaatttaccacacttcaatccggctcacgtggtcatg

SEQ ID NO: 507252 - DNA, 841 bp, Homo sapiens
  misc_feature (43)..(43): n is a, c, g, or t
  misc_feature (89)..(89): n is a, c, g, or t
  misc_feature (114)..(114): n is a, c, g, or t
  misc_feature (119)..(119): n is a, c, g, or t
  misc_feature (123)..(124): n is a, c, g, or t
  misc_feature (137)..(137): n is a, c, g, or t
  misc_feature (155)..(155): n is a, c, g, or t
  misc_feature (176)..(177): n is a, c, g, or t
  misc_feature (198)..(198): n is a, c, g, or t
  misc_feature (200)..(200): n is a, c, g, or t
  misc_feature (204)..(204): n is a, c, g, or t
  misc_feature (206)..(206): n is a, c, g, or t
  misc_feature (210)..(210): n is a, c, g, or t
  misc_feature (215)..(215): n is a, c, g, or t
  misc_feature (296)..(296): n is a, c, g, or t
  misc_feature (327)..(327): n is a, c, g, or t
  misc_feature (354)..(354): n is a, c, g, or t
  misc_feature (357)..(357): n is a, c, g, or t
  misc_feature (403)..(403): n is a, c, g, or t
  misc_feature (419)..(419): n is a, c, g, or t
  misc_feature (421)..(421): n is a, c, g, or t
  misc_feature (427)..(427): n is a, c, g, or t
  misc_feature (433)..(433): n is a, c, g, or t
  misc_feature (460)..(460): n is a, c, g, or t
  misc_feature (687)..(687): n is a, c, g, or t
  misc_feature (744)..(744): n is a, c, g, or t
  misc_feature (816)..(816): n is a, c, g, or t
aaacgctgcatcaacttcaccatgattcccagtagtgctggantggaaggaagagaagactggaaacacagagggacagaaggacaganagcacctccacaaacaaaccctggnctgcnccgnnccctacgtcacangctgggccctgacctgangcgggcctcccaccgccccgnnctgatctgtccagggataggntntcangnaggngtggngagggggccgggacgcaggggtagtggtcgccaggagccggagcaggtgaggaccagtctcgactaatcctttttcttgtnctctgatggatttggaggggcttcctggggntcgctggtagagctggccccctgggtnggnttggtgggcagggacgtggaggcctcctccctggtgtgtggtggtngtggtgggtgtaggtntnggcgtnagggcncctgctgctgtgggaacctcggttatnggggtggtagctgtggggtcttctctcactcatgccaaactcgttgactcgggtggggtcgacgcggtagatccaccgttggtagaggtagatgaagaaaaccacatcgtcccgcaggcagccgatccggtacataacgggcatcttgatgacaaaggcgaacaggtcgtcgatgaatgtgttgagggccttgtaggtgagcatgcgccagggaaggtgggccacanacttgagcttgtagttgatgaagagctggggcgtcatggtgatgaagccgaagtcangcaggaagccgtagagcatgctgagcacccaggagtaccagcccttgtgctccaggtacagagactgtagangcatacagcccaggaacgggaagag

SEQ ID NO: 507253 - DNA, 1543 bp, Homo sapiens
ccgttcgtgtattgtgggggcggctccttcgtatgtgcttgtccgctcgcttgtgaccggttgttgtcgcccgccctgttttttgccgccgcagggttgtgtgtgtgcctcgcctagtgtccacgtgggcgttttcccctcggaggaaattttgtgtgatgtgcggcggcccccctgggtgattcgtggtggagcccgtggggcccgagaggttgtccccaggtgcaccgcagaccccttggggggtgcgcgcctgtgatctgccgcgccgggggcatgtgcccagcgggtgtgcgcccctttctttggggccccgcccccagtatgtttgcccccccccgtgggtgctattatgcttgcgtggcttgtgattgggtgacgcctcgtgtccccgcgtggggtacccaccgttttgtcctgtgtttgtacccccggggggtgttcccccgcccaatgggccgtgttgccgtcttttgggacgccctcctgcctcctgtagccccacggattgtggtgtgacacataggtggcgccgcccctctgcgccccccatgggggtggtgcatatttaacccccatatggcgcgctgttgacgttggccccctgggtttggttctccccccgttgggctggaacacctgcgggtttccccccccacagaggagttgggttctcacatgggcgtgccgcgcccgtggttgcccacgccccgttctcgtatatcccccatcggcgtcgcacagccgacattccgcacgcgtgttatggttggtgtgatttttgggtttggccccccccccctcggggcttttccacacaggtttggcgcactctcccactcttgatctcccacgggcctcttcgcacacgctctgttgtgtgtgtgcccctctgtggtgtgtgagagacgctcttctgggccccacacagtgttatcacacagagagagagctctgtgtgtgcgccactatgctggagggcccgacccccctccacgcccacttctgtctctgagagggcctctggcggctttccccctctggagccccccacgttttgtctgagcctctgagttgtgatatcgcccacagcggtggcctctgtgtgtgtccacctcgggtgaacctgtgggttgaagcgggatttggagaggataaggccgagattttttcctcagagaggcccctgtgaaagatatatcggctccgcccctcttgaagaaagagattttattgaggcgagaggttttggtgcttgcgattctctctgttccgaaagagagagaggtggagagaagaaagagagagagaataactctattgatcccatatcctttgtggcccttgccacgccatcgtccatagctccccaggacatattccagcttccagcttcacatgcaccacgcaccgtttaagcttttctgcgttagcattgttttccccttggtgatccctgtcttttcccagggtacccgtaaaatttttccctccatatctccaagttaagtccataaccctcccaacaaaaataaaaaataaa

SEQ ID NO: 507254 - DNA, 378 bp, Homo sapiens
  misc_feature (378)..(378): n is a, c, g, or t
cggtccctgtgcgcgtgtagcccctcggcgtcgcgtggagctgcgagtcgcccgcttccggaagcgcacacgggccatgttgcggcggaccatctgccggggcggcgggggctcggcgggcagggttgcaggctgcaatctacgctgcagcctgctgtgtgctgtgcggcaaacggtcgcctagtcagcctcgcctgccactggtgcacccgggcttgcttacctggtgcagcaggcattcacatctttctcacctgcattcccactatgcactcttctataccggcacaggcagcaaggatctcagacaggcatcggggaccaagcactgcgcaagcagttccaggtataagggcagtcgtgttgtcataacagccn

SEQ ID NO: 507255 - DNA, 756 bp, Homo sapiens
  misc_feature (630)..(630): n is a, c, g, or t
gccctggggttggagagagagggcccccgaggaaccctaagggtcctccatgggcccccaggaccctccgttcagacagcgacaagctgaccttcagtggacatggaggggatctgggttcgggggcgatctggaggcccgtgtggggtcctcgaggtttcggctctggacctcccggaccccccggtgtcgcaggtctgctcggctgagcctgggcgctttgggtgtgatcaggtccgagtgtcccaggacccggccggccttctctggtgttgcgctgggcgcgcagggtcctcgcccgggtttccttggtctcccggggatcgcccaggccctccgcgtgaagatgagggtgaccccaggcatggacgtgtcgccatggagatggcgagccgtgggcgtgaagcagtgcgccccagtgacataagggggagcaacggtgagcccccgggtaccctgcatggtgctcgtggtggatgagcggacatggcaggagacccggggacctgtatggaggcacacagggccccagtggggcgcacctgggagcgcgctggggcatccatgcatgtcgctcgcagggctcttgatcgcacggtggccctgcgtcctgggggcgcgcccctgtcntgtgttgggaacggctgtcatggcgcccgaatggggcacgaagtggcactgctccggtgccctgtctgggacctcatagcgggggactcctggtcgtgccgtgtctgtgcaggggtgtcaagggcg

SEQ ID NO: 507256 - DNA, 312 bp, Homo sapiens
atcctaatgtagccaagtatggttatctgcatgtattggcatctaccagaactccctatatgaaactgccagactatgtcctggaacatttcaattacatgcacaatccaggttctacaagttggaacaagtctaattgacacacctgcataggtttaaaccttgtcctccccctacttcccaacagatttccaagtttttctgagacggaaccttgctctaggcccaggctggaagtgcaatggcgccaatctcgattcactagcaacctactgcctcctgggtaacaagtagattcctccagacctccta

SEQ ID NO: 507257 - DNA, 106 bp, Homo sapiens
aatgcagcggactcgtgcagcctcagtgcgctttcctgcgcgcactgtggagtggcgccctaatgtgtcaccaagcacactcacttaaagaaaaaacgagctcttt

SEQ ID NO: 507258 - DNA, 273 bp, Homo sapiens
  misc_feature (220)..(220): n is a, c, g, or t
  misc_feature (261)..(261): n is a, c, g, or t
atgaggcaggacggatcgcttgagcccaggagttcaaagcctgcagtaagctatgattgtgccaccgcactttagcgggagcaacagagaccttgtctcaaaaaataaaaatggtttggtccatgaacaagagttcaaatgtgtatagacaaggtgcatgtgtgacgtcaatatatgccaaaaggttagactcgtgacagtatagcaacgttattgtctnctacagctccaatattcatccgttttggccgtgcctctatngtcattttgcgg

SEQ ID NO: 507259 - DNA, 1469 bp, Homo sapiens
  misc_feature (8)..(8): n is a, c, g, or t
gagaaccnacccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttggggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaattaccaaccggtggttcctcaccctgcattaaccagccccagttccgggctgtcttgggggaagtgaaactgtgtgagaagatggccagtttggtgctcaaaagtgttgcgagacccaacctaaaaaggacaacccaggaaagagcaagggtccacggcgaagagaagcagaagaccccaggctgagcggaaggaggacgaacaaggcggctgaccctgctcctgaggaggagatggatgaatgtgagcaggcgctggcatgctggagcccaaggccaaggaccccgttcgctcaccgtgcccaagagtacctcttgctgttcgcgatgagatttaaagcagcaagctactcacaattgaggacacactctcatgtgggcactgtccaatattctctggcgcagacacgttgtgtataacggaccggacgtggtaccctggtgagtactacagacgtatcgacttccgctgaaaggaatctcaactcaagaaccttcaatgacgctgcacatcttcatcgacgtggacatattccagcagactggtacaaggctgaggacagaagtgccttacgtgcagatgtcatcctatttgaggaagccaacgaatagcagcgtccatttctggcagtctgggatcttccgaggccaaggagcttgcctttccgatgagtccagattggcacggtggactacgagtcataacaacattggcggaaaactggatcctggccagcgaggaagacccagaacgctggttcgagagtacttatccttgggagcgagggccattccagcatgtgggcaaaagcattcaagtccagggcaaagatcttcaagtgaacattctctttgccataacgctaactgccctgaacttc

SEQ ID NO: 507260 - DNA, 1499 bp, Homo sapiens
  misc_feature (8)..(8): n is a, c, g, or t
gagaaccnacccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttggggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaattaccaaccggtggctgctgagcccaaggccaaggaccccttcgttcctcaccctgcattaaccagccccagttccgggctgtcttgggggaagtgaaactgtgtgagaagatggccagtttggtgctcaaaagtgttgcgagacccaacctaaaaaggacaacccaggaaagagcaagggtccacggcgaagagaagcagaagaccccaggctgagcggaaggaggacgaacaaggcggctgaccctgctcctgaggaggagatggatgaatgtgagcaggcgctggcatgctggagcccaaggccaaggaccccgttcgctcaccgtgcccaagagtacctcttgctgttcgcgatgagatttaaagcagcaagctactcacaattgaggacacactctcatgtgggcactgtccaatattctctggcgcagacacgttgtgtataacggaccggacgtggtaccctggtgagtactacagacgtatcgacttccgctgaaaggaatctcaactcaagaaccttcaatgacgctgcacatcttcatcgacgtggacatattccagcagactggtacaaggctgaggacagaagtgccttacgtgcagatgtcatcctatttgaggaagccaacgaatagcagcgtccatttctggcagtctgggatcttccgaggccaaggagcttgcctttccgatgagtccagattggcacggtggactacgagtcataacaacattggcggaaaactggatcctggccagcgaggaagacccagaacgctggttcgagagtacttatccttgggagcgagggccattccagcatgtgggcaaaagcattcaagtccagggcaaagatcttcaagtgaacattctctttgccataacgctaactgccctgaacttc

SEQ ID NO: 507261 - DNA, 2137 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggtttgggaagccagtctggagagcagggcctggctgaagggtggccttaccccggcagatcccttgtgccttccctctgtctcacattcgccttccttctccctgctccttttccctttccgtcctaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 507262 - DNA, 1116 bp, Homo sapiens
  misc_feature (8)..(8): n is a, c, g, or t
gagaaccnacccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttggggcatcatgcaccacaagcagaagaccccaggctgagcggaaggaggacgaacaaggcggctgaccctgctcctgaggaggagatggatgaatgtgagcaggcgctggcatgctggagcccaaggccaaggaccccgttcgctcaccgtgcccaagagtacctcttgctgttcgcgatgagatttaaagcagcaagctactcacaattgaggacacactctcatgtgggcactgtccaatattctctggcgcagacacgttgtgtataacggaccggacgtggtaccctggtgagtactacagacgtatcgacttccgctgaaaggaatctcaactcaagaaccttcaatgacgctgcacatcttcatcgacgtggacatattccagcagactggtacaaggctgaggacagaagtgccttacgtgcagatgtcatcctatttgaggaagccaacgaatagcagcgtccatttctggcagtctgggatcttccgaggccaaggagcttgcctttccgatgagtccagattggcacggtggactacgagtcataacaacattggcggaaaactggatcctggccagcgaggaagacccagaacgctggttcgagagtacttatccttgggagcgagggccattccagcatgtgggcaaaagcattcaagtccagggcaaagatcttcaagtgaacattctctttgccataacgctaactgccctgaacttc

SEQ ID NO: 507263 - DNA, 1474 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacgaccgggaggagatgaggacgaggagcaccaacgggtacgtggatacagggtgttccggaaaaagctatgaccgatgctgccgctgggagggcgctagctg

SEQ ID NO: 507264 - DNA, 162 bp, Homo sapiens
ccgaggaggtggaggtgtggcagaggctgggggacaacacaggccagggagaaagaggagacagaggaagcaccgagtgtgacttacgttgtcttccctagatcaattttcttctggatggctcgtcgctgagtggtagattgagcgaatcgagtgagtcca

SEQ ID NO: 507265 - DNA, 146 bp, Homo sapiens
ggggaggtgtgctgttgtgcttgtctaaaccaaagcaattcccactgtccctgtgaaatttcaaacctctcccatatattcagtgacattaatctgaatggcatctttttggcttaatcatattttgccttgtttctttgttaact

SEQ ID NO: 507266 - DNA, 1336 bp, Homo sapiens
ttccacatcgtccccggccagagcatcctcggttactgaggtggcgcgtcccgttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 507267 - DNA, 358 bp, Homo sapiens
atgattctactagctccagtttcctgagtagctgggattacaggtgcatcacaatgccgggtaatttttatattttattagagacgggatttcgccatgttaaccaggctggtctcgaactcctgacctcaggtgatctgcccgccttgccttcccaaaagtgctgggattcacaggcatgagcaaccgtgcctggcctttattggcttagtttttaacatttatccctccaaaaacattttggggcctttttctcgtgggggcaacacagttgaagctgctctatcagcattagacactaacctttatccccatcatttcagtcaaccactcaggtattgtttcaccttcttgaggt

SEQ ID NO: 507268 - DNA, 428 bp, Homo sapiens
  misc_feature (18)..(18): n is a, c, g, or t
  misc_feature (108)..(110): n is a, c, g, or t
  misc_feature (134)..(134): n is a, c, g, or t
  misc_feature (174)..(174): n is a, c, g, or t
gtggctgggcttcggccntcatggcggggcgcagggcttcacctccaaggcggatcctcagggcagtggcggatcacggtgcggtgatcgagcacctggagcgtctannnttgtggacttcggcagccgcgagngttggcgcgactggagaaagctatcgccttcgccgaccgntacgcgccgtggacacagacggggtggagccatggaatcggtcctggaggcagatgtctatacctgagatccgacaatgtggtagaaggcaactgtgcctgatgaattactacaaaactcccatcgcgtcgtggaaggagtacttttgttggccccccccaggtaatatctcttttgccaaagctggattgaacaagaagccattcccacacagcttgagtagctcattcttggaaaggggggtactctggtga

SEQ ID NO: 507269 - DNA, 2005 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccggtttggtataaaggggaggagacccagtcatcgtagctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 507270 - DNA, 129 bp, Homo sapiens
ctagaggatcccggctatacattatcatatagtatcaggtttactgtctgtgcttgttgtattttaggacagaggcgggctttcagatacagaaatcacctgcgctcttgaaaagtaagggatggaagt

SEQ ID NO: 507271 - DNA, 2044 bp, Homo sapiens
  misc_feature (1045)..(1045): n is a, c, g, or t
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagaattggggggggnttggggggaaaaaaccttttggggggttggggaaaactgggagatcccgggagcctgctcaccgagtttgcgctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 507272 - DNA, 1284 bp, Homo sapiens
cggtaccctttggcacgcagaatgggtggtgaggagatggagagaaaggtgggcctgagtttctaactgctacacttggctatatggatgtgaactgaagagctcgttgaacttggctgtttcctttccttctcctctccagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 507273 - DNA, 172 bp, Homo sapiens
gccagaacacaggtgttcgtgaaaactacccctaaaaggccaaaattgggaaagggaaaagtatcatatcaacattgttcggtcattgggacaaggaggattcgggcaagtcccaccactacttggccaactgtatcttattaaatgccggtggcatcggacaaaaggaccc

SEQ ID NO: 507274 - DNA, 177 bp, Homo sapiens
gattccattcgtgaaaattttcctataccctgaacagtccacttatcaccactgcgacctattgggaactaaccgaattcaccatgttactcagattcgctacaccaaattccgataaatctctagaagtacacatattacaagagcctgctactgagaactaactgaatcccaccg

SEQ ID NO: 507275 - DNA, 1958 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacaggactctgagatggtggaactggtggaactggagatccgggagctgctcaccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 507276 - DNA, 229 bp, Homo sapiens
tttttttccccccccccccccccggggggggggggggggtgggggggcacaatttttttccccccccccccgggtaaaaaaccccccattttgccggggcccaaattttttttttaccccccaaaaaaggtggggggggggggtggggttttttccccccccccttttccccctggggttggtttttcccccccttttttttaacccccgggggggggggtttttttta

SEQ ID NO: 507277 - DNA, 1881 bp, Homo sapiens
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagtttggctataaaggggaggagaccccagtcatcgtaggctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 507278 - DNA, 1583 bp, Homo sapiens
  misc_feature (9)..(9): n is a, c, g, or t
  misc_feature (70)..(70): n is a, c, g, or t
acgaagagntacaggtcgatactctgtgttactttaatgctgggccagcgtttaagtgctcgattagccntgtcttcagctgatcaagtccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccggtttggtataaaggggaggagacccagtcatcgtagctctgctctctgtgcccttgagggtcgggaccctgagttaggcctgaagtctgtgcagaagctactggatgctgtggacacttacatcccagtgcccgcccgggacctggagaagcctttcctgctgcctgtggaggcggtgtactccgtccctggccgtggcaccgtggtgacaggtacactagagcgtggcattttaaagaagggagacgagtgtgagctcctaggacatagcaagaacatccgcactgtggtgacaggcattgagatgttccacaagagcctggagagggccgaggccggagataacctcggggccctggtccgaggcttgaagcgggaggacttgcggcggggcctggtcatggtcaagccaggttccatcaagccccaccagaaggtggaggcccaggtttacatcctcagcaaggaggaaggtggccgccacaagccctttgtgtcccacttcatgcctgtcatgttctccctgacttgggacatggcctgtcggattatcctgcccccagagaaggagcttgccatgcccggggaggacctgaagttcaacctaatcttgcggcagccaatgatcttagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtaagcca

SEQ ID NO: 507279 - DNA, 663 bp, Homo sapiens
atagcaacccagaatgtaaaaaagaaaaaactggggggaaacaagaccaggtctacagtgactagagcaaacgcaaaagaaaaacagaaacagaacaacaaaaaaaaacattgtgttgcgacgcgccatgggcccccctcgagaaagagccttcttataggaaccacattgtgggtgtgagggagcggggagtgaccacaatgaaagacggaagcaaacagagaggtgacagaaagcaaaggtgggggcaacaacaagccgtggtgacccaacaaggagaaaactccggggaacaaaagagcagatgagagggcggggagaatactccagacatagtataaaaacaacgcccgcgggggaaaacacgagagggatgttgaaacaaacacaccaacagaggagcctacggagggccaatagagggggacctacatcacaagcggaggagtgccacaagcggagacgcgacaattacagaagaattgaaagccccgaagccgggggagacaaaacaagcagccaaatagaaacagagaaggaaagagaaaagaaagccaccagcaacaacagaaggaaaagtaacagacacacacaaagcaggcaggatagcaagaaaagataaacagagaagcgaatagccagaaaaacgaaacaacagaaaag

SEQ ID NO: 507280 - DNA, 651 bp, Homo sapiens
agtaaatcgtaatcgccatccagtcacagacgttctaactgaggtgcattgtaaatccacttcgaccttaatgtttcataggggctatcggagttcctgatgtagaaaatgtagcccatttcttgccacatcatgggctacaccttgacctaacgtctttacgtgggtacttgcgcttactttgtagccttcatcagggtttgctgaagatggcggtatataggctgagcaggaggtggtgaggtcgatcggggtttatcgattacagaacaggctcctctagagggatatgaagcaccgccaggtcctttgagttttaagctgtggctcgtagtgttctggcgagcagttttgttgatttaactgttgaggttaagggctaagcatagtggggtatctaatcccagtttgggtcttagctattgtgtgtccagatatgttaaagccactttcgtagtctattttgtgtcaactggagttttttacaactcaggtgagtttaagctttattggggagggggtgatctaaaacactctttacgccggcttctattgacttgggttaatcgtgtgaccgcggtggctggcacgaaattgaccaacctggggttagtatagcttaattaactttcgttattgctaaaggtcaca

SEQ ID NO: 507281 - DNA, 172 bp, Homo sapiens
aggtgagaatgtaaattaatactatagaaaacagtctgattactgaaaaacctaacaagagaaatatgacataacccagcaatctcactactggatatctatctaaaggaaaagatatcagtatactaaacatgtacctgcatccccgtgttctttgcaacacggtctctca

SEQ ID NO: 507282 - DNA, 1367 bp, Homo sapiens
  misc_feature (1345)..(1345): n is a, c, g, or t
gagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagattctagctgagggaggtggggctaagttcaagaagtacgaggagattgacaatgccccggaggagcgagctcggggtatcaccatcaatgcggctcatgtggagtatagcactgccgcccgccactacgcccacacagactgcccgggtcatgcagattatgttaagaatatgatcacaggcactgcacccctcgacggctgcatcctggtggtagcagccaatgacggccccatgccccagacccgagagcacttattactggccagacagattggggtggagcatgtggtggtgtatgtgaacaaggctgacgctgtccaggactctgagatggtggaactggtggaactggagatccgggagctgctcaccgagtttggtataaggggaggagacccagtcatcgaggcccgtccctggccttgaggtcggacctgaagttagccgaagtcggcaaaagctacggatgcggggacctattcatgccccgaccggaaaacttcggggcagtggagcgcgtacccgccggcgggccggggaggcactaaggggctaaacggacggggcccgaataaaaccctgggctatcaaaggggcacggacacgggcacaaaagctaagagagagcaggcgtcatacgggngtctgcgaagggccgcggcgat

SEQ ID NO: 507283 - DNA, 151 bp, Homo sapiens
  misc_feature (88)..(88): n is a, c, g, or t
  misc_feature (138)..(138): n is a, c, g, or t
ggagtgaacaccagaacacatgacagaaagagatagagcagtctgcagctctagaaggaggggcaggcagctggctctgaggctcgangtatgccccctgtgtggagctggggcagcggggcgggcagaccattcatngcagcaggcagtg

SEQ ID NO: 507284 - DNA, 166 bp, Homo sapiens
tccatattcaagcactttctaagttacgataatgacatttcaattccatatacgcattactagaatatatatttttaaaccagagtgggtcttaaaaatatacttggaaccctcggagtctccatggccagaaccgggtggccatggacttccagccaaaggctcc

SEQ ID NO: 507285 - DNA, 448 bp, Homo sapiens
  misc_feature (5)..(5): n is a, c, g, or t
  misc_feature (14)..(14): n is a, c, g, or t
  misc_feature (94)..(94): n is a, c, g, or t
  misc_feature (125)..(125): n is a, c, g, or t
agggnaaaaggaanaatgcctgaagtacgccggaaaacctttttccaaggggtatgaattttttaaaaccaaagaaaagcctaaaatggttccncgtgtaaacgtaaactgaataaaagtttggnctgtgtccccccaccccaaatccttatccttgaaactgcagctccccataatccccccaggtgttgtgggagggaccccagtgggaggtaattgaatcatgggggtggttaacgcccatgctgttctcgtgatagcgagtgagttctcacgagatctgatggttttataaggggctttccccctccttcgctctgcacttctccttgctgccatgcgaagaaggatgtgtttgcttccccttctgccatgattgtaagtttcctgaggcctccccagccatgttaaactttgagttaattaaacctctttcctttataaatta

SEQ ID NO: 507286 - DNA, 933 bp, Homo sapiens
  misc_feature (2)..(2): n is a, c, g, or t
anagaggcagaaaagggtatctagagacgggtgtcctgcgttcggtcttgtgccacatagatgtcgcctcgtgttgtcttagaacgtggtgttcaccgtatgtttggccatactcttgttggttgctttcacctacacggtggggggttcccgtcggcgccttatttttgctccctaccacgtgggcttctttggggaaaccaatttttatcccccaccgggtgtctcgcccccggcccgtcctcatgttgtggccccgcctcggcccaatttccaggggtttcaagcaacctcgtgaaccatcctgggtgtttcccatccccccgggcgctattggtcatccagggggctgggggcacataaccccaacctccgctcatgggtgggtccgtgctctcacagcagtcccaaagggggtgtaatattcactcgcctgtctcacaagagcgccccacatttttggcgaagtcccccccattccccttgtaagttgggatgcgcaccctctcgaaccttaaggtaggctccctggcacgccttgcgtgccaccgcagtcccgtgtgagcggtgaccccccttccccagatggggctcccccccttccgcggagcgttccaagtcgccccactcccctccctagggcgacagtgaaaccaccccaccatcacggggaagtacgccctctcccgggggaccccaactcagtggccctgctgctccggagaaagaactgccccacccccggggcggtcttaaaccaacgcccgcgctgcgtccatgcaggggcggctcctagatttcacagacggtcgcacacaccactcgggccacaacaaaggctccctgcccagatacgtcgggcgccggacgataccccacaaacaccactttccaccgccccccaatataattccccccccgccaaaaataaca

SEQ ID NO: 507287 - DNA, 125 bp, Homo sapiens
ctcctattcttatcgggctccaaaaaaacgccaaaaggggccaaagccaagaaaaaattttgttcaaaaaaattaaaacccaggggtaagggttaaaggagaatcaaaaataaaatcccggttta

SEQ ID NO: 507288 - DNA, 168 bp, Homo sapiens
cccaaataaagtataggcgatagaaattaaaacctggcgcaatagatatagtaccgcaaggcaaagatgaaaaattataaccaagcctaattatagcagggactatccctatacctacatgcataatgaatttaactgaaataactttgcaaggagagccaaggctag

SEQ ID NO: 507289 - DNA, 144 bp, Homo sapiens
gcaccttgtaatcccagctacctttggaggctgaggtcaggagaattgctcgaagccgggaggcggaaattgcagtgagctgagaattgtgccattgaagtccagcctggattactgagctagacataggtctcaaagaaaatc

SEQ ID NO: 507290 - DNA, 632 bp, Homo sapiens
agcggggcaaaccgtttgggtccttctcggtaccctggtggcttgttgtatttgctctttgcaatagatcttgttgccgcttgctctttggggcctcactgcctttatgagctataacactccccgcagaggtctgcagcttcatgcttgaagccagcgagaccacgaacccactgggaggaaccaacaactccaaacgcgccacctgtaagagctgtaacactccctgtgaaggtctgtggcttcactcctgaagtcagcgagaccaggaacccaccggaaggaatctccggacacaaagaactgcaacactcacccgagggtctgtggcttcattcttgaagtcagtgagattaagaacccaccggaaggaaccagttccggacgtgccgagttcaagcaatgagtcctgcctcagtctccggagtaactgggattacaggtgcacgctgccatgcccagctaaatttgtattttagtagagtcgaggtttcaccgcgttgcccaggctggtctcgacattcctgagcttgggcaacccactcacctcggctcccaaagtgctaggataaacaggcgtgagccaccaggccgggcccgtatggtggtttctactccggactgactctccc

SEQ ID NO: 507291 - DNA, 546 bp, Homo sapiens
acgctgctcacatagaaggatagtatcctgattgtgaaacttaagctcttacccattgccaaaatcaatattggggatgtctctgtaacatagtttacgatgagcctggctttttttttttttttattggggaggcaaattcttgtcctgcccccctggctgaattgcagtgacccgaaatcaccccattgcactcaaccctgggcaacagaccaagattctgtctcaaaaaaaataaaaaataaaaaaagaaagaaaaaaaaagaatgtgattccagaggctgacatgtttggtgaatcgccaaaccagcgcttagataggaacccttccgggaaaactctgcgatccaggttggtgcatgtgtgcccccctcaggtgatgataaccccctttgtcaaggaagagtggtgtaatgggttattacgccagagcaaccggggagagccaagcagccttgatgttgcctcagccagaccccggggtgcatttcgggtcctccccccactgtgttgcccttgctcctttttaaaccctctttgccctca

SEQ ID NO: 507292 - DNA, 110 bp, Homo sapiens
tggggtttttcccagggacccctataaaaaacccaaagggttttgtgatgggggccccctgttcccccaaaaactaaggttttaaagggttccctaatgggaaaaaaaaa

SEQ ID NO: 507293 - DNA, 344 bp, Homo sapiens
  misc_feature (149)..(149): n is a, c, g, or t
  misc_feature (152)..(152): n is a, c, g, or t
  misc_feature (246)..(246): n is a, c, g, or t
  misc_feature (268)..(268): n is a, c, g, or t
ctgatctggtaagtttttaagtttcttgatacaatcatatagaattcattgtctaaaatttttattagcaatgtccttacatgattgtccttacatgattgtttcttatatgattgtttctaagcattaagcaaattatagtaaaattnctncctaaaatctgttatacattggataccatgtgagtctacaagcttaacaatgacggttttctgcctttctgacttatgtctcatactattaagnaagtataattttgtaaaaaggnaataatgtgttagaagaaagtatgaaaggcaatgctagcattattccaggctagtaagtactcagtaagtaaatct

SEQ ID NO: 507294 - DNA, 227 bp, Homo sapiens
  misc_feature (145)..(145): n is a, c, g, or t
tacacctagctaagttttggctttctaaatatcatttcctacgaagaggaaccagggctcctgtgaaaaaagtgctgattacagttccagggcagagaacatacaaggtaagcttagaatatctgtgtaccagaaagtagactangggagatacactatgatataggagtgggttcccacaggtcaaatttaggacaatctgaacatgaagaagataatcctagtaa

SEQ ID NO: 507295 - DNA, 208 bp, Homo sapiens
agaaggatgcctgtggcctcggagacacagtgtcaggcaacggaatcccagagccgcagtcttacgccccgcctcggcccaccgaccgcctggccgtgcgcccttcgcccagcggagcgttttccaccgtttccagcccaatgtttcctgcacgtgcaactgcaaacgctctttgttccagagcatggagatcacggagctggagttt

SEQ ID NO: 507296 - DNA, 480 bp, Homo sapiens
tcgtacaagaaagagatggagaaactggtgagggttcgactgggtgtccacccacaggctcagagcctgcacgatctgccgttctttcgcatcaagaagttgatctagcgagccatttccatgttgtagatccgccggcacctttcatagctttccctctgtcgccggcggcatggcttctcataataccggcgatgctcaatgtcctcaatgagcccatccatagtgaggattctgtttagggtcctgtatgcggctttccacgttcccttcctgtaccatcacagtcctggcgatgaacttcagatgttttgccatgaccttggatttaaaccttcactctgtagagcctaaaggatgatggagaaagggcgaggcaagcagaaagagaaacgcaacataatacaaactacaccgcgcgactaatttaggaattggaactccagatgctcagggacggcgagatggagacatgaagtc

SEQ ID NO: 507297 - DNA, 315 bp, Homo sapiens
tgagctggtccgaaagccgagcatacactagcacgtggggatagggatcaagacagatacgcctaggcaagaagtctgactgccttagaactaactctaatagagcccgggcacgggaaggggtaagagagatcacgctgactagatggttacagatcgcggtggggtaccttactcgagaccacaccagaaattagctacacaacaggatcggaaccgggcgtcgtcgctacccagccttagaccctttccccacagatgttcaccggtagagctctgcaccacaacttcttgccaaggattaccctttcgtgg

SEQ ID NO: 507298 - DNA, 793 bp, Homo sapiens
  misc_feature (12)..(12): n is a, c, g, or t
  misc_feature (81)..(82): n is a, c, g, or t
  misc_feature (140)..(140): n is a, c, g, or t
  misc_feature (154)..(154): n is a, c, g, or t
  misc_feature (156)..(157): n is a, c, g, or t
  misc_feature (167)..(167): n is a, c, g, or t
  misc_feature (191)..(191): n is a, c, g, or t
  misc_feature (207)..(207): n is a, c, g, or t
  misc_feature (226)..(226): n is a, c, g, or t
  misc_feature (240)..(240): n is a, c, g, or t
  misc_feature (249)..(250): n is a, c, g, or t
  misc_feature (254)..(254): n is a, c, g, or t
  misc_feature (269)..(270): n is a, c, g, or t
  misc_feature (284)..(285): n is a, c, g, or t
  misc_feature (303)..(303): n is a, c, g, or t
  misc_feature (305)..(305): n is a, c, g, or t
  misc_feature (312)..(312): n is a, c, g, or t
  misc_feature (316)..(316): n is a, c, g, or t
  misc_feature (328)..(328): n is a, c, g, or t
  misc_feature (331)..(332): n is a, c, g, or t
  misc_feature (346)..(346): n is a, c, g, or t
  misc_feature (351)..(351): n is a, c, g, or t
  misc_feature (360)..(360): n is a, c, g, or t
  misc_feature (363)..(363): n is a, c, g, or t
  misc_feature (367)..(368): n is a, c, g, or t
  misc_feature (376)..(376): n is a, c, g, or t
  misc_feature (383)..(383): n is a, c, g, or t
  misc_feature (396)..(396): n is a, c, g, or t
  misc_feature (401)..(401): n is a, c, g, or t
  misc_feature (404)..(405): n is a, c, g, or t
  misc_feature (408)..(408): n is a, c, g, or t
  misc_feature (411)..(412): n is a, c, g, or t
  misc_feature (414)..(414): n is a, c, g, or t
  misc_feature (427)..(427): n is a, c, g, or t
  misc_feature (433)..(433): n is a, c, g, or t
  misc_feature (444)..(444): n is a, c, g, or t
  misc_feature (450)..(450): n is a, c, g, or t
  misc_feature (452)..(452): n is a, c, g, or t
  misc_feature (459)..(459): n is a, c, g, or t
  misc_feature (463)..(463): n is a, c, g, or t
  misc_feature (473)..(474): n is a, c, g, or t
  misc_feature (482)..(482): n is a, c, g, or t
  misc_feature (484)..(485): n is a, c, g, or t
  misc_feature (502)..(503): n is a, c, g, or t
  misc_feature (505)..(506): n is a, c, g, or t
  misc_feature (508)..(508): n is a, c, g, or t
  misc_feature (535)..(535): n is a, c, g, or t
  misc_feature (538)..(538): n is a, c, g, or t
  misc_feature (543)..(543): n is a, c, g, or t
  misc_feature (546)..(546): n is a, c, g, or t
  misc_feature (558)..(558): n is a, c, g, or t
  misc_feature (563)..(563): n is a, c, g, or t
  misc_feature (578)..(579): n is a, c, g, or t
  misc_feature (582)..(582): n is a, c, g, or t
  misc_feature (589)..(590): n is a, c, g, or t
  misc_feature (645)..(645): n is a, c, g, or t
  misc_feature (729)..(729): n is a, c, g, or t
  misc_feature (781)..(781): n is a, c, g, or t
ttggcttctttnattggttaacagccaaactgtcacaggcagaccgtctgtttcccaccccttcaaacgctatgtgttttnncccttcttcccaaatccggtatatacccccccccccccctcgtgtgtgccggccagcngtcatacacagggngnngtgtcctggnttcttcaagggaacacatattggnatgggggttgggggtnggcgacgggttggtggttngggggggttgggtnttaagatgnnacangggccaggggggtanngtatggggggctgnngggggcaggggggggggngngtgcggntttngggggggggggnttnncgggggggggaatnggggnggtggggtnggngggnngggggggntgcggcngggggtcggggcngcggntgnnggngtnngngtgagggggtggngtttgncccgggtgggntggggngngggggcngggngggggctttnnaacatttntnnctttaccccttttgggnncnntntatctcccccaccccccaggcgactgnttnggcgnggnccgggggggggngggcngcttttggggttggnnacnttatttnnctttctatggcaagactgtcatggagcctggatatttcaggctcatatgcatccntgaccagtgtcccactgtggtcaaaaaacttagcaatggactttgtgaactcggcttcccgctgctgctttgttctcccactgntgaaggtcagcttccaggtgtatttgtcatcaaaccttttaagactggaggncagctgccaaat

SEQ ID NO: 507299 - DNA, 1039 bp, Homo sapiens
  misc_feature (692)..(692): n is a, c, g, or t
  misc_feature (897)..(897): n is a, c, g, or t
ggtgcagcgggggggcccgggggccctgtgtggccctgtagatgggtgaacctgcggtgtgcttcctgcggagggtttctggcaggtgagcatcctgggtgcctggggatcggcggccggtgcgacggtggctcggtggcgcgatggcctgctgggagcatcggcgtgagtgcaatggcctgacggtatacatgtgcagtgtgtatgccctgtcgagccaacgtttggcgcctggcttgggtccaacgggaccattcgaagactcaattgtccccttgtgacggacgaatcgtaagtcgtcttcgtccacgtgcctctaattaaggtgaactcacgaagactcgattgcacgtttcttcgcgtggcgagcgctcttctctcgaagcgactgacgcgtttgtgacagacttagtgcccacgtgccgagagagcaggaacccgttgcccgtgccaagcgacaccaaggttcaagggacattgtgttcgcatatcgggggggactaacaagtgtgccagcgtcgcgtcatggagtgttacagtggctccaatggacgtgtggcccaccgggcaatcgcgtgcgggcccatcaatccgtggcgcaaggctcttccaatcggtccccagtgctgcagaagcgctactgggcgggaaacaaggattcgggcaaggcccacacagctggtccctttgcnaatggttgacaagggccgcttgctggctcgtgtgcctggtactgccttcaatcccttgcagctcaggtggcactggggcatcgtcctccgaaccttgtgccttaagaagctgctcatgatggcctggtatcgatgactggtaaactcaaggccggggcttgactggctaccttggcaacttcggcaaggcacctttgttgccgtntctaagaacctacaggtactgtaccccaacctcggaagggactcgtttcccaagttccaatagaagtcatgagcactgttagagcccacaagtttcgcgcagggagcagccaccggggccacaaggggcttccaaaaaatgg

SEQ ID NO: 507300 - DNA, 608 bp, Homo sapiens
ctcaactggcgcgtcctgagcaacccgggctatactgatgcctctgcctatagattgcttaacctagtctattcgcctgatacttatagcccagtagttatctaagtgcaagtcactatcctttaatactaatcaccacttacagtgcaccacatatcagcactgaactgtttaataaactcacttctttttttcatggatagggaaattaaggctagtaagctcaagtgatttcatccaagcacaaccagcttagaattcagtcagatataaaatttgcacatgtgggtctttctggccacaagatatatctccttttggccatgcagtccttatctattaccacaccaaaaggtcatataaattccattgctataggcaatttttacaatatagcatctcccttaacacaagtgaaacatttgctaggacttggaaacattataggggattgaaaatttcctttgatcatgtaagatttcacttgtacagcttggatatacatttctccacgtgccttttctacaggcttcacatctgtctattccttccttactgtgtcatccttaccctttttccttctttatcacttttccccttcactatta

SEQ ID NO: 507301 - DNA, 331 bp, Homo sapiens
tttaaaaaaaaatttttaccattttttggggggggaacccggttttttggcagacccccccgggtgggtttttttaggataaaaacccccccccctcttggggggggggttttttttttttttttttttgggttttttggggaggaccggcttttgttttaaaggcgggggtttccccaaggtttttttgggccccttttagggggggccccccccttttggggggtcccttttttttggggggcccccctttttaggaagtgggtttaagtggggttcttttttttttttcctgggtttgggtcccccaattaattttggggggccctta

SEQ ID NO: 507302 - DNA, 107 bp, Homo sapiens
ggtaccttcccctatcgaccgataactcgactacctaaccacgacattccaaggagtcgacgtggacgagttccctctccttagtgtcaccccggtggcggtcaaag

SEQ ID NO: 507303 - DNA, 799 bp, Homo sapiens
aggctaggagaattcgagactagcttgggcaacacagcgagcccccatctctacaaaaaataacaattagctgggcatggtggcactgcgcctgtagtcccagctactcttgggaggatcgcttgagctgggaggttgaggctgcagtgagctatgaccatgccactggcgttccagcctaggtgacagagcaagaccctctctctaacataaagttggttaaaaacattacgagaaaaagcaaggtgagtcagttctccaaggaataagtcttgagaaattggttgtctcccttttgaaatgtcaatgtatttgtatgggaaaatcaaagactacttgtacaaggacctgaagtaaaagcatgtctccttttgtaacaaaaccttgtgttattcatataattacgttcggcatgaaaggaacgggtagtagtttgtgaatagtctatggaactagcaagagatggcgagggaaagtgtcaggatcgtgacaacaggaattaatttaaacgtctttaaaacctgcgtttagtaacggccattaatttttgctaggtgacagtcaaacgaaataaatgttctaatttctgtgcagactacccagattgtggcatgattattgcccttggttgtttatccactgaaccaggggaataatggtgctgaaggggcgcccaaggctcatctaaggaccgaatcttttgttgaccttgcggggattcaggtccccaaccttgcttggggcagtttggacctctgaaatatttctggggtgaaccgggtcccaaaagctaatcccc

SEQ ID NO: 507304 - DNA, 396 bp, Homo sapiens
gggggtccttgcaggtgtccggagactctgtgggcaaggaaccccaagtgtggagtggaccagcaaggccaccagtagctttcgtgaaacatatgacctacattgcttatggaggtattgttaatgctaagggtccctgaaaccatcagaataatgtgaagttcaagttaaatagtgttgcctattttcatgttgaattacatattctggcatatgttattttgaaaacatatcaattgtggtaccagacaccagtatatgtccatgttacttcaggcctccagcactcttgatgccaattcggacaatattgatatgagggtgtcagacagtcaatggaattattacagatgtatgttaactattttctgctcaatttgtgcgaagagtcgacgc

SEQ ID NO: 507305 - DNA, 218 bp, Homo sapiens
tccctgattgcccatgacccaccaatcacatgctatcatatatgtaaaacccagcccatgatccctaacagggtggcatcgtgactgggggggccagtcagtcgacgagacataggtgcatcgtgactgggggatccatcctatcatgtcagatccgtgcattgtgcagtgcataggcattggcagcgttggccggtctgttttacaactgtctgtga

SEQ ID NO: 507306 - DNA, 105 bp, Homo sapiens
aaactgttgtgtggtgtatgtggtgtgtgtggaagcctggacaatgtctcagcaccctcccacacacaccacaccacaccacacacacacacacacacacaattc

SEQ ID NO: 507307 - DNA, 103 bp, Homo sapiens
ccaaggtcgcaccacggaactccagcttggcagcctgggcaacagagcgagactccgtctcaaaaaccaaaacaaaaaacaaaaaaacttacctttagtgagg

SEQ ID NO: 507308 - DNA, 142 bp, Homo sapiens
gtaagtaacatgtaaacgttgtcctccgcattagcccgcgtcagattaggacactggactgacaatttacagcccaatatacacaatcaaccatacatagtcattattaccctcactgtcaacccaacacaggcatgctcat

SEQ ID NO: 507309 - DNA, 566 bp, Homo sapiens
  misc_feature (531)..(531): n is a, c, g, or t
taggagaaagccggcagggcagggacatggtcctgagtattttccagatagcgtcggaagatgaaactgtctatcctgggggtgttgatgacaaatctggcagccataaagatgattctatgatgctataatttttgaaatatttactgtagaattttgtccaccctccctgtccacatacacactagcttaggttaattagaagagcaaacagaattaacagtggcatcatggtatctggttgggtcttagagtagcttccatacccaacaagcccacaggagatgtttcccaggaggaggtggctggttaaagccatagaaaggaagtactacagtcaggaagaagagcaagatcaatgctcctattcccatctacagcattacattacctcttctggctgagtgttgattattttaaataggtagcagaggtcttccaaagctttactgatattggttgtggttgtagtgcccttcctttgtgcctgtgactcataagaaacaggtttagtcctggatctgtgtgccncagtaggtgttccctgaagtttaacagcagtgggg

SEQ ID NO: 507310 - DNA, 286 bp, Homo sapiens
gtatgaattgcacgatgaagacattcggctcaagtacacctttgatcaggccacaggtgggactgcgccatttgaaacacactcagatactcacgctttgggcctcttaaatgttacttctgaacagctcatggtagatgaaggaatggctcgggaagtcatcaatcgcatacagaaacttcgtgaaaagtgcaatcaggtttccactgatgaaatccccgtgtactataaaaccaagtctgaaggatcatatctgaatagtgttattgaaagacaccccgagatc

SEQ ID NO: 507311 - DNA, 343 bp, Homo sapiens
caggagtcagtgtcagttatagtttctacgcgggcccttctcctgtgtcattgtattacaacatgcctctagaaactgttgcaagctttcacatgtgtcgctcatgatcaggtcctatggtactccataagacgtatacccacaggtatccgtttaatagtctggaatttccagccttggaaatagcgtagctctattgtaacccacttaatacttagactgtatctcgactggctaacatcagaccccagtcggtatagcagccggttgtgatctcttggatgcacacggccctataagaaccggtactactgtattgtcttctgcgcgctaggcatatact

SEQ ID NO: 507312 - DNA, 783 bp, Homo sapiens
  misc_feature (192)..(192): n is a, c, g, or t
  misc_feature (281)..(281): n is a, c, g, or t
  misc_feature (283)..(283): n is a, c, g, or t
  misc_feature (296)..(296): n is a, c, g, or t
  misc_feature (301)..(301): n is a, c, g, or t
  misc_feature (393)..(394): n is a, c, g, or t
  misc_feature (403)..(403): n is a, c, g, or t
  misc_feature (473)..(473): n is a, c, g, or t
  misc_feature (540)..(540): n is a, c, g, or t
  misc_feature (543)..(543): n is a, c, g, or t
  misc_feature (549)..(549): n is a, c, g, or t
  misc_feature (579)..(579): n is a, c, g, or t
  misc_feature (614)..(614): n is a, c, g, or t
caccgccggagtgctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctctggccgagggcactgctcctcggtgcnttgctgctcgggcgccgcagccctgcagcctgccagcctcccccggcctgtgcccctcccccgtggagccggcttgtccgtcggctgcncnactgccctgtgcnggcangctggctggagccaggcagccccgctggcggccgagcgcgctcgcgcatcgggccctctggccttctttacctagggcagcccgctgccccnngtgcgaggngagcggtccttaccgagacccgcccggcccggcggtgcgatgagcttcttcggcttcgggcagagcgtgnaggtggaaatccttctgaacgatgcagagagtaggaagcgggccgagcacaagacggaggacggganganggaganatatttcctcttctacgacggggagacggnctccgggaaggtgagcttgccctcaagaacccaanaagcggctgagcaccaggcatcaagatcgagttcatcgggcagatcgaactctactacgatcgcgggaacaccatgagtcggtgtcctgggtgacggactggcccggcctggagagattacccagtcgcaggccttcgactttgacgttaccacgttgagagccgtatg

SEQ ID NO: 507313 - DNA, 1120 bp, Homo sapiens
ggagcagtcgtgcattcccagcctacgcctacgggtgtagggatatagcatagaaaagcaaaactacacagctctatgacttgtgtagtatatcagtatatattaggcattagaggctacacctgatatcatgtacggacgatgtgtcagaaaaaaccaaactctaccataagagacgtacgtaatacaagcagccaacctatgaggctaaagtccgcacccttatttcatggcactctttgcagcaaatcagcagtagcctagcaaaggatgacaaactacaagcaccgacgtataacgcagccgtacacaaaagacgtacgcaggctaactaggacgggtacagtaccggccaacccatataagacggactacaccatacagtaggtaaacccaagaccctagacggcaggacgctggacaccagggactgcgacaagagtggatattaccacttatccacttcatggcctcgtgcgtagccagattctacctttataggctgaatgtgcctgctgccttaaaagtagcacgaatccaccgaccgttgcactaaacggcaaaaccaggttgcggaccggacaattgcgccatggaaacagccaacacaaaatgggaaatcagggaacaaggccgaacaaaaggaaacaggcaggaagcaaccgaacgtaggaaaggcaagaagcacgagcaaccaaccacaaaacaaacggcaacaacaggaccgtggcagcaaaccatggacacccgatgcagacaccacgggaacggccgcaaaagatagaaggacaagcccaacgaggcaaacagttgaccctgggcgaatccccctaaccaaacgtggtgggctgcaagggttcaaagaggggcacatggcgcgcccgacaaccccagcaagacaccaccaaggaagaacgcacaagatacacagcacaaaacggccacgaacccactaaccgagcaaaaccggtaattggccaggaagacactcacgcgggtagctgacacagggggagccgacaaccgaagcaacaaagggcacacaaaaaggcgtaggagaacaagccgacactcaaccagtgccagaacaccacgtgcgagcacaggtgaagacacaaga

SEQ ID NO: 507314 - DNA, 1520 bp, Homo sapiens
acggccctcgcagaagctttctagcacccattctgtttggctgcgcgagtgccccagtcaggtcaagtgcaacatggtcatcagctgtattcctaagagagcatccatggtcatgcactcagtgcttaggattctacaccaatcaaaaaacgccctgggcggcaaaccgagacgattacatgaacaaactccacgatgtgagtttctgacgcgtcatatacctggactctactcaacacggagtccaaggcgagcctcgactatcaacaattacgccccgacacctgtaaaacacacaatagagacgacgacgcgaaagacgagagggagagcgacaagcgagcgcagagaggaggagacgggcacataggagaaggaaaagggagggccggagagagtgatacgacacagggggggagcgcgagacagcaagcgcccacgggaagcgtggaagagcgagcgacgggcagcggagagcagaaccgacaacggagcacggagcagggagaacgggcaaggccagcgcgcgacaggagcagaacggacacgaaagaggaagaagtaggaaagcaccgaaacagaggcgcgacaagcaagggcagaacagaaaaagcgacagaaaaaaagacagaagggaggagggaggagaaggagaggagcaggaagagagcaacacaagcggacaggagaagaaaaaacgaagagacgcggacagaggaggcgaagggaaaaaggaagagaaaagggaaagacagcaaaaaggcaaagagagaaagagagcaggacaagaacaagacaggggagaagacaagaaaaaagcagagaagagacgcaagagcaggagagcagaaaagcaaagcagagaaggaagagacgaaaaggggaggagaagcaagcaaggagaggagagagaaaaacgcgggaggagcggaggggagaggggaaggagaagggagaagaaggaagagggagaaagaagagagaagaagaggatgacgagcacgaagccgacgcggagaggagagagagagaaggagaccgcacggcagggaaacggcgaccgaaagagcacaagagaacagacgagggaaggcacagacgaaagagcaagaggaagcgcgagaggagagcgcagaggagcgagagacggcgggcagggagggagagaggcgaggaggacggcgagagggagacagaggcgtcggcggcaaaggagaggggagagaggggcaccggggggatcgagaggcgacaggcgacgaggcggagagagaacaggagagaggagcgggagagaggggaggcgccgcagacagacggagcgaagacggaaggggagagaggagagccggcacgccggggtgagcgcgtgagggacgaggcgagggggagcgcgaaggagagaggaacgaggcgcgggaggcgcgggaaggagcggggggacgaggcggatagcggcgggcagagggcggagagagggcgggggcgcggagcgggcacaggcagggaggagaaggccg

SEQ ID NO: 507315 - DNA, 128 bp, Homo sapiens
  misc_feature (46)..(46): n is a, c, g, or t
aatgcacacgactatctgctgaggtactccccctgcttattgctanctccacaaaagctatggattaaacacaccacaatactatgtgtatagccagtggaatgtgcgtgggtgtgctttgtgtgtgc

SEQ ID NO: 507316 - DNA, 156 bp, Homo sapiens
caccatcatcaccatcaccatcatcaccaccatcattgccatcatcatcactatcaccatcatcaccatcaccctccttaacctctacttctacctacgcctaatctactccacctcatcatcactatcaccatcatcaccatcatcaccatcagt

SEQ ID NO: 507317 - DNA, 481 bp, Homo sapiens
  misc_feature (10)..(10): n is a, c, g, or t
aggatctcgnatatgctgtctcagtctgtttagtgttgctatagaggaatacctgaggctgggtaatttataaagaaaagaggttatttggctcacggttctgcagactgtacaagaagcatggcaccagcatctgcttctgatgagagcctcaggctgcttccactcatggcagaaggagaaggggagccagtgtatgcagagatcacatggtgagagaggaagtaagagagagaagggagatgccaggatctttttaacaatcagctttctcaggaaagaacagagtgagaactcagtcactctcactctccagggaggacattaatctattcatgaggggtctgcccccatgacccaaacaccccccattaggccctacctccaacactgaggattaaatttcaacatgagatttgcaggggtcaaacatacacactatagcactaaactctaatttgaaagggaatacactttcaag

SEQ ID NO: 507318 - DNA, 198 bp, Homo sapiens
tctaactacggtatctaggcaggagtgaagtggcgcaatcttagctcactgcagctgggctgaagcaattctccttcctcagcctcctgagtagctgagactacaggcatgcgccaccacaccaggctagttttgtatttttttgtagagacagggtttagccaagtgatctgcctcaagggatccttgagcccctct

SEQ ID NO: 507319 - DNA, 158 bp, Homo sapiens
ggcaagtcaagctgggaggaccaaggccaggcagcgggagcacccaaggaaggaaaatgaggtggctacttctctacttatgctctctgcttctccctgtcaacggcttcaagccacaccggtggtgctaaacaatatgtttggccagatccaggtcg

SEQ ID NO: 507320 - DNA, 233 bp, Homo sapiens
agcgacctttgaccgagtccgggtaaatgggtgggctaccctattcctccgaaccagcatccccacgcatcaacatggagaacaagaccacgtggttctctgtggacattgactcggagctggtggcggagctgccggccgaaactcgagctgtggctggtgctggtggccgtgggtgcagggctgctgatggtggggctgatcatcctcctgctgtggaagtgcggcttctt

SEQ ID NO: 507321 - DNA, 426 bp, Homo sapiens
ccatccgctgcagcattcgctccggcgacatatgcaaattaagaaaaggcaacatctcctgcaatttaaaaagtttgcgcgtcagctccttattaaacttcggcagcatagagataaattcgttaaacgatgccgccagtacgccgaccagcgcggttagtgcgatcagcatcaccaccactacaatcgtaatggcaacggggcgttgtactccccgacgaataaaccaggtgacgagcgggttgaggacgatggcaaaaaacagcgccagtaacagctgcacaatgatatctgccgctgcgtgaatgcccgcgaggatcactaccagcgaggccagcttgagcagaatgtgcatgcccgttttatcgggttgaggggtttccattggggcttccttgtgactttttgtattaagtgtagcgggag

SEQ ID NO: 507322 - DNA, 434 bp, Homo sapiens
ttattaacctaatcgctctgaccgtgatgatatagtaccagagcttgacgaacacggattccacccaggcaaccacacaacaagcccagctggcggcagcagctgaaatcgatgcagaaccagtcagtacaagcaaaacagcgtcggcgtgcaacgaaggcacggaaggctatgtccaaactgggtcttcggcaggttacaggagttactagagtcactatccggaaatctaagactatcctcttagtcatcacaaaaccagatgtctacaagagccctgcttcagatacttacatagttatgggggcagccaagatcgaagatatatcccagcaagcccaactagccgctgctgagaaattcaaagttcacggtgcagctgtctcacaccacttcaagcacaccacacagactccaacagtacacgaggagag

SEQ ID NO: 507323 - DNA, 343 bp, Homo sapiens
taacccatttttttttccccccaaaagggggggaatttttgagcccccccccccctgggtggacttcccccccctttttgttagtggaattcccgttaaaaaagggcccaccccgggggttttcccccttttttgggtccccccgggggggcggccccctcccccccaagtaaaatggtggttccccccccctgggggggggggaagtggggaattttttttccctgggggaaaagctttttttttgggaaattaaaaagttttggggatggccgggggggttggttccccccccctgttaatgttcttttttccccccccttttacctggcttaaataggga

SEQ ID NO: 507324 - DNA, 177 bp, Homo sapiens
agaagcttatgtgttatgcggggaaacgccatatcgggggcacgattattaggggaactggtcagttgccaaagcctccgattatggtgggtattactatgaagaagattattacaaatgcatgggctgtgacgataacgtgtagatgtggtcattaccgtgaagattgttggctgg

SEQ ID NO: 507325 - DNA, 211 bp, Homo sapiens
  misc_feature (164)..(164): n is a, c, g, or t
ctagtgttgcactgttatgtgcattctctctggcatgggagtctccaggtgctgtccacatacatgaggagtctggacataggtggtccagacaggaggagcaggaggcacaggattccacctaccctattaggattgaggtggcaggtgggatgatactggtnatggctttctttctcatcacctacacctttcattcaacctgggtacc

SEQ ID NO: 507326 - DNA, 167 bp, Homo sapiens
catgacttaagaatagctggtcttgccataacctgggtgtgtgcggtagaactaggttaataaccactgtaagtcttctgtccgtaagggctgactgctctgctgggaataagccctgcccgggctggtggggtaggccccatagctttgggtagcttgtaccgctg

SEQ ID NO: 507327 - DNA, 240 bp, Homo sapiens
  misc_feature (184)..(185): n is a, c, g, or t
agagttgcgttgttagcgggtggcggatatagtctagtatagcgactatggtaccgcagtgagtgcttagtagtggtgtattgatctacgataatcgtagccgagcagtctacatgcgatagttcgtccatatctagcatatgcttgggacaagtctccatgacagaagatgcagttagcctcnnctatctatagactcaggtgggatgtactgggtcgggactgacgtcatggtatcaa

SEQ ID NO: 507328 - DNA, 965 bp, Homo sapiens
  misc_feature (965)..(965): n is a, c, g, or t
ttgtagactttgagtgtgtaataagagtaaatctatcatcaatcttggcagagctgcagcaggaatcattccccaggaccagctggctatgtcatgcattcgactccactaagtggatgagctggatattctccgcatatccgatccccctttctggcgaacatgtgtacctcgatacatgattgcacatgaatccatatgcgtgtgtatgcatgatcttccttgaaatcttagcatgctaatcttcgaccatgtgattgtggtactctcctcattcatggattgtaagggaactcttcttcaatcgtgatggatgcacaataacaatgtctgaggattagtgcagctgctattagcttttgttttagagtaccaagaggatagtttaaaatggctccttaagtcttggtatctgaataagtgccgtttgctcattcatgtctgtttgcgcatcgatacctcttgcgtacacttcgttttttgccttaccacgtacgcgcgtgtgtgccagtaaaatgggcacacccagctatgtggggccaagctgccttgtacccctctcccatgggtcttttccaattaccgcggagtgagaagttcggggcccatcgaggagcaagtccagcgttgatgcgtctcgattcttttccttccatggacatccaatatagaattgaggccgagatgaccagatcttggcccattcaatcataatgggggcggtttaaagctgcatagggttcggcccagcttaatggatcgttgttgccgtgcaataattctttccagggttggccgtgccaggattgctcccacagacaagttgatacaggttctgctgcgccttattgtcaaaagagttgtcgctgggaatggtaatctcgagagcatttttgccctttttcccgccatatacagggtaacccttaaggagctggcggagggattcacaggggttaacaccn

SEQ ID NO: 507329 - DNA, 692 bp, Homo sapiens
  misc_feature (227)..(227): n is a, c, g, or t
  misc_feature (347)..(347): n is a, c, g, or t
  misc_feature (391)..(391): n is a, c, g, or t
  misc_feature (395)..(395): n is a, c, g, or t
  misc_feature (535)..(535): n is a, c, g, or t
  misc_feature (563)..(563): n is a, c, g, or t
agcgggagcgatgcgcagacatctttgtgtgggcgaaacgaggtgaccgcagagtctgtcacccaggttggagtgcggtggtgtgatcttggctccctgcaacctccacctcccaggttcaagcgattctcctgcctcagcctcccaagtagctgcgattacaggcacccaccaccatgaagaatggcatttttaaaagatggctttcttaaaaaaggatactaagntgctcttctactcataccaagtcctgcagacacattctgggactgcaccttatgagtgctgctcactctgtttcctgcagaagacatacagagccgttcgcatagagggccatgattttnattcagcaattcttcaaaccactgatgctggttgaccatttgantttntttttgaagtattttttacatacagtgtacagaacatttccgctggatatttggatactgaacaggagtaacaagaggaacagctcctacctcccccctgccccttccctcacaagcctgtgagtcagggcaggggcagncactgaaagtagcagaggccttcataanggagaagttgtcaggtagacctttggattaatccccaaaagcagcccctaggagacaggcgacagaccgcagtcaggggatgcaggcgtggaaggcacttctccatgttgccatcatgtgacgaaggaa

SEQ ID NO: 507330 - DNA, 104 bp, Homo sapiens
caagacgtttacttcccctaatgatagaagagctttatcaccttttcatggatccacggcccttcataatcatttttccctaatctggcttcctagtcctcgta

SEQ ID NO: 507331 - DNA, 637 bp, Homo sapiens
  misc_feature (227)..(227): n is a, c, g, or t
  misc_feature (347)..(347): n is a, c, g, or t
  misc_feature (391)..(391): n is a, c, g, or t
  misc_feature (395)..(395): n is a, c, g, or t
  misc_feature (535)..(535): n is a, c, g, or t
  misc_feature (563)..(563): n is a, c, g, or t
agcgggagcgatgcgcagacatctttgtgtgggcgaaacgaggtgaccgcagagtctgtcacccaggttggagtgcggtggtgtgatcttggctccctgcaacctccacctcccaggttcaagcgattctcctgcctcagcctcccaagtagctgcgattacaggcacccaccaccatgaagaatggcatttttaaaagatggctttcttaaaaaaggatactaagntgctcttctactcataccaagtcctgcagacacattctgggactgcaccttatgagtgctgctcactctgtttcctgcagaagacatacagagccgttcgcatagagggccatgattttnattcagcaattcttcaaaccactgatgctggttgaccatttgantttntttttgaagtattttttacatacagtgtacagaacatttccgctggatatttggatactgaacaggagtaacaagaggaacagctcctacctcccccctgccccttccctcacaagcctgtgagtcagggcaggggcagncactgaaagtagcagaggccttcataanggagaagtgagtgggatctgaggggacaaaggttccctgcccaagtggcatgtcatccagtggctgaccacagt

SEQ ID NO: 507332 - DNA, 1055 bp, Homo sapiens
  misc_feature (24)..(24): n is a, c, g, or t
atagaaggagggaccaagcggaanataatctttttgttcagaggtccatcggtcaaagcctgcattttagagatggcattactgaggtccaaaaactagagccactcgctctgggtcatacagccgataaacgcacgcagccgagctcagttcttccctgaccctgttacaaactgcctcactaaatgaggacccccatccccttcccatgccaggaaagcacagctcatttgtcctaaagttaacattacacaaatcacacccttcaagccttcttgaaacattttttttccccgagggtgacgggacggttacgctgattcatcctggccagggaccccaaacatctcccctcctccggcccaggcgccgtcacccaggctccaccggtccgcgggacagagccgcggagagcgcctggaagcgtcgcgccctcaaagccaagcgattaagttggttcctcaaattgttcccgacaggaggggcaggaaataacaccgggctctggcggcggccgcagcaggagggggagaagagcgggccgtctcccgggcagtgctggcggcctctcatcgatctcgggtctaaggtccggccgggtcatcattcctgccatttccacagcattcgaggtaccacatcaccccctgcctcggtcgtcgctcagtcattccctccgcgccgagtcctggagcggcggagtccctggaggcctgggtttccttaaggggccccaatgcccgcagcccccgacccgcccaggtggaaggaaacaggctgcgggcctgggccaggcggggcctgacagaagtaaaggccgggagggggagcggaagacggccagaaggacccctgcgccctctcctccgcgccgcccgccaggctgccaacccagccaccctgggtgcgacgcggcgccttctccgccgctgggagtcgggcaacaggtgaagagggcgggcgtccgcggcgcctccgcggggcggtccctctcctgcctgctgcggaggggaaaaggggggaaaacaagaagcaggagccaaggaaaaaaaacg

SEQ ID NO: 507333 - DNA, 840 bp, Homo sapiens
  misc_feature (40)..(40): n is a, c, g, or t
  misc_feature (89)..(89): n is a, c, g, or t
  misc_feature (115)..(115): n is a, c, g, or t
  misc_feature (136)..(136): n is a, c, g, or t
  misc_feature (212)..(212): n is a, c, g, or t
  misc_feature (218)..(219): n is a, c, g, or t
  misc_feature (221)..(221): n is a, c, g, or t
  misc_feature (223)..(223): n is a, c, g, or t
  misc_feature (232)..(232): n is a, c, g, or t
  misc_feature (238)..(239): n is a, c, g, or t
  misc_feature (243)..(244): n is a, c, g, or t
  misc_feature (246)..(246): n is a, c, g, or t
  misc_feature (257)..(259): n is a, c, g, or t
  misc_feature (267)..(267): n is a, c, g, or t
  misc_feature (269)..(269): n is a, c, g, or t
  misc_feature (271)..(272): n is a, c, g, or t
  misc_feature (279)..(279): n is a, c, g, or t
  misc_feature (286)..(286): n is a, c, g, or t
  misc_feature (298)..(298): n is a, c, g, or t
  misc_feature (302)..(302): n is a, c, g, or t
  misc_feature (335)..(335): n is a, c, g, or t
  misc_feature (344)..(345): n is a, c, g, or t
  misc_feature (349)..(349): n is a, c, g, or t
  misc_feature (356)..(356): n is a, c, g, or t
  misc_feature (368)..(368): n is a, c, g, or t
  misc_feature (371)..(371): n is a, c, g, or t
  misc_feature (378)..(379): n is a, c, g, or t
  misc_feature (383)..(383): n is a, c, g, or t
  misc_feature (410)..(410): n is a, c, g, or t
  misc_feature (415)..(415): n is a, c, g, or t
  misc_feature (419)..(419): n is a, c, g, or t
  misc_feature (723)..(723): n is a, c, g, or t
  misc_feature (779)..(779): n is a, c, g, or t
  misc_feature (784)..(784): n is a, c, g, or t
cagcattatgcatcgcagtatgtagtgtgcaccattcaanatcgtatagaccatatgaggatagattacaacgttagaaactaaaatanatttgttcaacactccagacaacatntagtgtagatgacagggaagntctcatgtgatgtttatttcacaaacatgaccttggaagaattcataagacagcatcccagtcacttacatgagancagagnngncngcttgagtntaaganngcgnntntttctgtgggnnnggcggatntntnncccgggntgaggtnttagagttggcncttngggcggtgcgagggacatcttactgcgaatgangcggggggnntttnggctgcncagggcgtggtngcnattaggnngggnaggaggtggaggagagagagcgagcgnttcantttngggaggtttaacatttatgcacaaaataagagcaagagacttaaataaaaaagttgacagaactcagggacccctccaataaatgtaaaaattggaagacttcagaatttatttcaagatcctcatttaatcattggaatagtaatattctaatatttatctcattgtgaccatcaaaatttttctatatttttacttcttaaactctgtcttatgtctacttactccggcaacgagatggcaacacaagttaacattttccagatgggatgtctctgtctttaaactagaagatgggtattcngaggttaagatagcctctgaagtgtcttattgccataccactaatttttaaaaatnaaatntttttttttttttttggagggggaggctggattttcttttcacttaactgctggtt

SEQ ID NO: 507334 - DNA, 347 bp, Homo sapiens
gcggccgcagccatggttgctcagcttcagaagaggcttgcctttaggtgtcctccgccttttgcaagaagaagggtctggttagaccccaatgagaccaattaaatcgccaattccaacctcccgttagcagatccggaggcttatcaaagatggtcttatcatccgcaagcctgttacggctccattcccgggtcttgatgccggaaaaacaccttggcccgcgggaggacaggcacatggcataggtagccgagggctacagccaatgccctatacagagagtacatggatgagagatgagatttgcgccgctgctagaggtaccgtaatttagaggtcgtcgc

SEQ ID NO: 507335 - DNA, 340 bp, Homo sapiens
ggggacacatcagtgagcaggctgtgggagtggcagcgtggccagagttggcacggggatcacgggaagtgaaaaaggggggttagagaaacattactggtgaaataatctgtttacagggcagggtgaagggatgagatgaatggaaattaattctggggggaaatggattcaacgccagggcctgggagctgctgtagtgggtaactggagaaatcggaaaggtgtatttgggagagaaggaatgggctactcaggctatagagaagtttctgggggcggctaagatatccagatgttagggtccggcaagcagctatggcccggaagggagcccaaa

SEQ ID NO: 507336 - DNA, 112 bp, Homo sapiens
ggaattcgggcacgagacggacacgtacttacgttgttagctcacttccacttatgtcctatcaataggggctgtatttgccatcatagggggcttcattcactgattttcc

SEQ ID NO: 507337 - DNA, 223 bp, Homo sapiens
  misc_feature (56)..(56): n is a, c, g, or t
  misc_feature (67)..(67): n is a, c, g, or t
  misc_feature (95)..(95): n is a, c, g, or t
  misc_feature (138)..(138): n is a, c, g, or t
ctgcctgctggtgaccctggccgcccacctccccgccgagttcaccctgggtgcangcctccctganaagttcctggcttctgtgagcaccgtgntgcctccaaataccgttaagctggacctcggtgccatgcttcnttccttggcctccccccagcccctcctccccttcctgcacccgtacccccgtggtctttgaataaagtctgagtgggcggcaaaa

SEQ ID NO: 507338 - DNA, 119 bp, Homo sapiens
ttggtctatcctcctgtgcttaccacagtgagaacttggatatgccattgagcttttctgagtttccattctctcgtctatacaacatagcaaattttcagcaaacatttgctcccacc

SEQ ID NO: 507339 - DNA, 343 bp, Homo sapiens
tggaggggcaaggttcccaaggttgccaaaaagctcaaaagggttaataaattttatccctaaaacccgccccccccccttttatcagggtggaaggaggggtttcagaactgtttgtttcaattggccctttaagtttagtagtaaaaaacgggttaatgaaaacaaggccttgtaaacccttcaaaaggaaaggaaaatgttttggggccccctttggtttttttttttggggggggcggttttaaggtattagtttttaaaaacaggactttttaaggggaacaacttgccccaaaatttgtcccaaaattttgagaccccttaaaaaagtttaatggga

SEQ ID NO: 507340 - DNA, 698 bp, Homo sapiens
ccagaccctatgacccctaacaggtgccctctcagccctcctaatgatcctccggcctagccatgtgatttcacttccactccataacgctcctcatactagtgcctatctaaccatacacatctaaccatataccaagtgattgtgcgcgatgtaacagcgagataatgcaccactaccaaggcgcaccagcacatccacctgtccaaaaacgtgccttcgaatacgcggataagtcctactttagtataccctctaaggaatgttatttattcttcgcaggattttttctgatgcgcttttatcgcatctcctatggccttagccccctaccctcgctcagacttattgagggcatctgtggcctccctaatccaggcgtcagtcaacctcgcgcttaaagtaccccctagaacgtcccactcctaaagcacatccgtacttactcgtatcaggagtatcaattcaccttcacctcatcctatactctaactagaaaatcatacgcgtatataccaaactaacttcatgcactagctatattacaatatttagccttgggtctcattgttttatccctcctaacgagcgctcatgaggtacgttcgatgatctcgccgttcatccagtttcccgatcggtcagtctacttggctctagcagttttcttagtacgccacacgtgctttcccccggac

SEQ ID NO: 507341 - DNA, 200 bp, Homo sapiens
atccagtatccaggacatgacatgtttgtgcggtccaggcaacacagccaagctttttatcccactttgacatcaaagactttccggcaaagtctgtcaatcagtccctctcccccaatatgccatgtggtctggcggggtagaacccagatgtacccaaccccacaggatggcagtgaggcaggttttcatttggcctt

SEQ ID NO: 507342 - DNA, 562 bp, Homo sapiens
  misc_feature (43)..(43): n is a, c, g, or t
  misc_feature (45)..(45): n is a, c, g, or t
  misc_feature (98)..(98): n is a, c, g, or t
  misc_feature (132)..(132): n is a, c, g, or t
taggatccggaccggcacactaaatagtgtgtgattgcataangnggacagtagctagccaggttgatagtgtacactgacatcatacctgtcaatgnggttgttatagtagcagcgactggcttgcccaanagtgcacagggttcaaggaggtgatgccctttgaggggttttgtgctgtgcctggcagtaggaagggcctgttgttgttagctgttgttgcttccccaaggtgggcactgctccaggagccccagtggggctggagcagactccccagagcaaggggttctcttgagacctgcaaagatctcatgcctctcacccagttctctaaaaagctgcatttcgccagggcacctagccgggaagttctgagatgcgccactagggggcacaggtggccacggagcctcgggattgtcagggccctggggctgttgtcaggagagcctgagggttcatccaacccaggagtcctgtggaagctccagctcgtttacatgcagatgaggttgctcaagagtgttgttacaagcttgttctcttaggcaagtgttga

SEQ ID NO: 507343 - DNA, 214 bp, Homo sapiens
gcatcgccggattcgccgatcatagtcttgtgggaacgaatgttatgatttacgccgtatgactattatagtggaatggatttatggccgtaggtttggtctatgggtgttgcctgagaattggggagatcagtgaatgaagcctcctatgatggccaatacagctcctattgattggacatagtggacgtgagctacaacgtactacgtgtcg

SEQ ID NO: 507344 - DNA, 221 bp, Homo sapiens
  misc_feature (9)..(9): n is a, c, g, or t
  misc_feature (15)..(15): n is a, c, g, or t
attcgcggncgcgtngaccccagctaagtgtgagaattgcttgagcccaagagacggatgttgcagtgagctgatatcgcaccactgcactccagcctggcaacagagccagagcctatctcagataaaaaaaaaggaaaactgaatgaaagaaaaagaaaacaagataaaaaaggccgtgtgcggtggctcacatctgtaatcctagcactttgggaggc

SEQ ID NO: 507345 - DNA, 1148 bp, Homo sapiens
  misc_feature (802)..(802): n is a, c, g, or t
gggccttagagaggatctcggtcaccttgaatgacgcggcggcacctgcacgccaacacggtcttcacggggcagaacgacgggacgtacacgctgactgtctgctgtgcggcacggggtgcctcgacgtctttatcggtacaacgattcgtatacggcggactgccgtgactctacgtctcttcttgcaccacgacgctggggacactgctgaccgcggctacacacgcaccgacttggacgctctgcagtacccacagacacaggccccatgctgacgtccctcctcaagagctggactggcatctgcacaattgatgaccagcacctctctggtggactgacactttgggggcacacacacacgctcttcatacccatcttattggctcagtactctacacacagtggaccaaccttgcatcttacatcaccagggccaaagcaaggttgaccagggccatcttgtgtcattttctttcttgggactgtgctctcttgggctttacaagaagacttgtgaccaagtttctgggcccagtgcattcgctcacttggacccctccacatcggtccatctcttgggcatgcgtactcttaacctgtactccaatgtgtcggacatgtctctacctctaagaccagtggtataacaccataatgtttatccagaattccttcctcgacaactgctgactccacagctggacacttgggtacttgaccatttaagcaaccaacttcatatatgctgcctgtactcttatggaagcatggcttattgcaactcagtgggcaatcnggcactgtgtacctactccaacataccatgcctcctctcgactcaacccaccccattccattgcaccttttaaattcatggtctcgacaccgagggtccccccccattgttcctaccacagtaccacctagcaaagggaaagaacagctcggaaggccccagaccaccgggcagaaactcgacaccgcccggacgagacgaaaagaacgaggaacaagggaacatggcgaccggacaccgagcagcggcacaaaagcacccgtcggtgtcccacacaaaccgctacgacagcgccggcaagacagacacaaaacagtgggggacccggccacccgcagcacgacga

SEQ ID NO: 507346 - DNA, 849 bp, Homo sapiens
ggcctctcccccttctatggcctcccgcctcccgcttggggtcctgtcgccctcgcatcggtcgttatattgggcgtgtttatcaaactccggctttatcacctgggcgccgcgtgttaccagggtggggcacactttctggggcccgcaccaccgtcccgcggtcctctaagagccctttcttttattgggggtatccacccctgttggttccccccccagaagtgttttttttgcccgagagtttttttgagcaccgttgtcaaccccccggcggtgatccgcttctctccgcccatttgtgggggccccttgttcccccccccacgagtgttttcctccccgtttatttttcctcctcatgtagtctcccgcctctcgcgacaagaaccgctccgctgtttattttgtgccgctcccgggggagggttcgcacttctccccccagggtgctccccactttactgtgttatttattagtaacccccccccgggccaccatatgtctacacccgctcttgttgcacaccgttttctgggctttcttatgtttactaccctcccaccagacctctcgcgatgtttgttgggttgtctccctctcaccccctttcggccgcgccattttcgcggctcaccactatttgttggtaaccaaccaccgcggtcttcccgcggcttcaccatcctattttggggtgcactttccctccctatttggcgtctactcccccccctaattttcccctaaaaaaccccaaaacaacttgggtttgaacccccccccttttcgccttttttaaaaggggttaaatttttttattttccaatttttgaaggggggtttta

SEQ ID NO: 507347 - DNA, 254 bp, Homo sapiens
gagtatcgacctcattaaattagcatctgatgattcacatacgaggcttgtggtgatagtacagctgagtgtctacattcgaggtcgtagtcatagctggttcctgatgacaaaagtgcacagaacttacacacacgagtgcagcatgtataatagtgaaatccaaatatgatgggattataacaatgtccatatcttggtcctgatactgtactgtgttaatatgagatggtggtggttggtggaagttggtg

SEQ ID NO: 507348 - DNA, 898 bp, Homo sapiens
ggcagtattcggaaggtccctgacggagtctgtctcttgcattcaacagtagtatggacggaacaagatccgggagactcatacttccagcctccgaactgccctccgcattatcctctccgcttgcattctctccgggaccatctaactcggacatctccatgctatctggagacctgccagaaccgaaataagtggttaagctccttacttgccaaaccaaccatgagctcccagatacgtcagaattattccaccgaccgtggatggcagaccgtcaaacaagcactggtccaatcggtacctgcaggcctacctaccaactacatctactctgggactacaatatacgaccgacgatgatgtggactctggaaggcgtgacgccaatcactaaccgagaaattgggacgcggacgcaagcgcgagggacaacgagcagtctcctgcaagatgcaacacccagcgatacagggccgcgaccactctaaccagagaccatcaagcaaggccagctgaagattgcgtgcgggtaacaccacctagcacgcccattgacaatgcttgccaatgcacccatgtgacgacacatacgtttgaatccaggccccatttggcatcactccatgccctgagaatcatggcccagaacggaccccacaatttctagctgaaatacatgcatgacgtcacttcaccacactgacggcacgtgcaacgatattcaccgaacccactgggatgcaccacctgacacaagcatccaccaggaggagcagaacccgcaaaaatgaactaggacaaaaaaacttatgcacaggacaccagatcaacacagataaaaagactatggacacaccgaaacacatgacagccctcggacaagcacccgggatcg

SEQ ID NO: 507349 - DNA, 211 bp, Homo sapiens
ttgtacaatggaattataagtgaaaagcctttctagttctatcttaccctaaatgggctctatttctctgtaattcacatgacactctttggctgtggctgtctgttaaattccctgtttagaactatttctcagcaaaccaaaacaaatagctcacagaaaagggcaagtggtaactacatttttttttttttttttttttttgtgggga

SEQ ID NO: 507350 - DNA, 127 bp, Homo sapiens
cccccttcccccatggaaggccctcttcctcccttgatttcactttttttcaggcccggatccttttattctccccagttataacccagttataaaaaaaagatttgggcataaaaatacgggttta

SEQ ID NO: 507351 - DNA, 173 bp, Homo sapiens
cgctcagtgtgaagacatgaggatgaacactttatgatgacccacttccacttaatgaacagtaaatatattttctcttccttatgattttcttaatgtcattttcttttaactaactttccttctttttgcttcctgcttctgcctcctgcttctctgcttcctgcttctgc

SEQ ID NO: 507352 - DNA, 409 bp, Homo sapiens
ccctctaaacaatggggcattcgtcaactctcagccccgatgtagggaccagccccacagggtcggtaggtctctccctgtgtgcagcgatgagagagtgtagaaataaagacacaagacaaagagacaagagaaaaggcagctgggcccgggggaccactaccaccaatgcgcagacaccggtagtggccccgaatgtctggctgcgctgttatttattggatacaaggcagaaggggcagggtaaagaatgtgagtcacctccaatgataggtaaggtcacgtgggtcacgtgtccactggacagggggcccttccctgcctggcagctgaggcagagagggagaggaagcagagagagagacagcttacatcattatttctgcatatcagggactattgtcgacgc

SEQ ID NO: 507353 - DNA, 916 bp, Homo sapiens
gtttgagactcagtagatacaggacatagagttctctgacaatgaaataagtagtctatatgaagcagcacaatataaacttgctaacttaaagaaggcatccagtataacaagaatgaatcagtagctcaccaattatgcaattaatccattaaatccatatggggatagagttacttaaagattatggtttagaaaagaaatgtcaagtcatactttgatatcaaaactattaacaatgtataacagatatttataatatttacaagtgcatgtttgaatgtatagttataggatatagtaaaatgtgcttaagaaatatactcagttcttaaaccacctcatatgagtattatacttgatgccatacttctcagaaagccaaatccaaaaaagtgatcgcgttgactaaaaaggaacgcttaggagatcgtctagagagaaagcgtctaggcactcacatttctagcacagggagataggtgatttgccacgataagcctgcatagaaaagaccatcaaatgaagttttcttatctcaacgtctctatgaatacgataatatatggcacaaataagtggtcaaatttttccaaggatgttactgagaaccacaaatccttagttcgtggatactcaaaaatcgtgacagggttaattgagggttaatcatactagagtacatcaaagcgactgtcggggcaagaaggagtcttaaaggggcaagagggaaaatattcccgagtacaacagaaggacgttttttgggaggccacggggagagaacctcgggcgggtaaccaacgggaagggaaccggcttaagatacaaaaaccgggggggggggccacaaggagggcagagaggtcgcgcgggagatagcaccgcgggagagaaaaaaagaacagaggggcgg

SEQ ID NO: 507354 - DNA, 593 bp, Homo sapiens
ggcaggtcctgggggaccagacggtctcagacaatgagctccaggaaatgtccaatcagggaagtaagtacgtcaataaggaaatacaaaatgctgtcaacggggtgaaacagataaagcactctcatcagaaaacaacgagaatcgacatgtagctgccacagacaaactgcttcgagcacaaccgtagcaagaagcccaagacagacagaacagcaggatgccctaaatgcagaccagggaatccagagacaaagctgaaaggagctccccaggagtgtgcaatggagaccatgcatggcccttcatggcgaagaagttgttaaggcccccttggccccttggaaacaccaagaacccattgccaattgaaagttctacgcacagcgtctgcagaagtggctcaggcctggttggccgccagcttgaggagttcctgaaccagagctcgcccttctacttctggatgaatggtgaccgcatcgactccctgctggagaacgaccggcagcagacgcaccatgctggatgtcatgcaggaccacttcagccgcgcgtccagcatcatagaccgagctcttccaggacaggtc

SEQ ID NO: 507355 - DNA, 714 bp, Homo sapiens
gtacttgtcagcttcttggggacactggctgtgcttcctggaaacattgtgtctgctctgctcatggacaagattggcaggctcagaatgcttgctggttccagtgtgttgtcctgtgtgtcctgcttcttcctgtctttgggaacagcgagtcagccatgatcgctctgctctgcctttttgggggagttagcatcgcatcctggaacgcgctggacgtgctgaccgttgagctctacccttccgacaagaggactactgccttggcttcctgaatgccctgtgtaagctggcagctgtgctggggatcagcatcttcacatcctttgtgggcatcaccaaggctgctcccattctctttgcctcggctgctcttgcccttggtagctctctggctctgaagctgcctgagacccggggacaggtgctgcagtgagggatgggggctgtctcaggggctttagggatggcaggcacactgtgagaccaataattccttttatccctaccctgccctgctgtcctggtcctcactcctgtgtttggtgtcttagctgtgtgtgcctgtgtgcatgtgtgtgaccctgatgggcagggactacagggacggtcccttcgttccacttttgggatgaggtactccttactgtggccacctcaatttgccaaggagaaggtggcctggatccttctctccccagtgttagcgggggg

SEQ ID NO: 507356 - DNA, 282 bp, Homo sapiens
cccgttgtggggaggggcagtgttaaagcagggctggtcatcccctttggagttcaaaggaaaaggtaggcccagggcttttttgttttttttgttatttttggttgggggggtgggaaggtttttttaaaatggggcgggccccccccccattccgtgcctcaatttccccttttgtaaacggtaaatatgactattgccccccctcgcagggggctgtgggggggcataagctgatgtttgtaaagcgctttgtaaataaacgggctttttgaatgccca

SEQ ID NO: 507357 - DNA, 185 bp, Homo sapiens
actaacaatacaagtaaaaaaaatcgaggttcaagatcactttcattccaacaactatagtcattattggaattttacttaccttgcgatggaacatatgtatatcgtcagcatagtcatgatatagtgggaaatttctcgttagaaaaaataagccgttcttaggataaaacttcacctttttt

SEQ ID NO: 507358 - DNA, 325 bp, Homo sapiens
ctctgagatagtttcattgaactagcaagggatccatgccccgcacggaaatttgagatgtctctcggcggtggtgaaggaaagctctgcggcctgacggatttcatcagccttatgcttctgcgagctgacgtcggtggcaaattttaacactttcacaacctggccggcttcatcaatgacggggttgtaggtggcctcaagatagatggtctctcccgatgcggtcttgcgctcaaattgcccgcttaaaaaagttcctccctttaaactctgccaaaaatttggattttcttgataaaaattatcgaaacagaacattcgg

SEQ ID NO: 507359 - DNA, 1227 bp, Homo sapiens
gccggacgcccccagtcccaccgaacgctctgcccgagtgcctggcgggaagtcggcgccaccccgtggaaggtccgctcgggtcgtccgcgggggagcgtttcgctcctgtggatcagtgcggtgggaccggggtcgtcgccgggatgacgtccccctgtgtgtttgggctctccaggtgtgggggtcccggggggctaggcgacggtcgtcgagagcgcctggcgctggtggagagtgggcaggtcccgtgatcatatgacatgccgtctcggaccagtgcttcgatacattgatccagatgagggcactggacggtcgcccgtgacggaaatgagccctcaggctagcttgcaacccatgcctcctgcgacccgggcgcttctcgcctagggggtcccgcgtggggtcaccgaaagttggagcgccttggatctccgggccccggtctccctcagggttcttcgagcgtcgccggtgctcccctacatgtgacaccgtctgctggtcattgatgccccgactgaatcgcgctaggactcccccagcgatggctccctgctcggggctcctgcgaaggacgctccttggagcgccgtgtgccctcttgtgacccttccgtcgcccgcccggggagcttgacccgggtggagtaatggaaaccaaaaagtgcgcctgttttccgttggttgcggcgacgaaagccagaagcgggacgtcaaatacatcccagcgtttcgcctttttccgcggaggggtgcgtgcacgccttcgtgcagcgattgtcatccatgcgggtgcaatgccgtagaagcgagactgacgtactgcgcggtaacacagatgtcccatatacgggggaccgcatcgccagcggtgcaaaagtgggccgacgtagccacaatggatcacaaccgcgccgaacctgtggtaaaacccaacgacgacacccaaacacccgggggggtgcccaaggaaaaaccacacaagcgggcggcaaaacgcaggggaccagggggaacgaaatcatcgggcacgggtacattgccgcccggggggaagagccacgccgcgcggatggaaccacacggacgactagtcgagagcgcaaccccgcagaggaggtcgcgacgaaatccgccgtcggaccactctgcacacccccgccggcagagggggacacaggccagcgggacccacgtagcgacgacacccaaccactgggcg

SEQ ID NO: 507360 - DNA, 548 bp, Homo sapiens
  misc_feature (341)..(341): n is a, c, g, or t
caggtgaggaaacgggctcagacaggtcatgtaactggtccaagttccacagcgggggggtgaatttcccatcatggtcccatactcttactttggtgtttggtcctgtcaacacgtgagggctttggtctggagccaaactctcaaaggagggtgaccacaggcacagccccccagggcctcgggtgatctggctccccagcaagggactgcattttctctccttgtctctcgcagccggccaagctcgcggaggccttcaagtacttcgggcagggcatgggatacagtgagtatggcgtcccccgtgtgcagtgggtcggggcatgtgtcggaatggnaagtgctcggtcctgagccaggttgggatgagcaattcggtgtcccccgggccagcttcagcttgcggggaggaaacagttaggtgtgtggagggcatgtggcagccgggaggatctagcctctcataaatcagggaggctcattttccctcctttgtcgaacagacgtggtccacaccaggaatgggggggggttcagatgaggac

SEQ ID NO: 507361 - DNA, 802 bp, Homo sapiens
ctgcgggaacttaagtgccgtcactggtgatcagatgacacttgtggctattgccgtgcatcttgatttcagctgtgccattcgccagttccatgtttcaggcgcaggaagtcgttgctggactgggtcacatcaacgtagatcggatcaagttgctgcacggttggcagcgcagatcgcctgaccgtactgtaccaagtgcgccttcctgtcacgttcgacttaccaatgcgaccggtaatcggagaggtgacttatggtgtaagccagattgatccgcgcagtttcaacggcagcatttcgccgcagataccgcagcattcgcctgattgcgacatcagccaagagacctgatcgtactcttgcttactgatgtactgagtaccgagcagttgctgataacgattcaccgtacaattgcgcgatataggctgcagcctgggactttcgccagatcacctattcgcactgtcgtatgtcgcctgataggtcgcaggatcaatctgatagagagagacactgcttcgatgtcgataccttctttgaaacttacgcttcatgataatcccgctaccttgacggacgaacttctgcgatccggtaaggccctggtgcgacccggaagctcggttgtgatctggagaggttcaggaacagactggtcactacggccaacgagggggcatctgatggccacctagaagggactgtcaggtcggccacatccctgtaggggctaaggtgcctgcgagcatcagaccgaccgccagaggagaaagcatccgataaggacaactgacag

SEQ ID NO: 507362 - DNA, 212 bp, Homo sapiens
  misc_feature (16)..(17): n is a, c, g, or t
  misc_feature (25)..(25): n is a, c, g, or t
  misc_feature (48)..(48): n is a, c, g, or t
  misc_feature (187)..(187): n is a, c, g, or t
  misc_feature (195)..(196): n is a, c, g, or t
ccagacaacatgtgcnntgcccacnctaattggctgaggggccgatanagtgatctgattggttagaagaggttgtggcatcactgaactataatgattgctgtgtgaaatcattttcctagggagaaaatttttaaaaattgaattcctacttgaccaagatctatcttgcaaactattcgcaaanaagtactnntgtttttaacttaccc

SEQ ID NO: 507363 - DNA, 890 bp, Homo sapiens
tagtaagaaaacaaacattctggctcactagagttcagaaaagtaataatttgagccaaaggaatttgaattaagaaaatagaaactaggtttcatgtatttaaaaaataggaaataaaatagaaactcaaatgccatgaagttatcttcctcttccttatatcccctaagtttgggttgcaaataactttccaattcctaataacctaaattattttgaaatagtgttttcagtgaaatgatgaatgtttgaatgtttgtttggtaatcaacataacaatgctaacaaaattcccacttagattttttaacttttaaaagtcagcgtggttttgataatttgatattttaaatgcccacacatacacacacacacacacacacacacacacaagcacatgttaataaactgataggatggagtgagcaaaattgttttcagggaagatggcacattttagaaaagacttgcccagatgatcttccatattgctcccccaatgtcatttatcgctcatgccaatcctcctcttgttacctgtggctatggtaaaattcctttaacaagcttcattgtgtccaagtatttcagagacttttaaaagctgggcatgacatagcgttttgtgctgttaagaccttagcagagtcaggtagtttacgggtaatattcaaccttgtgcatctgaatctgtcatggattcccttcactcagcactttgccactaatttgtattacactctgtggccatataatacttgcacattatgcaaaaaaaaatgttgatagtatctccttgccacacaatatgcagagttgacaaccttttgaaaaccagggtaactaatatgtatgtcccagttgtgtgggcgttgggtaacaagtctgt

SEQ ID NO: 507364 - DNA, 794 bp, Homo sapiens
gcttgcttgggggaatgaagaccttggttcacctcctgccccgttgcttcccgctgcacatggacagacttcagagcgtctgctcataggatctgctagtccttcctggggacgaattgcgactcgtccacagggacgagcgccacgggtctggaggccgaggatcacgcagctagggcgaggatggactgatgtgttgggcaacgaactcgttaccctcgtggagccatgtactcttaggcgtgcaaatacacgacagcagactcggtgccccatctcgcctggatgcaattagctgttgtgcaatccaaggaggcaatgcgtacatcggtaggcaggcgacggggcccggcgtccaggcagaagtagctccgctggaaggcacggcatccactgtcgttcccaccttggggcctggcggggcccaccgccactgacggtcaggccgtcgttggactcttcccggcctcgggcgtacggggtcctcgaggaatgccgttcttgttccaaactcgcttgctcctcgggaccgtggacgatagccctcaaagggattagccagggaggcccgggggggcctctcgaccgtgggacgcactttgaccttgttgagctcgctgcagtgcatgtggcgtcgagcatggagggctgcacatgcgtcgtgtcgtggcgacgtagttgctaatgaaattggctgggggccgcatgggggtccgtcttgcacactgctgcacggtctcttctaggtgcagtctgagctgtggtgggagctcctttggacaagggttagttcg

SEQ ID NO: 507365 - DNA, 254 bp, Homo sapiens
agcgtaaaacgacgtccagcgattcctcattcttggtcatacttgattcctgattaaaaacccccgtcacactatccctatttttagcctaggggccccgggacaaagaacatttcaaggaaactctactataatttcagatttcctactctggataaaaaccatcttctctgaaaacacacagtctgtatctgtgtgttcatgtctatagaaagccctttatgcaagatggagagagccacatttcccctgag

SEQ ID NO: 507366 - DNA, 329 bp, Homo sapiens
ttgaaggtggatcttctaggactcaggtggtgtggatctgtgatgagatggggaaagtgggctcaagaggtctggatctgtggtgagatgggggaagtgggctcaggaggtctggatctgtgatgagatggggaaagtgggctcaggaggtctggatctgtgatgagatggggaaagtgggctcaggaggtctggatctgtgatgagatgggggaagtgggctcaggaggtctggatctgtgatgagatggggaagtgggctcaggaggtctggatctgtgatgagatgggggaagtgattagtatttagagtgtgcaactattgaaaa

SEQ ID NO: 507367 - DNA, 275 bp, Homo sapiens
agtgaatcgactcgggtactggaggatctctaagtcgaccaggctccatgttaacgatatttggaggtcagcactgactagactcacgtgtcgacggaacttgtacagggaggcatgcaccgcagtggtgaatacacgtcgaccaggatgcatgtatgcgtgattgggtcgtgagcgcggagctcatatatgtaaggagcatgtataggaaggtatgcacggccgtggtgaatacacgtcgagcaggaggcatgcatgcatgctcgggtcctgga

SEQ ID NO: 507368 - DNA, 1252 bp, Homo sapiens
  misc_feature (302)..(302): n is a, c, g, or t
atcaccatggcggctgagaccctgtacacgtatcctagaaaactgagagggccttcaaagctctcatcgctgctcaatacagcgtgggctcatggtcccgcgtgctctccggaccaccaccagcattaccaatttcaggcacaacaaccaatcctgcatccccttagaatattgctcgcgacacaattatcgcatgcacggacaaggatccccgatgcagttatgatgggtgattgagtgtgacttcgtgatgatgtatcgagtgaggcaagcggcgcatttgccgtactattgtgatgccnatgatgcgagcttgcggcgcggacagatacttccgagagtgcaagcagacctcgagggtggtgcacgatgaggctgcagcgtatctgcatgattctcccgactatatgatgcccctcacgtcatggtaaccttggtgatgtgtcgcccacctttgtggcaatcaatgcatccaacaacaaaacaggccactgagaatgcaaaggaggaacgtgaggcgacattctggggctgctggatgcttacttgaagacgaggacttaatctggtgggcgaacgagtgacacttggcctgacagtcacagtttgtcatgcaccctgtgtgaggactctataagcaggttctagagccttcttgccgccaggcctttcccaagtaccaaccgctggttcctcacctgccattaaccagcccagttccgggctgtcttgggcgaagtgaaaactggtgtgacgaacgactggcccaggtagactgctaaaacagtttgcaagacccaagctaaaaaggacacacaacgggaacgagaagggctcacgggaaggagcagccgcagccccagctgagcggacggacgaacacaacgggggttggcccatggcccctgacggaggcaacatggttgactcgtactcaggcgttgcgtttgagccaaggccatggacctttcggtaaccctccacaagagaacacagtgggtgagacaactcaagcgccagtgtcccacgtgtgaaccacgttagtcgacaaggacaaatacggggacccagtgacaaggagcgaggcccgaggtaacaccggtggtgcgcagcaacaccacgagaagaggtaaggagcaccttggacagccgacagaagcacagaaaagacgatacctggaaaacgaaccaactgagatgagcacagcgagctggtctcaggtcgtgaggcgggactcacacagctacggcc

SEQ ID NO: 507369 - DNA, 417 bp, Homo sapiens
  misc_feature (396)..(396): n is a, c, g, or t
gagagagagagagagagagagagagagagagagagagagagagagagagagagagagagagccctcatgaaaacacctgcgttagtactcatgcattttagggtactataggatctagtttcagaggattttctgactagtatgtatttgacacagggacaattgaaactttcacagatgcagtgacacgaactgtgtacatctaaacagactcttagattgattcaggctacttgatagttcggcttctgtcacgactttttaaacagttctacatcaaatcagttataatcaacctgtgtttaataaccatcctggacgcctatgaggcatcttcctgcgttctcactagctcatggagtctgtagaagtcacccatgaatgagcattgtccangcattctgagtgagtactgct

SEQ ID NO: 507370 - DNA, 416 bp, Homo sapiens
  misc_feature (20)..(20): n is a, c, g, or t
  misc_feature (53)..(53): n is a, c, g, or t
  misc_feature (57)..(57): n is a, c, g, or t
  misc_feature (65)..(65): n is a, c, g, or t
  misc_feature (102)..(102): n is a, c, g, or t
  misc_feature (156)..(156): n is a, c, g, or t
  misc_feature (305)..(305): n is a, c, g, or t
  misc_feature (338)..(338): n is a, c, g, or t
  misc_feature (373)..(373): n is a, c, g, or t
agaaaaagaaaatagagagncaagaagagaacctgaagaataccaccagaganctancaatggtncgaatgaaatccatgtttcctattggcttttgttttnctcccctaatgggaatgttcaattccatatttgatggtagagtggtggccaaancttcccttttacccctctttcttacacccaaggactgtctccatccgaaactgctggggagatgacaccacagactgttcccttcattttccctgtatattctctgtacttatgtccgattcggcaggacattcaggaaggatctcggncctttcccccttttaaggagcccgccacccagnagggcaggtgggatttctttggggcccaccacctnctttttggggggaggttttttttggaccttaaaggactctttt

SEQ ID NO: 507371 - DNA, 347 bp, Homo sapiens
agatcagaaggatactagttaagactttggggaaacaacctccagttgctctttatgaaacaatgatgtgacttcgttagaagacaaaggagagatgaatgatatgaaattcttctaagatcagagaatgcaagagcacctcctgtagggtaattactctgaagaaggcagaggagattcttacaaagctgcgtacaagattccaaatgaagagtctagaacataaataccctgtctaattacaaaggtttaatacaatctctgccgtaaattgggagatgtgatgtgaatgcatatagttgagaatggccctcgagatctggccgcattaggaaatgcattgacaa

SEQ ID NO: 507372 - DNA, 145 bp, Homo sapiens
gaacactcaggaaccctctcttacccagaagcctgttacacagcaaggtctccccacaagcaactatactctgccacatcgccaccccgtgcctattgatctagcacagacccttcacccctcacctcgaggcggccagtagtgg

SEQ ID NO: 507373 - DNA, 166 bp, Homo sapiens
gaacagtgctcaacagagagaaacagcattccctgtgcagtatcaccatgccaggcctcagtcaggaatctacagcttcccacagcagcccaggacccaaagacacaacattgtcccctggtagataccacagcatcatcccttggtccagaatatactaccttcc

SEQ ID NO: 507374 - DNA, 423 bp, Homo sapiens
taataaagcagcgacatgaaagcacacagaccagagctctggggtcgaaataaagcagcaacatgaaagcacagagaccagagctctggggtcgaaattcatacacctttgcacagggtagaggagtctcgacggacagccaaaatttttcacaggcttatatagtaaaactcaaagggggagaactgggcagagaaagtacaagtttacatcactagggagttctgccaaaggaatctaccgtaactaaggagccatgtcctcctcatttattttgaggttgttccaggaggcctttatctcaaaaatgttcttggaacagtctttagtttgggagggttcgaactttaggatgaggagttttgggggtgaaaagtttaggagtgttccgagaacaacctctagatgggaagggggtgggct

SEQ ID NO: 507375 - DNA, 165 bp, Homo sapiens
  misc_feature (135)..(135): n is a, c, g, or t
ctcaatgggcaagccatggaaaggaggtggaaggcaattgtgcaccatccccggggttactttttggggggttccctttcaaggagggttcaacttgtttaatgttgggcccttgccaccttgcccccctgggcncctttgccaagggttattatcttacccaat

SEQ ID NO: 507376 - DNA, 488 bp, Homo sapiens
  misc_feature (23)..(23): n is a, c, g, or t
  misc_feature (67)..(67): n is a, c, g, or t
  misc_feature (152)..(152): n is a, c, g, or t
aaaaaggatttgctcacatttcnaaaaattttatctttcccatttcttttgtctatgaataaaaaanactctagatttttttctttatttcccaaaatatgggaagtaatcataatttaaggaataaatgacaatcacagaagggttaaatnccatataatgaaatacctacctgtcattaaaaatcatgtgtataggtcaggcaccatggctcacacctgtaatcccagtgctttgggaggtcaaggcgggaggatcacttaagggcaggagtttgagaccagcctggtcaacatagcaaggcactatctctacaaaaaacttaaaaattagccaggtgtgatggcgcatgcctgtagtgctagctactcagaagctgaggtgggaggatcacttcagcccaagagttggaggttgcagtgagacatgattgtaccactgcactccaacctgggcaacagagagagatgctttctaaaatacaaaac

SEQ ID NO: 507377 - DNA, 259 bp, Homo sapiens
gttttctgggctacttatgaccagacttatcttaagaagtacacttttgtaacaatgtagtcacacgcatctgataaatccaagaagaagtgtgcagaatatgtaagatatttgcgcatttataatcactatgattaatctctctctcttctctttgagcagcttagcagtgtctgcaataacgaatctttgcctacaacctgttaactgactggactgttggtaacaaagtaattgtgagaaccatgtcggtcaaaaa

SEQ ID NO: 507378 - DNA, 945 bp, Homo sapiens
ctcgtggtgccacacaacgtttttcccgcacagttacggtgcgtccccttaattggccgcgctcttcaccccgagagcgagtgtttgcgccatgacgctcaaccgttgtgcgacacacaccacgaccgacccgttgtttaaacaccattctagagctggggtgtaggaagctgcgccccccgcaggggggttcctcctgacactatccgctgtgacgccgtctccctttagtttacagcgtacatccttgggccaaacgcatggggaagccgcccctcctttttattcctgccaacggtcggttgcccagttagcaccacttccagggggcggccgcacgaaaaaccacacgccctgtgccagcacgccgggaaccatccaccaaggggggaccccagaaagctccgagggcgtctcccaagcagtaacataacgcaccagccgggtcagaaacaaaggcccacctgtcccccgccagcaagacgacccaagtgcggatgctgcctcccagatgcctcgcagtcacagggaggccccacccccggaccacgctcatgtgttggggatcccgccgcgctccccccgcggacaacggggagggtatatagtcgcccccccccggggaaaaaacaatggggtatttgacctccactccgcctgggaagtgctcccacacaaggcaccgtcacgcccccgcacactgtccccactgttcgtgtgtcggctctcgcacttaatattatgatgaaaacaggcctcaccccctattttatttgggtgctccaggataggggcgtcctgattactcataaaggttttgctcgcagtgttctgtaaaaagtgtagaaaaataccgcgggtggtccttcttcgcagctatcaactagccggggcgtcccgctcggccccaaacaaacaaaaagaatttttgcgccccacaagaca

SEQ ID NO: 507379 - DNA, 215 bp, Homo sapiens
  misc_feature (212)..(212): n is a, c, g, or t
tttgtatatccagtttgtatcttccaaatcttccatagtattttcctctatatgtccatgcattagtccattttgcattcctataaaggaataaaggaatatctgaagttacctaatttatgaagaaaagagctttaaatggcttacagatctgcaggctgtccatgaaacatggcaccagcatctgcttctgttgggggaatcctggaagnctt

SEQ ID NO: 507380 - DNA, 216 bp, Homo sapiens
  misc_feature (6)..(6): n is a, c, g, or t
  misc_feature (71)..(71): n is a, c, g, or t
  misc_feature (73)..(73): n is a, c, g, or t
  misc_feature (82)..(82): n is a, c, g, or t
  misc_feature (99)..(99): n is a, c, g, or t
atccgngctacaacgccaaggcgatcttcatggcgttgttcttcgtgatcttaaagccctgcagggcatcngnagctttccntgcctgtacctcaccgncaaactccacgaaggcgatgtcatgccgcccgggtaccagacggacctccttgaagccagggaactgattgaaaagcatggacagcatgagctcgttgatcgccttggcgttgtagc

SEQ ID NO: 507381 - DNA, 718 bp, Homo sapiens
  misc_feature (521)..(521): n is a, c, g, or t
  misc_feature (534)..(534): n is a, c, g, or t
  misc_feature (537)..(538): n is a, c, g, or t
  misc_feature (546)..(547): n is a, c, g, or t
  misc_feature (549)..(549): n is a, c, g, or t
  misc_feature (569)..(569): n is a, c, g, or t
  misc_feature (620)..(620): n is a, c, g, or t
  misc_feature (635)..(635): n is a, c, g, or t
  misc_feature (684)..(684): n is a, c, g, or t
cggtgcccttggtagcacttcaaggggaactctgttagtggagggaagaagtaaccctgtgaaaccgtttccacctgcccgatccacatggtgttccgttccatgtaaactatggaggacattctctttcctcgttcaggactacactcatattggggacccctcaagtgcacgatgggtgttgcctccccggcatattttgccgaaaatccgagaacgttcgatttgcttagtcctgaagagtatcttattctttgccagaatttgttaagtagcccagtgaagacgattcctgtgctattcgacctttcccaaatgggcaaaacctggtgtcgtattcgggaacaatgcatcgttgtgaacccttggctggaatcatggtccacagaacatcataggtcattcattcacgcaggctggccaaggctgaaccgcatcaagacaagtctggctgatttttcagccgtcatcatgggttctagtgtgtgacaggttgtgtccccaagggactggactgggancaggtcaaccacnccnnggggggtnncnccagcctttttttttttttnttttttttttttttttcctccttaagctgctgtcaatccaaaccattggcntcatcgtttcttttnaattaaaaccaacatatcagcaatagtctgctctccccgggaatctctnacatgctctgttacatcgaaaagacttaggagac

SEQ ID NO: 507382 - DNA, 1484 bp, Homo sapiens
ggcgaacgcggagacgcacgccatgaaggcctcgggcacgctacgagaagtacaacggtagtgggtcgctgtcctgcccaaccccaaatgccacacgccgaccctctaccgatttacgaatctatgcgcctaatcatgtcgatcgccaagtcccgctttctggctactgttgtaatctcagtgtaaggaagactgaagcacagtccttcagggcgatgattcgtcgtacttagtgagagcagagtagtcttgacgaatgtcccacaccgtgtcggtgttgaacgaatcttactgagcgagtctcggtcgtgagggctaattgatcgtccgcagagaatcgggggaagcacacaccatagcaattggtaatctctgagtgtacattaacccaggggaacctcatagataacaacagctgtacaatgagccagaccatcgtccaacacccacactggagtaacccgaacgcaccagtcgagagttgcattcaagaggagaccgctggtcggcacaccaagaaagggcaccccaagcttacaccaactttcaccgaagttcctattagcacaacgggctcgagaacgcgaacgtagtacagcccgggtacactaggaccaaaagtttgccccagacacggcgacctcgtggccatggatacacagggccacgatagtcccacactgtaagattcccagcaaggaatgcacgagcgaatctccccacccgggacattgaccgccagccctacagcacctggcggcacatcacccttgaatggaaccgcgcctccctagaataaaccaataagcgccaccaaaaggtccaatatctgcagcgccaaaacacaatcagataaagagtagagccaccaaaaacaacagccgattaataccctttaccattacaagtgatctgaccacgaagatgaaccgacccatatgacgagttactccacgtaagacagactgacctagaccaaccacctcccaaaacaatgattaaacaaaaccactttcacataggggcaccaaacccctgtactcccaccaccacgtattcctattctctaaatcaacaaccaacaattcaatccacaaccacacaatcacaatcgtagctatcacacaacacaccatctactctaccatactcgcacataacaccacacgcactaccaagtacaatacaacaagactaacagaactattgaatacatcaataatcactatatatcaagatacatatcataaatctactcactaaaacaataatacacatcccaacatgccacatatcagctctaccacaaacacaataaacatcatcacactctccgcacaatttacaattccaaactaaacactcatcccacacacaacactccatatcacactacctcaacctctacgctaatacaaacgatgacatatagtaccactaaggtacctaaccctacaaccacgcacatcctaccctatcattca

SEQ ID NO: 507383 - DNA, 413 bp, Homo sapiens
  misc_feature (45)..(45): n is a, c, g, or t
  misc_feature (47)..(47): n is a, c, g, or t
  misc_feature (300)..(300): n is a, c, g, or t
  misc_feature (347)..(347): n is a, c, g, or t
  misc_feature (377)..(377): n is a, c, g, or t
  misc_feature (388)..(388): n is a, c, g, or t
agacacagagaagttgaaattgagggaatggattacaggcgtgcncncacacctggccggttgtttatatttaattgtctttttttcactaatgaggaccaccttgtaaattctgggcattttcagagttttctcttccatgtgaattgctccagctaacttaatattagtttctcaagggtttgtgtaggacctgggctttgtctctttccatctgtttctctctttccctttaacgtcacttgcctgagggtctataagggccctttaagggttgccagcccagagccaggaagaggntggggtgtccctggaagttaaggaaagccacctttggccctacaggnggggtgtttcacagtgttggggtgttgggnagttcacaggnttgactttttgggggggccccaggg

SEQ ID NO: 507384 - DNA, 130 bp, Homo sapiens
acatgtatcgcgcgcttgtatgcaggcgctggaaccgacgcaatgagcagccgcatctccaccagcatgatgtacaaccagtcggtgtcgctagatgataggccaagcaggccaagctcagccacctggg

SEQ ID NO: 507385 - DNA, 111 bp, Homo sapiens
gccgagtgatgcgtgcgtcgtgcaggcgctggagctgccggcggatgcgaagcagcgctgctggagatgaccccgggcagctacaccggcctggccgagtcactggcgaag

SEQ ID NO: 507386 - DNA, 117 bp, Homo sapiens
tggcgtttggcagtttataagttattagttttataaaatcagtactttttaatgggaaacaatcttgaccaaaatattggtcacagatattttggagaccctattaaaaaatgttaa

SEQ ID NO: 507387 - DNA, 227 bp, Homo sapiens
ggggcccccccccccggggggcccccccccctttttttttttccccctggggttaaacggggggaaaggggggggggggggcccggttttggggcccatcccccttcccccttgggggggaaaaccccttttaaaaaaacccccccccccccccccccttttttttttgggaattttttggggggggggccccaaaaaaaaaaaaaaaaaatccttttttttttcca

SEQ ID NO: 507388 - DNA, 541 bp, Homo sapiens
ctctgtttgagacttggctttaccattactctgtaaggatccttgagcaagtgatttaaattctccaagactcagttatttgtaaaatgatgccagaatgatattacttgccttattttattgcagggttgttctgaggacaaagttagggaacaggtgacaaaggtacagtgatgtacaaatggatgctgttattatggcagcatctaatatatataagggtaaatgtcctgagctgtgagtgggacagatttgcctttagaattgctctgctgtttagtaatttggtgctttgggccaaagcaccacaatctttttgaatttcagtactctcatctgtataaaataatcaacatcacagatttgtgagaattacattaatgtagatactatatttaaatttttgtaaaatagtgatggggtaggagttattatcttgaacagatttcagaaagttagaaaagagatagccagagattttttatctgttccaaacatcttaataagataaattactcatagaatgttagaatgctagaag

SEQ ID NO: 507389 - DNA, 450 bp, Homo sapiens
tatatcggtgcactgtgcatactacatcaatcagacacatgttcctcgtagtaacggccatactcatccaaggcccctgaagctgcaccggctgcagtcattctcataatctgcccagggacttacatcctcattactatactgcctagcaaactcaaactacgaaaacgggagcttcatcggccgatgaagatgccgttttcgtacacgccgatgtaagcgcgccggtagatgatgatgccctgcacggagacactgaagccctgatacaggccccggatgccgtcggcttcaccaagagcagtctcccaggcctcggaaactcgcgctctgtgcctgactttcccaagtacgatagcaaggcgggttctggcaaaatccagcgggtacacgaagcagagggaggtcgggccggccgaactgcggaggccaggttgcctgaaagtactc

SEQ ID NO: 507390 - DNA, 1442 bp, Homo sapiens
  misc_feature (1026)..(1026): n is a, c, g, or t
  misc_feature (1182)..(1182): n is a, c, g, or t
  misc_feature (1334)..(1334): n is a, c, g, or t
gtgggacggtggaggctggcacctgtggccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagcangacctctctctaatggggggtggcgggggggcggacggaatgcggacccggcgctactggaccccctggaatctctcattcctggaaatcgcctccttaaaaaaaaaacacaacaaaaacaactcggcggacattacgatgcggggcggcagccanagacgggtcactcaaacggtgcccacagggcatcacatcaaggtgtcttgagcccacccttttgtgccaaacggggcaactaggcgcggagcccccaaaagtcagggccgatattcacaacacgcatcatataatactcgtctgataacacntatctgatgccggatccagtgacgcaggtcacatcgattccaatcatcacatacgtgacactgagcacacactcgatcatcacacgctactcacgctcatcacattgg

SEQ ID NO: 507391 - DNA, 1951 bp, Homo sapiens
  misc_feature (472)..(472): n is a, c, g, or t
gtgggacggtggaggctggcacctgtggccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggacacgggggagattgaggtgggacgagagaagcagangcgagagagacggaggctgctggaaggacgaaagaagacgggtgaggaggctgacagagggagaggaggaagaagaggtagaaggagagagaaaggggagagaacggagagaggagggttggaggtgcatgaaggaggggagagggagcttcagcgtggagagaggaccgcggaaggagagagagacagcccagagtggaatgtggaagggaaacagtccagcggggagccaggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcaggggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaagaacaacaaaacacaacaa

SEQ ID NO: 507392 - DNA, 1991 bp, Homo sapiens
  misc_feature (472)..(472): n is a, c, g, or t
gtgggacggtggaggctggcacctgtggccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggacacgggggagattgaggtgggacgagagaagcagangcgagagagacggaggctgctggaaggacgaaagaagacgggtgaggaggctgacagaccgggaccgacggacggacacgaacgaccggtacgacgggacgacgacgcaacagggcgacgacgcacacgcgccgcacacggacggggttgcgagggttgcactgacaccggacgggggcgagagggagcttcagcgtggagagaggaccgcggaaggagagagagacagcccagagtggaatgtggaagggaaacagtccagcggggagccaggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcaggggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaagaacaacaaaacacaacaa

SEQ ID NO: 507393 - DNA, 2211 bp, Homo sapiens
  misc_feature (472)..(472): n is a, c, g, or t
gtgggacggtggaggctggcacctgtggccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggacacgggggagattgaggtgggacgagagaagcagangcgagagagacggaggctgctggaaggacgaaagaagacgggtgaggaggctgacagagggagaggaggaagaagaggtagaaggagagagaaaggggagagaacggagagaggagggttggaggtgcatgaaggaggggagagggagcttcagcgtggagagaggaccgcggaaggagagagagacagcccagagtggaatgtggaagggaaacagtccagcggggagccaggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcaggggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatgggagaggctggggcagggccttatgtcttctcctagtacaaccaaacagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaacacacacacacacacatactctcacacaggaaacgacctggaagaatatttggtgcttttattttttagattatttgtgtttctgaaatttctacaattaataaatactgcttt

SEQ ID NO: 507394 - DNA, 323 bp, Homo sapiens
atcacagcagcgaccacagctccagtgatcacagctccaaagagaaccaggccagcaatgatgcccaccatccccatcgtgggcatcattgctggcctagttctctttggagctatgttcgctggagctgtggtcgctgctgtgaggtggaggaggaagagctcttatagaacaggagggagctactctcaggctgcaaggcagtgagcagtgcccagggctctgatatgtctctcacagcttgtaaagtgtgagacagctgccttgtgtgggaccgagaggcaagatttgttcctgcccttccctttgtgacttgaagaacc

SEQ ID NO: 507395 - DNA, 465 bp, Homo sapiens
aattgacagatgcattccctttattctgtggaagcgagctgagagagactgacaagagtaggttcagacaggtgagacgtcgaactatgtgtcggcaagttgaaaatgaagctatgtattatagtccagacctactactcaataccttagacgatcggcgcgtctctaataaggttgaaccagatacaagtcatttaattactcagtggcttcatgatgtggactgtttctatggtggcttcatgacagaacagatgtgtgtactcggactctgtgctcttatagatatggaacagataccccaagtttaaaatcaggtatctggacagatcatgccggcttacatccttctattataccggattgacaacgagcatatgcctgacatgcagaacatgagcatgacagctgatgatgatgatgacagctgaacataatgatgaaaccgaggaaccggggagtgac

SEQ ID NO: 507396 - DNA, 2678 bp, Homo sapiens
  misc_feature (472)..(472): n is a, c, g, or t
gtgggacggtggaggctggcacctgtggccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggacacgggggagattgaggtgggacgagagaagcagangcgagagagacggaggctgctggaaggacgaaagaagacgggtgaggaggctgacagagggagaggaggaagaagaggtagaaggagagagaaaggggagagaacggagagaggagggttggaggtgcatgaaggaggggagagggagcttcagcgtggagagaggaccgcggaaggagagagagacagcccagagtggaatgtggaagggaaacagtccagcggggagccaggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcaggggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatgggagaggctggggcagggccttatgtcttctcctagtacaaccaaacagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaacacacacacacacacatactctcacacaggaaacgacctggaagaatatttggtgcttttattttttagattatttgtgtttctgaaatttctacaattaataaatactgctttaaaataatcaatggttatttgtaattttaaaaaatcaaggatttccattcaatgctagatgccacaagtgggtgacattctaagaaaaaatattggcgatatctacattgactagaaatttttatctagaacagactttttcaactgaagttcctcatctgaatctcaaaaaccagcaaatatggccaggcacggtggctcacgcctgaatcccagcactttgggaggccaaggcaggtggatcacttgaggtcaggagttcgagaccagcctggccaacatggcgaaactccatctctaccaaaaatatgataaaattagccaggcattgtagtgcacacatgtagtcccagctacccggaaagctgaggcaggagaatcacttgaaccccagagagggaggttgcagtgaggcaagatcgcgccactgcactccaccctgggcgacagagcaagactccacctca

SEQ ID NO: 507397 - DNA, 210 bp, Homo sapiens
tacgaggatcccgtgcaccgtacttctcaggtagaattttttctcttggtattagagaacctccatgaggtcagatgtgggctgagggagaggcaaacagtgcagtaagggtaagtgctcttaagtgtgagccagcgtggttaacttgtccgtcctgagtccagtctcttgacctggcatgtcactgggcaaggagaaagtacggttgca

SEQ ID NO: 507398 - DNA, 2631 bp, Homo sapiens
  misc_feature (472)..(472): n is a, c, g, or t
gtgggacggtggaggctggcacctgtggccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggtaggaaccgctgcccaggggagctaggaggaagcggggagagagagcgagcgaaaagcgggggtggggaggacacgggggagattgaggtgggacgagagaagcagangcgagagagacggaggctgctggaaggacgaaagaagacgggtgaggaggctgacagagggagaggaggaagaagaggtagaaggagagagaaaggggagagaacggagagaggagggttggaggtgcatgaaggaggggagagggagcttcagcgtggagagaggaccgcggaaggagagagagacagcccagagtggaatgtggaagggaaacagtccagcggggagccaggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcaggggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatgggataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaacacacacacacacacatactctcacacaggaaacgacctggaagaatatttggtgcttttattttttagattatttgtgtttctgaaatttctacaattaataaatactgctttaaaataatcaatggttatttgtaattttaaaaaatcaaggatttccattcaatgctagatgccacaagtgggtgacattctaagaaaaaatattggcgatatctacattgactagaaatttttatctagaacagactttttcaactgaagttcctcatctgaatctcaaaaaccagcaaatatggccaggcacggtggctcacgcctgaatcccagcactttgggaggccaaggcaggtggatcacttgaggtcaggagttcgagaccagcctggccaacatggcgaaactccatctctaccaaaaatatgataaaattagccaggcattgtagtgcacacatgtagtcccagctacccggaaagctgaggcaggagaatcacttgaaccccagagagggaggttgcagtgaggcaagatcgcgccactgcactccaccctgggcgacagagcaagactccacctca

SEQ ID NO: 507399 - DNA, 1862 bp, Homo sapiens
gtgggacggtggaggctggcacctgtggccctgcgccccacgtggcgccctttccgggcggggggggtggggaggcacctccagcgacaactctcccccctcccccggcacccggctgatttgctgtgccactgggagggttcgggggtggctgagctgagagggctccgggaaggagtgacgtcagggtgagtgggagcccaggaaggagcgagtaggagagagggagcgagagccaggcaggaccgcagggtcggggctagtgaggagcgagggcaaggagagagcagtgaggccggagagaaagaagctgccgcggaggaagacaggctgcgggttcccgggactgcaggtccaggcagggacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggcctaaagatccctcctggctgtgagctggtggtcggcggtgagccccagtgctgggctgaggggcactgtctactggtggacgactcttttctacacacagtggctcacaatggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatgggagaggctggggcagggccttatgtcttctcctagtacaaccaaacagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaacacacacacacacacatactctcacacaggaaacgacctggaagaatatttggtgcttttattttttagattatttgtgtttctgaaatttctacaattaataaatactgctttaaaataatcaatggttatttgtaattttaaaaaatcaaggatttccattcaatgctagatgccacaagtgggtgacattctaagaaaaaatattggcgatatctacattgactagaaatttttatctagaacagactttttcaactgaagttcctcatctgaatctcaaaaaccagcaaatatggccaggcacggtggctcacgcctgaatcccagcactttgggaggccaaggcaggtggatcacttgaggtcaggagttcgagaccagcctggccaacatggcgaaactccatctctaccaaaaatatgataaaattagccaggcattgtagtgcacacatgtagtcccagctacccggaaagctgaggcaggagaatcacttgaaccccagagagggaggttgcagtgaggcaagatcgcgccactgcactccaccctgggcgacagagcaagactccacctca

SEQ ID NO: 507400 - DNA, 135 bp, Homo sapiens
acacatgagtcacagagatatgagcttagtgagtccagacatcaggctagtgattctaattaaagaaacaaaagggggggggagttcccgtacctggttcagtggttaacgaatacccactatgaaccatgaggt

SEQ ID NO: 507401 - DNA, 548 bp, Homo sapiens
agccctatccatctttacgtcacaggccctccagttcctgttgaagctgagaatggcagccatgtcctcctcactcaactggaagtcgaagacctagaaagacaagagttccaaaaccacccttagcaagcaatctctttgatcttgggaatctccattactacggggtcttctggcttggcactagacgaagaaagagagctggagtaaaaatcaccatggctactgtgtgcccgtgaacatccctgccaggacagcatcaaggctgagcactgcagcatttttcctctgcaaggcaggcaggaagatctttccccctggattcgtgcataggatctagtactttggcaatttgaaaatactgccccagcacaggacatcagaaatggaatattccaggggatcagacatgctatcattttaaaaacactttaccctgacaatcccacttgggttaccaacacattgccattggtatattttatcttgtgccttggaacttacatactaatagaacaaattacaaaatgctaattttaagaaggata

SEQ ID NO: 507402 - DNA, 677 bp, Homo sapiens
agggagaaaaaagatttcctttataagcagagcaaaagagtacatgcttggaccacctcgcagtgttttatagcccacctgcctcacccagtgttgtccagtggtggcatctagcttgtacgtgtcatttggaaagattgtgcttaccagacatcctgattcaacaattgtctattgcaatacgttcatttaaacatcgctagttcacatcaaggcggatcagtttccaagggttccttaccctggtacattcatgagggttcttagaatgctcatgagccctgactgtattgcactataccactctttgtacataatagcaactattccaggctaatcacagtcgtatgcgtgagtcttttgaaaggcaagaataaataatatccagtgcaattgatcagatttctcagtgttttcccatatactagtgtataagcttcttgattggttggctgactatgaaccccatatgttcatgtcaaaatagtaccttgctctttaatataatacatagtctccaaataggtgatcattggcgatggattagattttcaaagtacattcatagatatctgttattctggtaagggtcaaaaccgtgtgtgaaggcagctccctgatatgatagctttttggtaatctgcgtttgtctggtcccttaatgatgtgtgattaag

SEQ ID NO: 507403 - DNA, 958 bp, Homo sapiens
agcggagtacggcctcgcggagccggcccggcggaccgtgacgggtcccctcacctcctcttctctcccctccccgccgcctctctccctcccttcctccctcccgtcgctcttctcacgccggacggctcccgctcgcccgctgcccggttggtcctcttctccagcgcgcggggccgccccgcgagccccgaggatgagaccccgcagcctggaggagggctgaccggggctttggatgcttgctgctagagggtggtggagagcaaaacagaaggagacacgtgaccggaagacgagaggtgagagcctgggattcccgagagacatactcttccttgtactcctcctctcctctctatcccagatgtggcacgtgggctgacactaaagacttaggtagccccatcaaacccgaactggcatggtcttccgatggacaactggaaggtcagacacgtatttcgaaaaaaataacctactgcgtgacaatacgagacaatggattccttggtatgagacaatcaaacaacaaacgcccaggagaaataacgccaggtccagtgaacgttcgcaagacatgtatcccaacatgattcttccaaaaaaaggctcctaaaaccaacatgtgaagctccggtataggcaagacttgcatggctggaacgaacagactggataaataaccgatagaaataaaccagagtgcgccattaaaatatatctatcgatgaaaaaccccctaaatcaagcggattagcgataagcagacaaaaagttaagaccgcagttgacaaagcatacaactaagggggacaactagctacacagaggcagatacacaactgtcgaacaacggtaaacggcgatggtagccacgacgctaagtgcaaacaacgatgacacactgcagtatcccacatacgtgttcttgagatcaccacaccgatagcagaaa

SEQ ID NO: 507404 - DNA, 132 bp, Homo sapiens
tgtcacgctcagccagcagtgtggaaggaaaacagacaaaaggctcatcaaaaacagcaggaccaaatattgagcaggctggcagaaccagttcttgctaggtacaccgccaggacacacgactccaggtag

SEQ ID NO: 507405 - DNA, 343 bp, Homo sapiens
  misc_feature (32)..(32): n is a, c, g, or t
cagtgggtgttctagaggccatctggggttgnaagccaatggtctgcacacttcactgggtgacagtctgtgttccaagttccacgaaatagctcaagaagttaccaaagtaagacttggcctcggcctgaagctctgggctcttgaccttctccatcaggtccttgccatagtcagtcacggtctgaaagttctgagaaccgaggtctctccacacatggctcctttcctgtctcgaccaagctcttcaagtctgcagatggtgagaagtagcacagttgctgcgagcagcttcatgttggtcacagtggagagcgcggcctagacagcgtctctgtccgcg

SEQ ID NO: 507406 - DNA, 637 bp, Homo sapiens
caccggcgcgctggacaactcaccaggcgggcgaatcgtcagcgacggtagccagacggtcaccgccgccaatgtggataaccgcgcgggtgtgatcggcagtcaacaggcgttgaacctgaccactgccaacctcgataacactgccgggttgatcaacagccaggctgatttgactctgaccgggcaaacagtcgactcaagcctggatggcgaaatctcagccaagggcgacttgaaactcatcgtccaacagctgatccagcgccagggccgcttgatcggagaacgcgctgtgagcctcgatctgcaaggcggaaatctcgaaaacagcgcaggcttgatcagcgccaaaggtccgctgaccttcgcgcgcctggctaacctgaccaaccgagaacaaggcgaaatctccagccagacggcgttcaccatcgccgccaaacgcatcgataacggtgatcgcggggtcatcctcagtgccgatcaattgcgccttgaagcggataccgtggtcaacgccaacaagggcttgatctccggctggaacggtctgacggtggtcggcaatggcctcgacaacagcgccgagggcacgttgtcgagcaagaggcgtccgtagcggccggggatctct

SEQ ID NO: 507407 - DNA, 326 bp, Homo sapiens
tctctagaggataccctgtcagagtagcccctgttgtcaacggtggggtctgcaatgaccgagtcaatggcttcagctgacacctgcccctcgggcttcagcggctccacgtgtcagctgtactgttgtgacgaatgcgccagtacgccctggaggaatggcgccaaatgcgtggaccagctcgatggctacgaatgccggtgtgccgcgggcttttgcgggcacagcttgtgtgatcgctacgtggactactgctcccctatcccatgccatctatgtgtctctgcgtgcttggcattgccggtttctcatgtgtcctgtgctct

SEQ ID NO: 507408 - DNA, 1371 bp, Homo sapiens
  misc_feature (1025)..(1025): n is a, c, g, or t
  misc_feature (1158)..(1158): n is a, c, g, or t
  misc_feature (1274)..(1274): n is a, c, g, or t
ggcagaaagttgacgaagtcatgtatgcgtacgagcagaaggaataccggaagcctatgaaggtgtgatgactggtgcgcgaacggtgcatgtagaggttctctcgaatctcatggtgcccataggaagggggtaagcctcaattcgctcgacagcacatccctgtcccttatgttcggagggcaatatgaggtgatggttattcgcttgtatgttgccattgtaattccacgtaaaggacatcgtccctagagatggaacgtcacttcgagatctgcgtagacattcgcgaaggattagtacataaagcaatacatatgaaagtggaagtacatgggttcttcgtaaagcacgtcgttttacaagaacattcaagttgtggagatgggtttggagatacgcaacggggaggggttagcacggtgggtaggctattaacaagttcggctacaggaatgcgctgagatagtaaatcacataactgttaagagtggttgactcttcgggagaatggcctgctcgtacgtcccagggcgcatataaaggaacccctttccagttcaagactacctgatgtatgaacatgaccgtgtcagtaggcctaagatatatcatgcgccacggcggaaccgagtatgcgtggaattcaatttactcattgtggggaatctggccaccaggggggagcacatgacgggcgcttgagttcttggactcttggtaaaggtccagccgttgcgacttaaatgttagtgccattctagtttcaacatcctgtttgaaccgtggggtaacctttacttagaggataccgcgccttctaaacttcggaacgaatttcccccttccattaaacgtaacacgaaaaaggaagcgagcacaaaggaatgaaaaggtggttggttcaaaattttttggaacgccatacggtttacagcacgcccataaaagattctcgggagataatttacaaggcaaaacatgggcttattaaaggagacattggtccgttgagatgaaagagnggtgcgtataggcgtggagggtatggcttttttaaccttgtttcgttggacggacataaggaagaaaggaaaagggtcgttgggcggagtcaacattgggcccgcctatggaaatcggaacccgaagaaggtnaaatgaagggttggaaaagcaaattgggttattacggagaaaggagagcactgtgaaacagcaaaacactaggggacgggaaagaaatttaccgttggaaggagacatttttgacntgtgagttgagaagacccttgttggggcacaaagcgcacatgttttgtgcatcttccacatggaaagggattggtggtagggtttgagaaaaccttc

SEQ ID NO: 507409 - DNA, 850 bp, Homo sapiens
ccagctgtacgctccggattacgggatctggctcccgggcggacggagccgcacggtagtagatgggtggtgtggccgtggcccccgactctgctcggcggggccgttcctgctttgccgtccgtgtgggacttccacgacagtggaggcacgagagctgggccccatatgctgcttgcccatgcttgggaaagaggaggctgctgcaaaggacctgatcggcgggtaccgtacagagtgtgatttgcatgtggcagtggcatgtgagcccctcttcccctgcgccgttctgggaggttatctacggcagccaccttcagggcaacctgtccctcctgagccccaaccacagtctgctgcccccgcatctgctgctcaatgccagccactggcgccttcctgcccctcgggctcaagggtcaccatcgtggggctctaccttggcctgtgtgtgtcggagggctcctggggaactgccttgtcatgtacgtcatcctcaggcacaccaaacatgaagacagacaccaatatttacatcgttaaaccttggcccctgtgcggaactctggtccatgctgacgctgcccttccagggcacggacattccttcctggggcttctgggcagtctgcggaatgcgctgtgcaagacagtacattgccatatgactactaccaacatgttcaccaagaaccttacccgctaacttgccaatgacgttgtcggattcgagtaatgtaagccattcttggcagcgccatcacggttgcgctcgaaggggtccggacggtccgaggaaaaaggcccaaggcttggtaaaagtgtgccattcttgggcctggccctcatg

SEQ ID NO: 507410 - DNA, 136 bp, Homo sapiens
catgacagctccattggtgatcaagaccaccacagcggcaggtgagtgccaagttgtacatcgtgcattgtgtctggacctgagaggccgtgagctcgcacacacatgacttgcactctcgccgcccccccaccct

SEQ ID NO: 507411 - DNA, 186 bp, Homo sapiens
cgtagtcccagaggaagaggagttgtacccatgtcagagaggatacaggctaaaaacaatttaacagtttatggatgatggaattgacttaaatcgaacctaaattggaatgtgaatctgcatgtacagaagcctattcccaatctgatgagcaatatgcttgccatcttggtggccggaactcgg

SEQ ID NO: 507412 - DNA, 172 bp, Homo sapiens
  misc_feature (162)..(162): n is a, c, g, or t
agttaacaaagtgctgtcacctatattgtttcatttgatcctcacaaaaagtttatgagattgtttaactctccttcagaggcaggacagcctaggcccagagaggacaagtggcttgccaagaggaatacagtttcttagtggcagaagctcaaatccagnttttctcacc

SEQ ID NO: 507413 - DNA, 188 bp, Homo sapiens
acacagtccaagcagttagctacaggccccgagcagctggtttagccaatcctcgaacctcctcatgggatggcaagaccagagacgcctggagccctgatacctactccagccctctgctcctctcactgaccaggaaacttcccttaagacacgacagccctaccggtcatctgcagccccagaca

SEQ ID NO: 507414 - DNA, 437 bp, Homo sapiens
ggggcggttttcagcggctacgcgcatttgtggaagaaacccgagacgttccgaagtcaaggcaagctaaggggagtgcgggtcggcgagggatattctttcggaaacgtcatattggcctcggggctctccagccctttgggacttccaatgggatcttagaagcagccgatgcagcgtgagggcggcagcccagggccagccacgattcgaacgctctgccttgcagctcttctggaccgaggagcccaaagccctacccttaccattcaccaggtcctgtgcgaagagcagagtggaggtgggctgtggctagaaggtgcagagcgtgcaacaagattgctagctgggcattggacatctgctcttgaacaggccctgggcctgccataggggaagttctccagggatcagttctcatgcgcgcgtacactggg

SEQ ID NO: 507415 - DNA, 365 bp, Homo sapiens
  misc_feature (42)..(42): n is a, c, g, or t
  misc_feature (44)..(45): n is a, c, g, or t
  misc_feature (255)..(255): n is a, c, g, or t
  misc_feature (318)..(318): n is a, c, g, or t
gtctcccccagtagccgggattacaggcatgctattgttttncnnctttttgtatttttagtagagacgaggtttcaccatgttggccaggctggtctcgaactcctgacctcaaatgatccacttgctttagcctcccaaagtgctgggattacaggcatgagccaccgcacccggccggcagttatctttcttaagtagcagttctatttctcagtataaattaatgctgcagttcctaaaccatttgctgangtgcctcagaacccagtagcaagttcgtggggcacagggataagttcttcaaggggaaggcgnttgcaattattggaacatttatttggaattatttcagggaaccacca

SEQ ID NO: 507416 - DNA, 111 bp, Homo sapiens
gggcacagtggcttacgcctgtaattcccaagaaagtttgggaaggccaaaggtgaggcggatcaatgaaggtcagagacagattagatagacaccagacctgtgacaaag

SEQ ID NO: 507417 - DNA, 270 bp, Homo sapiens
atcccccgtgacttattactagtatcaacatcacaagataaagacactactggtatcacctgcccatatcctccttagtagtcacccaaagacatttgactactagactgtggttaattagataacttatacttgactaccaatttaccaatgcttttgctttccctcaccatcttattcccctatgggccccccaaaagatggccagcagcttgctatgcagcagcgtgcatgcaccaatcaacaacaggcagcaaccactcagcaggc

SEQ ID NO: 507418 - DNA, 201 bp, Homo sapiens
aggcgatagaaattgaacctgcgcaatagatatagtaccgcaaggaaagatgaaaattataccagcatatatagcagggactacccctatacctcctcataatgaattactgaaatacttgcagggagccaacctagacccccaaccaacagctactagcacactaagggcacacccttatgacaaatatgggagattaga

SEQ ID NO: 507419 - DNA, 177 bp, Homo sapiens
ctaagatccgtcggacaggggacggcgggagaggtggttctgtgtgtgagccaggcatccagacgtagggccaaaaaaggggctagggtgaggggacctaaaacttgaactccttatatttctggctgcccccacggcggtccgggggctgagctttccgtttttttctgcttctgt

SEQ ID NO: 507420 - DNA, 144 bp, Homo sapiens
aaaacttcaatggctctccaccaccttggtagcatcaaaaacttttcacaacattcccgcatttgtttaagaaagttttcacatttggccaggtgcagtggctcacaagtataatctcagcagtttgggaggctgaggcggccg

SEQ ID NO: 507421 - DNA, 111 bp, Homo sapiens
ggatccccatcatttccctgacaaatggaataggaccgcggtactatatagtaggtaatcaggaactgacggccatgattcatgacgggacaggccgaggagacattcgta

SEQ ID NO: 507422 - DNA, 789 bp, Homo sapiens
  misc_feature (515)..(515): n is a, c, g, or t
  misc_feature (652)..(652): n is a, c, g, or t
  misc_feature (697)..(697): n is a, c, g, or t
  misc_feature (707)..(708): n is a, c, g, or t
ggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacacacagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgctttngttttttattttgaacagacgttttaaaagaaaaaaaaacaactaccttctgtcctagaagacacagactgacagatggggtgaaggcctggggacctcagagaactctgccttgccctcatccctcgtccttcggnagccggagaggctgtgggtgggccgagggtgtctaggggttctgnctagtcaacnntatttgtcgtcccatctttgggcagcaaaacacctgcgtggctaggatgattactatgaggatgatgaatttgtgtgataa

SEQ ID NO: 507423 - DNA, 846 bp, Homo sapiens
ggtcggcgaaaacggagggcgctgcggtaaggagcagccgccagaggcacagcgttcgaagcctcccgccgtggttttgtcagcccccgggtgcgggggcccggggtcagaagcgccgctctgaggttcagtccctaatcgatgaaacccggtgtcctcccagccggaggttccttcgggaaaggggggggcagggtccggttgccttggagcagagaggcgggactccttcccgagaaccagggaggagagaaataaaagcacagaccaaaccaggcggatacaagagcagagtagacaaatagatatgcacagaagcgcgacaacagacaaacaaaagagaagcaagacgaagaagaaagcgccagaaacaaagagaccacaatacaggcgggggagcagccccataaagacgcgggcgaaggtagcagaggacgctcgcacaacaagtaaggacaacgcgtcggtcatgtacgacaacaatacagggggtgaggagacgcgagaccaactagtttatgaggcaagagattgcagatacactcacaagactcgggggggagaacgatcgcaatcaaacaagagcacagcgagagagaacgggagcggcagcgaacacatgcgcccgactctgacttagattgctcgacaaaccaaccaaaccagcgccagccgcgtgaagagcagggcgcgctggtgggtgagcaggaagaaggagaagcaccgagagacaaacacagatagagagaggatgtgtggtgtgggaaggtggacgcgctctggtcgcatccaacggcagcagtaggcgcgaccggacagcgcgagtgggaggacaggacacacgaa

SEQ ID NO: 507424 - DNA, 668 bp, Homo sapiens
  misc_feature (394)..(394): n is a, c, g, or t
  misc_feature (531)..(531): n is a, c, g, or t
  misc_feature (576)..(576): n is a, c, g, or t
  misc_feature (586)..(587): n is a, c, g, or t
gcggccgccgaggatggggaaatccaacagcaagttgaagcccgaagttgtggaggagctgaccaggaagacctactttaccgagaaggaggtccagcagtggtacaaaggcttcatcaaggacagccctgacaccaaccccgtgcgtccacccagccttcttccgcatccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgctttngttttttattttgaacagacgttttaaaagaaaaaaaaacaactaccttctgtcctagaagacacagactgacagatggggtgaaggcctggggacctcagagaactctgccttgccctcatccctcgtccttcggnagccggagaggctgtgggtgggccgagggtgtctaggggttctgnctagtcaacnntatttgtcgtcccatctttgggcagcaaaacacctgcgtggctaggatgattactatgaggatgatgaatttgtgtgataa

SEQ ID NO: 507425 - DNA, 1081 bp, Homo sapiens
gttgtgttcgctgtgcgcccttgtttctcagagccggtctcccttgttttgctgcggggagtttttccggggtttgtcctggcttttgtgcctatggacggtggacaaaactcgtgtggccctcggattcccggtgtcttggcccccgtctcgccagcgttccgggggacccaaggcgggacacatgttttgttgtgttcccccagtatgagccggtgtggtgtgcgtggtagaacgcgttcttttaccgtagttttagccattctggagtgcccgacagggaggtaagttccgtcccgcagggtgatctctcgcccatgttgccgtgtctccggtgaacgtgtggttgtgtcagccgcgtcttgggtttccccggtgtgaccctcaggtggcccccccgagccctaggtttctgttcccgttccgtccgtgttttttttttgtggagacgccgccctgggccacacgagtgagactctgaccccaaaagagaattttgccgctcccaggcttgaagtcaatttaatgttgcccacggggtaagagcctttggttgaaagggctataaagagctatgagaactatctgagagagtgcccctctttaagtgtccgctagaagcctcgcctggagacccacaagaagttgtgttctcgcctcgctagaagtgggtaaatttgaggagattcactcccgctattttcctcaatggtgacccactcccacagagttactcggttttccactcttgaacttgtaaatgcaccaccccatctatcccatcttgcgcccaccaaaccctggcccaaaatgtgagaaccaaccctggaaaccctgagtggagctataaggagtactatttacaccaattgagttgccctttgcacctttattccaggttgtttcttaaattttggtagaccagatcccatttgtatatgtgtgtgttatatctagtttatggctatagagaaggttttaaatactcaccagtgtcccttccctcaaggtttaattagaagctgcctgccttttagttgttttttgcccttttaattaaatgttatccgttccccccaga

SEQ ID NO: 507426 - DNA, 329 bp, Homo sapiens
gacttctctctacaagaaggccatgattcccagctatctagtagaataaagagtactgcagtataggttgcaaacaggtcggtcatagactgtcaccatggtgtgacaagaagtgatctatgaatgcatttccccccctgctacttaccataaagtgtaaaaagggagttaaaggaaagtttccttgttggttcctaccatatgaaagatgctatattctattttagcagtgccaatatatgggaaatatctaaattaaatgttattacaaaaatgaagcagtaatgagattctggctaaagagggcactaaatgggaaaactgggtgg

SEQ ID NO: 507427 - DNA, 741 bp, Homo sapiens
  misc_feature (467)..(467): n is a, c, g, or t
  misc_feature (604)..(604): n is a, c, g, or t
  misc_feature (649)..(649): n is a, c, g, or t
  misc_feature (659)..(660): n is a, c, g, or t
ggtggaccggatctttgccatgatggataagaatgccgacgggaagctgaccctgcaggagttccaggagggttccaaggcagacccgtccattgtgcaggcgctgtccctctacgacgggctggtatagtcccaggctggagctggatgcctgggaaccactcacctccttctgtgccatgaggccacctcagccctgacaccaaccccgtgcgtccacccagccttcttccgcatccacaccacacacagccggctgcccttgacccgggaggccccggctctcctctcccctgtcctgcacccatcccccgcctgaagccaccggctccaattgccagcaacctctgcttgtccggaaaacgacaacacgaaatggaaaaggctacagccctctgcataaaccaaggacttggctgcctcgcaggcagcctccgttcctcccgctctcttgcgcgtgtgctttngttttttattttgaacagacgttttaaaagaaaaaaaaacaactaccttctgtcctagaagacacagactgacagatggggtgaaggcctggggacctcagagaactctgccttgccctcatccctcgtccttcggnagccggagaggctgtgggtgggccgagggtgtctaggggttctgnctagtcaacnntatttgtcgtcccatctttgggcagcaaaacacctgcgtggctaggatgattactatgaggatgatgaatttgtgtgataa

SEQ ID NO: 507428 - DNA, 332 bp, Homo sapiens
gtagctcgggaagacgcaatggtcagaccgaagacccttcgcctttgggtgacagttccctttcctggctggaatctttatttcttatcttacttggagacccggtcttgctttgtcacccaggatagatggagtgtggtgtcttgatcacggctcacagtagccttgaactcctgggctcaagcaatcctcctcacctcagccccctaagtagctaggactacaggcgtctgccaccgcaatcagctaattttcatatatatttgtagagatggggtttcaccatgttgccaggctggtcttgaactcctaagctacaagtggtctgtccg

SEQ ID NO: 507429 - DNA, 561 bp, Homo sapiens
ggtcccttgcactttaagaggcaggaccagcagagtgcagcctgggcaacaagagcaaaactcagtctcaaaaaacaaaagaaaaaacctgtgggtatagtacgaaagaaacgtcttgcagttttctgtggcagagaattaattagaaccaacctgtgggattatacacattcacctttcagaatcctttcttctctgtggaaaccccacatctcagcagtgtgtgggaaccacgcgtagattcttaagcgaatgctgtgtggactgttgcagttctgcattcttcttgaagtaaccagaacctgtgtggtagctgtttacccacgtaccacactgtgtctaaaggacctttgtgaaccttaccgatgtaacgacgacttaatgtgcacccaaaggcgagtctcttaagttacttacaactgacattatttcacacagaactctttacatttgacactttcctggtgacagtctgggaccttgtgtaccactcatgtcccttgtgttcaaaaccagcccctgaaacacgaaccacattaaggcaattaacgatacgcatta

SEQ ID NO: 507430 - DNA, 147 bp, Homo sapiens
tcgagactgaccgaggagagcatagcagtacgtcctgcaacaccagataatctgaattacaaatataactaggaacacattctactacatgacttgcgagcatatataatatatcaacattcaccctctctcatcacgctatttcct

SEQ ID NO: 507431 - DNA, 101 bp, Homo sapiens
ccccccggggcccccccttgggtttccttccccttggggggggggggggtttggcttttttttttttcccccccccccccccttttttttcctttttttta

SEQ ID NO: 507432 - DNA, 825 bp, Homo sapiens
  misc_feature (4)..(4): n is a, c, g, or t
  misc_feature (72)..(72): n is a, c, g, or t
  misc_feature (85)..(85): n is a, c, g, or t
  misc_feature (117)..(117): n is a, c, g, or t
  misc_feature (119)..(119): n is a, c, g, or t
  misc_feature (127)..(127): n is a, c, g, or t
  misc_feature (129)..(129): n is a, c, g, or t
  misc_feature (132)..(132): n is a, c, g, or t
  misc_feature (139)..(140): n is a, c, g, or t
  misc_feature (159)..(160): n is a, c, g, or t
  misc_feature (169)..(169): n is a, c, g, or t
  misc_feature (176)..(177): n is a, c, g, or t
  misc_feature (186)..(186): n is a, c, g, or t
  misc_feature (188)..(188): n is a, c, g, or t
  misc_feature (205)..(205): n is a, c, g, or t
  misc_feature (227)..(227): n is a, c, g, or t
  misc_feature (230)..(230): n is a, c, g, or t
  misc_feature (241)..(241): n is a, c, g, or t
  misc_feature (286)..(286): n is a, c, g, or t
  misc_feature (326)..(326): n is a, c, g, or t
  misc_feature (328)..(330): n is a, c, g, or t
  misc_feature (333)..(334): n is a, c, g, or t
  misc_feature (346)..(346): n is a, c, g, or t
  misc_feature (349)..(349): n is a, c, g, or t
  misc_feature (362)..(362): n is a, c, g, or t
  misc_feature (378)..(378): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (401)..(401): n is a, c, g, or t
  misc_feature (405)..(405): n is a, c, g, or t
  misc_feature (410)..(410): n is a, c, g, or t
  misc_feature (444)..(444): n is a, c, g, or t
  misc_feature (461)..(461): n is a, c, g, or t
  misc_feature (463)..(463): n is a, c, g, or t
  misc_feature (478)..(478): n is a, c, g, or t
  misc_feature (480)..(480): n is a, c, g, or t
  misc_feature (495)..(495): n is a, c, g, or t
  misc_feature (498)..(499): n is a, c, g, or t
  misc_feature (516)..(516): n is a, c, g, or t
  misc_feature (523)..(523): n is a, c, g, or t
  misc_feature (555)..(555): n is a, c, g, or t
  misc_feature (557)..(557): n is a, c, g, or t
  misc_feature (561)..(561): n is a, c, g, or t
  misc_feature (564)..(564): n is a, c, g, or t
  misc_feature (566)..(566): n is a, c, g, or t
  misc_feature (582)..(582): n is a, c, g, or t
  misc_feature (656)..(656): n is a, c, g, or t
  misc_feature (663)..(665): n is a, c, g, or t
  misc_feature (667)..(667): n is a, c, g, or t
  misc_feature (672)..(672): n is a, c, g, or t
  misc_feature (675)..(675): n is a, c, g, or t
  misc_feature (819)..(819): n is a, c, g, or t
atantgctgcaattaaacccaggcactcctctttatgctgctcactttcgtccaggacagtatgtggatgtnacagccaaaactnttggtaaaggttttcaaggtgtcatgaaaagntntggatttntnttncttcccnntacgcatggtcaaacgaanncccacaggngacctgnngctgttgcnantggtgatattggcagantctggcctggaactaaaatgcntgnaaaaatggganacatatacaggacagaatatggactgaaagtgtggagaataaacncaaagcacaacataatctatgtaaatggctttgttcctgnannnttnnattgcttagtanagntcaagatctaaangcctgcatataagganctcggnaaaatnctncattcccnacanatttncctgatgagatgaagaggaactgccagaagattngtatgatgaaaacgtgngncagcccggtgcgccnangatgacattggccgnacnnctttggacgtggcaganccggacntaggctgtgagcggcgatgagccagagggatngnatanccncngggaggcagacccgcnggggggagggacgggggagtgacacatgtcatctttgtcaagggcataaatatatcattcatacccccattaantttgttnnnanaattnccncattaaatatatgagttaagtagatggatttgctgaaattggtgttgggcatattagcaaaatattcttaatttgtggactcgattctttttactacatatttcccaagttatcttaagatgtctgtaaatttaacttttattnatgttg

SEQ ID NO: 507433 - DNA, 309 bp, Homo sapiens
ctatgagcagctaagaatgatatatagactttggggactaagaggaaggtgggggtggtagtataaaagactacacagtgggtacacgtgtacacagctccagttacaggtgcgcccaaatctccgaaatcaccactaaggaatatattccatgtaacccaaaaacaactgttccccaaaaactattccaattagggcccggtgtggttaatccccgcactttgggaagcccaggtgggccgatcacgaagtccagagtccaagaacagcctggccaacattgtgaaaccccatctctctcagcctggg

SEQ ID NO: 507434 - DNA, 104 bp, Homo sapiens
ccgcgcagttatatagcagcgccggtcaaataattgtggtcgagttttgggacgggtagcggatcggaaggcggcacggtggtgcacgctaccatctatcttcc

SEQ ID NO: 507435 - DNA, 842 bp, Homo sapiens
  misc_feature (4)..(4): n is a, c, g, or t
  misc_feature (72)..(72): n is a, c, g, or t
  misc_feature (85)..(85): n is a, c, g, or t
  misc_feature (117)..(117): n is a, c, g, or t
  misc_feature (119)..(119): n is a, c, g, or t
  misc_feature (127)..(127): n is a, c, g, or t
  misc_feature (129)..(129): n is a, c, g, or t
  misc_feature (132)..(132): n is a, c, g, or t
  misc_feature (139)..(140): n is a, c, g, or t
  misc_feature (159)..(160): n is a, c, g, or t
  misc_feature (169)..(169): n is a, c, g, or t
  misc_feature (176)..(177): n is a, c, g, or t
  misc_feature (186)..(186): n is a, c, g, or t
  misc_feature (188)..(188): n is a, c, g, or t
  misc_feature (205)..(205): n is a, c, g, or t
  misc_feature (227)..(227): n is a, c, g, or t
  misc_feature (230)..(230): n is a, c, g, or t
  misc_feature (241)..(241): n is a, c, g, or t
  misc_feature (286)..(286): n is a, c, g, or t
  misc_feature (326)..(326): n is a, c, g, or t
  misc_feature (328)..(330): n is a, c, g, or t
  misc_feature (333)..(334): n is a, c, g, or t
  misc_feature (346)..(346): n is a, c, g, or t
  misc_feature (349)..(349): n is a, c, g, or t
  misc_feature (362)..(362): n is a, c, g, or t
  misc_feature (378)..(378): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (401)..(401): n is a, c, g, or t
  misc_feature (405)..(405): n is a, c, g, or t
  misc_feature (410)..(410): n is a, c, g, or t
  misc_feature (444)..(444): n is a, c, g, or t
  misc_feature (461)..(461): n is a, c, g, or t
  misc_feature (463)..(463): n is a, c, g, or t
  misc_feature (673)..(673): n is a, c, g, or t
  misc_feature (680)..(682): n is a, c, g, or t
  misc_feature (684)..(684): n is a, c, g, or t
  misc_feature (689)..(689): n is a, c, g, or t
  misc_feature (692)..(692): n is a, c, g, or t
  misc_feature (836)..(836): n is a, c, g, or t
atantgctgcaattaaacccaggcactcctctttatgctgctcactttcgtccaggacagtatgtggatgtnacagccaaaactnttggtaaaggttttcaaggtgtcatgaaaagntntggatttntnttncttcccnntacgcatggtcaaacgaanncccacaggngacctgnngctgttgcnantggtgatattggcagantctggcctggaactaaaatgcntgnaaaaatggganacatatacaggacagaatatggactgaaagtgtggagaataaacncaaagcacaacataatctatgtaaatggctttgttcctgnannnttnnattgcttagtanagntcaagatctaaangcctgcatataagganctcggnaaaatnctncattcccnacanatttncctgatgagatgaagaggaactgccagaagattngtatgatgaaaacgtgngncagccccgggtggggccttctaattaaaattttggcctaaacattctttttgggaaccggttggcggaaacctttacatatctgtgagcttcgatgagccagaatgatatcataaccaacagaaatcataatctcctttcttagtcacaagaaaatcacacatgtcatctttgtcaagggcataaatatatcattcatacccccattaantttgttnnnanaattnccncattaaatatatgagttaagtagatggatttgctgaaattggtgttgggcatattagcaaaatattcttaatttgtggactcgattctttttactacatatttcccaagttatcttaagatgtctgtaaatttaacttttattnatgttg

SEQ ID NO: 507436 - DNA, 100 bp, Homo sapiens
agtacgtgtcatccctcgtactagtgtatctgtcctctctcacttccttcaggcttctagcagctactttctttgtaaatcaatcacaggaaaggggaaa

SEQ ID NO: 507437 - DNA, 140 bp, Homo sapiens
ccacaccacactggtatccacacctgcactggtagtcccacaccgtgcaccgggagtccgacatctgcaccggtgggtgttggggttggggtcacctgtagtggtggtgctgatgggtgtcgatagtggggtctgtgttg

SEQ ID NO: 507438 - DNA, 392 bp, Homo sapiens
  misc_feature (1)..(1): n is a, c, g, or t
ncccccaatgaatgcccaacactagaaatatcccaattgtcactcaataggtgtttttttaaacatactatggcacattcggacattgtaatactacacggaaatgacccggaacaagctattgatacatgagaaaacttacatgggtctcaaggacattctgtttagtgcaggcaaaagagtcaatctcaaaaggtacatattgagaattaagtgcatactatatgattgcacttaataacaccctcaaaatgacaaaactatatagatggagaaaagattagcggattccagaaagataggtgctatgaatacaaatggagagtacaaggaagttcctttgtggagatggaactacacacatgcacacacacacacacacacacacacac

SEQ ID NO: 507439 - DNA, 468 bp, Homo sapiens
tgcgcagtactctaaactaggcggctatggtataatacgcctcacactcattctcaaccccctgataaaagacatagcctacaccttccttgatacctatccctatgaggcatatctaataatcagctccatctgcctagaacaaacagacctctaatcgctcattgcatattcttcagtcagccacatagccctcgtagtaacagccattctcatcgaaacccccttatgcttcaccgagcagcagcattttcgtcatcatcgcccgacgggttaacatcctcattactaatactgccgtaacctcactctcacttgcccaagaaactatcaaactcctgagaccaaacgaacttaatatgactggccttacacaatagcttacaatagtaaaagatacctctttaacggactccacttatgactccctaaagcacatgtcgaagcccccaatcgctgggtcaacta

SEQ ID NO: 507440 - DNA, 132 bp, Homo sapiens
cagatgtggtatggtgtattcctgtgggcactggtgtcttctctggggtttgatgtccctgctggattactggccctcttcaccctcagacatcacaaatatggtaggttcatgtctgtgagcatcctgttg

SEQ ID NO: 507441 - DNA, 312 bp, Homo sapiens
  misc_feature (32)..(32): n is a, c, g, or t
gccatcccccttcgtgtgacctctcgtaaggnaggaatatgaagtagatagaaaccgacctggataactccggtctgaactcagatacacgtaggactattaatcgtagaacaaacgaacctattagtagcggctgcaccatggggatgtcctgatccaacatacgaggtcgtaaaccctataggtggatatggactactagaataggattgcgctgttataccctaagggtaaactagtaccgtgggtcaagttatagggatcaatatgagtataagtagttcgctatggactggtgaagtactatagcat

SEQ ID NO: 507442 - DNA, 688 bp, Homo sapiens
gggcgcaaggggtcccggtggccctcgagggccagaacgcagcccatgccattcaggcttcccctggcccctcaatggggggcaccaagctcttccgaagaagttttcctcggcaaatgaaaagaagcttcgccggccttttggatgtttttatggctggagtttggtgccagctccgaccaacagccgacatcttgggctgtcccgtaccgggaatggactcctagttgctaagctcgccctaaacctctgccagcaggggaatcatgtctggatcttcaagatccggcgcaggtatgaaatgtacgcccgggagctctccgaagctgtcaagtccatcttcagccccaccatcgtgaaagagtagccggcttcagtgcctgccttggggtgaggaagacacctctgccccagtggattagcaagtgtggcaggcttaacatgtccagggtcccccgataacattgtccaggttggttttaaaattcccaggcagggggaaagtggcatggggagtgacttcttaatgggtaaggggctgcttacttctggggtattggaaatgtttggggcctaggtagaggtgaatgtcccgtgggccactgaatttgtataaaacccaatgtgtggtatgttgatttcacctcaactaaaaaaaaggacgccccggtatcaataccataaaaac

SEQ ID NO: 507443 - DNA, 160 bp, Homo sapiens
  misc_feature (88)..(88): n is a, c, g, or t
  misc_feature (150)..(150): n is a, c, g, or t
tactgcctgtgtccctgtgctctggaaaaggaacaaagtctggatgatagcacatctgtttacaggcatggtttactgaatatttaangcccactattgagatctactgctcagaaaaaagtattccctattaaaaatattattggctcncgttgacaat

SEQ ID NO: 507444 - DNA, 204 bp, Homo sapiens
gaggatcttttggaggcaggacactgactacctacactccagactgggaggaagtcgtgctggccacaaagagagggctcggtgcctgctccatgtcccagccactagagtccttctgggtgcctgcttcacgtacccagccactagagtcctcccagatgagaccagggaaatcatgaagcagccaacccacattgccctgtc

SEQ ID NO: 507445 - DNA, 303 bp, Homo sapiens
  misc_feature (87)..(87): n is a, c, g, or t
atgggtcccctccaggttattaaagggggaatgtcccctgttttaacattaaagggcaggtggtgggccatggccatggtccccagntaaggagcaggtttccctgagaacccaaatttcccagagagtatgtgagacccaaccaatgaaaacagtcccttggtttttacccggtaagtaaacagtcaaaaaattagcatgaaaccagtttagcattgggaggaagctcagttttttaaagtttttttttccccccccaggattgacctgtgtgtaagtcccaataaactcccctattcttca

SEQ ID NO: 507446 - DNA, 237 bp, Homo sapiens
acacacactgggacctgtaggagggtggggggagggagagcatcaggaagaatatctaatgaatgctgggcttaatacctgggtgatgggataatccgtgcagcaaaccatggcaaacatttacctatgtaacaaatctgcacatcctgcacatgcaccactgaacttaaaataaaaattgaatttaaaaagtttaaaaaattaaataaaacctaattttaaaaagtaaaaaaaaaa

SEQ ID NO: 507447 - DNA, 870 bp, Homo sapiens
accacgctgacaccggaccgcgccctcggcagttaaacctacggcacgaggccgcgcaccgcccctctacaccaccggccgcgagggcgcgcataccacacctaccacgcctgcgccgccagccggccccaccccccccgcccctacaagaccacctccagcccccatatcctacccctaagccgcgccgcacgccccccgcctcaccctccccacccccctccacgctccctccgttccccctctccacgcgcctcgccccccctcgctcgcccccccccactccgccgccccccgcttcctccgcgccccgctcgcctcccccctgcctcacccccccctcgccccctcccgccccccccccccccgcccccccctcccccctcggcccccccccccccccccccgcccccccccccccccccgcccccccctccccgcctcccccccccccccccccccccccccccccccccccccccccccccccctccccccccccccccccccccccctcccccccccccccccccccccccccccccccccccccccccccccccccccccccccccccccccccccccccccccccccccgccccccccccccccccccccccccccccccccccccccccccccccccccccccccccccccccccccccccccccccccccccccccccccccccccccccccccccgccccccccccccccccccccccccccccccccccccccccccccccccccccccccccccccccccccccccccccccccccccccccccccccccccccccccccccccccccccccccccccccccccccccccccccccccccccccccccccccccc

SEQ ID NO: 507448 - DNA, 351 bp, Homo sapiens
ttaaggatccgcaggtgttctggtagagaggcccaattctgatgaaccacattcccagagaagtacggcagggatagggcttccgtgtggctcagagacggaatggggagttaagcaaaattttctatcttggggaaagggaggaggtgctagcagagtgagggttaaagcttgttgccagcctcttggacgggtggggcctcccgccttcgcctgacattgggacaaaggggccacgggtgggcaggcagcgcatgggttcttgtctctggcacgggcagaagggcggcaggagcagaatccctccaggctcaagaacacaggcccagcactgttaaccacaaacacctg

SEQ ID NO: 507449 - DNA, 773 bp, Homo sapiens
ctgtggcgagttcatagaaaggccacccgcggcgaagtcatctcctggtggtaatttggaaagccccccctctttttcagaggagggaagaacccacggtcttcaaatgcagagggcttccctctccaatgaggaaacgaccaacagtgggtgacatatagccaccacctattggtgtgtctctatcagaaagcttcgcacgccatcctttggggtgtccttaactagattgtgtatacacgcttcgtgcgaggaaattacctattatttggtggcaaatgaggagtgcggcaatacacacccacgcaagagttgagtctttctgtaatgcgtgccacaccaggatgagatggagtcactagatggtggccgccacgactcagttatgacacactccggtggggtgtgtttctttcttaggcactcaagagatattttaaacagacgatatagttgtgtgggtgtggtgcgagtgtgtagcgagtagacacagagagagaagataagtgcaattaagagatgtgtgtggtgacacaacttgctggaaaaatggacacctggcgcgaatcggtggtggatgaacctcccagctcgtggtgccaccaaggagccgcgtgcagactagggggaccttgacgcattcccacccccagagacatcgtgtcatgagtcataacgtcaggaacaacgggggtgacacaacaggcagttagccaccccctatgggtgagggcaagaaggaacaaaaaataaaccgggcaatcaaaggcgaa

SEQ ID NO: 507450 - DNA, 190 bp, Homo sapiens
ggtgtgaacacaaaagatcaattaagaaccaacagagttaaatctctaaggcaaatttgggagtttaagaaaaatcaaactggcaataaggatatgcacagcataagtacattaactaccaatttactacttactaaattattagacggaaaactataggacgaaaacagcatcaaggaaagggaaactt

SEQ ID NO: 507451 - DNA, 435 bp, Homo sapiens
  misc_feature (10)..(10): n is a, c, g, or t
  misc_feature (37)..(37): n is a, c, g, or t
  misc_feature (60)..(60): n is a, c, g, or t
  misc_feature (100)..(100): n is a, c, g, or t
  misc_feature (145)..(145): n is a, c, g, or t
  misc_feature (165)..(165): n is a, c, g, or t
  misc_feature (179)..(179): n is a, c, g, or t
  misc_feature (184)..(184): n is a, c, g, or t
  misc_feature (191)..(191): n is a, c, g, or t
  misc_feature (195)..(195): n is a, c, g, or t
  misc_feature (279)..(279): n is a, c, g, or t
aaaccatccnccactcacagacccaagacctggctantgtactaaaaggaaggtctgagncctctacgtagctaaaactcagattcagtaggagtgatgncagagtagtgaagagctgataaatagagtaagttgaacttgtaancagacactgattaaaactgngggatcaaaagtanctccntgttgangttnccctgaaagacagaatgtacactgctctgtgaaataagcctgtaaaaaagcagacatcctgttagctgcaggttgataaacaancgggagaagtacttaacagcaaagacagcttccatacctgttcagcaagttacactacatccacagcaaaagcatgatgaaatcaaggccttgtgctgtgtcactcaaacaaccactccagaaccctgatgcctttcttggggttactgttaatgc

SEQ ID NO: 507452 - DNA, 437 bp, Homo sapiens
  misc_feature (15)..(15): n is a, c, g, or t
  misc_feature (60)..(60): n is a, c, g, or t
  misc_feature (63)..(63): n is a, c, g, or t
  misc_feature (69)..(69): n is a, c, g, or t
ccaaaaaaatccgtncccccctggcctaagaaaaaggaatggccttgtaaaaacctaaanatnccctanaatctggcccatgtgggtcttgggtggaggaaagtgagagcacccacatggctggggctgagattttgcatagatctttggggtctgtcagggtgggaaatgcaggcaagcctaggattaaccctggaaggcctgcgaaaggagggtggggacagtccttggaaggcagctgcccttaaaactagcccagctctttctggatcgggcaggacccctgaagctgttcacagtccctgtggcatgtaggaaaccaaggtgtctcaggacaggaggagacaaggagtggctattgggaaatcagctctggcctccccatgagggctaataaggggcaaggacgataggtcctgtggcagggcggacagctc

SEQ ID NO: 507453 - DNA, 327 bp, Homo sapiens
aaaatagtactatcaagaaaatttttaaatgaacagcctagggccaggtacagtggctcacacctgtgatcccaacactttgggaggcccaggtggaggattgcttgatcccaggagttcaagatcagcccggcaatcacagggagactccatctctacaacaaatttttaaatttagctagacatgatggtgcattcctgtgattccagctactcaggaggctgaggtgggagaatcacttgagcccagttgaggctgcagtgaactgtgttcatgccactgtactccagcctgagcaacaaagcaagaccttgtctcaaaaaaaa

SEQ ID NO: 507454 - DNA, 356 bp, Homo sapiens
  misc_feature (100)..(100): n is a, c, g, or t
  misc_feature (105)..(105): n is a, c, g, or t
  misc_feature (112)..(112): n is a, c, g, or t
  misc_feature (116)..(116): n is a, c, g, or t
  misc_feature (200)..(200): n is a, c, g, or t
ggtggaaaaaggcggactggggggggggttggggttgggataaaagacatcctgttaaacccattagcccttaaatttaaagtaaggggatcaaaagtanctccntgttgangttnccctgaaagacagaatgtacactgctctgtgaaataagcctgtaaaaaagcagacatcctgttagctgcaggttgataaacaancgggagaagtacttaacagcaaagacagcttccatacctgttcagcaagttacactacatccacagcaaaagcatgatgaaatcaaggccttgtgctgtgtcactcaaacaaccactccagaaccctgatgcctttcttggggttactgttaatgc

SEQ ID NO: 507455 - DNA, 198 bp, Homo sapiens
ccaaggcccaggctttggtgcagtacctggagagcccctcacccaagtgcggcatcttaaccgcattggtgaaagctgggtcaagaaaagagaattgacaatttgaagggcgggccttcctagaagaaccttcttagacaatggggggaggatgggacttttttttttccaagaataaacttcaactcctgaaaaaaa

SEQ ID NO: 507456 - DNA, 398 bp, Homo sapiens
aaagtagttacgaatctgtgataaaggatggtagctgatggggatggcatagaatctgtaaattagcttgggcagtatggccattttgacgatatcgattcttcctacccatgagcatggaatattcttccatttgttggtatcctcttttatttccttgagcagcggttggtagttctccttgaagaggtccttcacatcccttgtaagttggattcctaggtattttatactctttgaagcaatggtgaatgggaattcactcatgatttggctctctgtatgtctgtagtcggtatataagaatgcttgtgatttttgtacattgattttgtatcctgagactttgctgacgtcgcttatcagctgaaggagatagagggcacacattatggagg

SEQ ID NO: 507457 - DNA, 1346 bp, Homo sapiens
attttgaatgagtttgacactgccggcttccttccatccagcgaggtggtgctgcacagtgtggcacttgcagcacacttcatgcccaacatgcataatgcatcactgcacttctggttgggcagctctcccaaagcaacactgggttggttttcaagcaacaatcagtttcacgacagttccaactcatcattcttttcagcatcattcatgtcatttgttttcactcgtgcattcaggttcactgtgcatcaggccatttcattccatattcgtttcctatcacccacatgtccattcaatcatcattcacacaacacagcatgatatgtagtatcagcacatcatcgcacacaggcgccttcattcttctctattcttccatcagcactagcaccatatctttctggcacattgtcttgcacgtccatatctcatatcattaccttcagcgtatcttgtcacaacttcacaacattcacacggcgccacagctgcacaacacagtcacatcacattctgggcgcatatcattttcacagcgcgtcacccagcacattgctgcatctcctatatccacatttgttcttcatctcaccaacatgggcctcagtctgcggcaccaggccacacccacaatcttgccacacacaggttgggacacaggcacatctccatctattagcggtccaaccacaggcatatcccggcctatcatcactctctctccggcacacgccctatcccattcattaacacatcacacagcacgcttgctgtaactaaaccacttcaccaacagcacgccactttggactaacaccccattttatatcccttacttctctaacaacgtttcatcacagtcggggccttcaccgacacatgtccaccaagggcaacgaggaccaaaccacaatccgtggggaaaaccaggagatatggacaaattgggacaacattttattcaaccttccattatttccttggctggcacacacagacacacacatcccaaaacaagaaggcacatggtcactggcccgaaccccggacaagggaacagcgtcacgcagagcgcggggacacccccggaggacaccgaccactctgcggacttggccaccctgacggggcccaccacacggagccgccccaccggttcggcaccccaccacacgaaaacgggccacaacgcacaggacaacctcaggcacaagccagaaacacgcgcacggaacaacaccacaggacgacaacacccacccaggcacggcatcacatgatctcacacacaactcccccccaatggcacaggcagtacaccacactccaccacacccacc

SEQ ID NO: 507458 - DNA, 187 bp, Homo sapiens
gttggtactagtcactggttggctactagtccactggttggctactagtccacgggtgggctactagtccacgggttggccactagtccacggttggctactagtccacggtgggctggtttccatatggtggcaccgtgtgtggagacttgattttggttcaaaaatgctcttgctccctcttcta

SEQ ID NO: 507459 - DNA, 231 bp, Homo sapiens
aggtgccctaaagatggattacgaggaggttggtgtgcgcttctgtaagaatgatggggtgaggaagaatgcgaggaatactcattatccattccttttggccctgcagcatgtcatgctcccagaatttcagcttccgcttacctgacagacgttaaagctttctggttcgattgtattcacttgagtaatcatgtcttataccatgtgtacctacctatttcacaatcg

SEQ ID NO: 507460 - DNA, 472 bp, Homo sapiens
cacgaggagcggcgagagcctgtggagcaaagggcagaaggcggcggtgatgcacctgctcgattacgtcgcctcgggcgaccaggccgactacgcggactaccgccgcaacatcggcatcacgctcggcgaccgccgggcacgcgaagcactcgaccggccggacccggaccgcgctgccgcagcccaaggcttcctcgatggcggcaacgacgtgggcgacgtgcccagcctgatccgcctgttcgtctggttccgctgggcgccaccgatgcgcgacgcgatcgatctgtggaccgaaggcgaccggctgatcggcgagatcgatgcggtagcgcgcgtggcccacggccagatcagcgccggcagcctgacggcggacgagcgcgcggtactgacgctgcgcgtgcgccagctcgacgccacgctggaaacggtggccgtccgcttctcgtggacactcggcgacatt

SEQ ID NO: 507461 - DNA, 225 bp, Homo sapiens
  misc_feature (7)..(7): n is a, c, g, or t
  misc_feature (117)..(117): n is a, c, g, or t
cctcgcntgaacaaaggtgactggtctcatgagccctgaagaatgaactcagaggaggttgtttacatgaggttctcccactgggagggggggagagtctgcaattataaacagcangatcttattacttcaatgagagcatgtaacaagtttctcaaaccaccaacagccaagtggatttggtacagtgcggctgtctaataaataatcaaaagcatttgatag

SEQ ID NO: 507462 - DNA, 680 bp, Homo sapiens
ggctgggcggcctggtctcggataagagggtgagagtggcgggccgttgaataagctttcaaaatgatgcccacaccagttatcctattgaaagaggggactgatagctcctcaagtgcatggccctcgagcttgtgagtaacatcacgtgcctgccagtgtgattgctgaggctgtaagaactaccctgggtccccgtggcatggtcaagcttattgtagatggcagatcggcgaaagccaacgaatatctaatgatggggccactaattccggtgaaacttcgttgatgttggtccatccgtgcagcagaagactttggtagacattgccaaatcccaagatgctgaggtgggtgatggcactcactctccagtgagcttgctggctgcagagctttctgaaccgtcaggtgaaatgcctatgtggaggaaggtttacacccccgagatcatcattcgaggctttccgcagcagacacccagctggcagttaacaagatcaaagagattgctgtgaccgtgaagaaggcagataaagtggagcagaggaagctgttggaaaagtgtgccatgaccgttctgagtctccaagctgatctcccagagaaaggtttcttgtgctaagatggtggtggatgcaggtgatgatgctcgatgatttgtgcagttacaatgattg

SEQ ID NO: 507463 - DNA, 108 bp, Homo sapiens
cctttgctctgaaattccctttttccctctttccctgagttgtattgacccacagagttaatttcctttgtatttttttaaaaaaatattaaaaatccccggtcccca

SEQ ID NO: 507464 - DNA, 420 bp, Homo sapiens
  misc_feature (412)..(412): n is a, c, g, or t
ctgcctcagcctctcaagtagctgggattacaggtgcccgccaccacggccggctaatttttgtatttttggtaaagatggggtttcaccatgttggccaggttgatctcgaactccttacctcaagtgatccacctgcctcagcctcccaaaatgctggaattacaggcttaagcaactgtgcccagccctgttttattttatgtaagtggaattataattatataattttttcccttttgtgcctggcttatttcacttagcaaaatgttttcaagattcatccatgttgtgacatgcatcagaatttcattcctttttaaggctgaataatatttcactggtatgtatatacccgcatatctttatccatttatctgttgatgggacatgggtcgtagaaccatttggntaatgggg

SEQ ID NO: 507465 - DNA, 113 bp, Homo sapiens
atattgttggtcagagagatatttgtctaggctcagccatgctggctctgcagcgagggtccttcactagaacaccatgcatttgtggtggcagcattagtagaaggcactga

SEQ ID NO: 507466 - DNA, 444 bp, Homo sapiens
atcgaagttcaatagcacattgctgcgagtaatccaccccagcgtaaaggcaacccttcagtcaagtttatacagcaaaccctccatagtccatggtcaacagggaaggggtggggacaggtctgccaatctatctaaaagccacaatatggaagaagtattcaattgatatcataaagggctacttaacggttgaatcactttcatacatggatgaaacgggttgaacacaggatccagatgaatcttcggtgggccaagagatgtgccttaatccttgtagatcctgtttgctatatggaactagctttggtacagtagagttatctgactttcgatttatccactgccaatataaagaggagacaggggtgcgggaagcatgacttcattccagaggcttctcagagtacagcatatgctattgaaactgctaaaactagg

SEQ ID NO: 507467 - DNA, 226 bp, Homo sapiens
tagaggaccccgcctcaattttagttctgtcacgctgcctggtgtggactgtcactcagctgaatatggtggggaagtgtccctcaggcacattacataggaaggggacgttctgcctacatccattacatgcatgatctaggactatccggcatgtacatatggtcttaactcacaatacaacaacgcgtgttcaacttgaatgccagtcatggaaccacagtct

SEQ ID NO: 507468 - DNA, 234 bp, Homo sapiens
aggaccccgaagccgtgggctgggcgtctatgtggttgtggctgtggctctttgtgtccacaggatttaagaactccttggagcatggcaggctatagtgtcggtctgtcttgtctgtgttgtggttcaagaggctgcctgactggcagcaagtcttgccacactggctgcaagaggagcggctccctggatgcagctgagagctgtagtctctgttggcccagctatccatgt

SEQ ID NO: 507469 - DNA, 353 bp, Homo sapiens
  misc_feature (329)..(329): n is a, c, g, or t
cttggattcgtgaacagaccacagtggaccacttctggggtgagtccctgcgagacacagattgtcccgcctacagttggggtgtttctcagattatgctggggagaggggaggcggtggccaggttgtcggtttgcatggattatgctagggagagggaggctgtggccacattgtgggtttgctgcgtgactggttggtaggagcatcagttaggttccaggcttgtcctcagacttgatcaggacgctccttggaagctgcttccatgtgcgccttgtcgggtggtcattgggttatgctaacgtgtagtgactagttccaatggngagatgaagcagcaggtagtaatt

SEQ ID NO: 507470 - DNA, 295 bp, Homo sapiens
tcaagccccaaatggttgggggaggggcctatacaaggctccaggccccacctcctcctccatactttcaggggtgcatctggccgctgctgtggtgaccacactgatcctgaataaaatggatggatctaacatacatggaatgcttacagatcatgacctgaggagggaggatcgtggtcaactcagagttgcctcttcctgcaacctcacctccacttgcccccatcataggggcacttaccccatcccatgctgcttattaagcacagttcccatcatactctcctctcaa

SEQ ID NO: 507471 - DNA, 977 bp, Homo sapiens
  misc_feature (112)..(112): n is a, c, g, or t
  misc_feature (402)..(402): n is a, c, g, or t
gtgctctttctttttttgatgtgccgctgctgttctcttttcgttagcgcgtttggtaggggtgttaaataaaaggaattcgtggggggttttttcttttctctcggtctcnccttctgcgtcttctctactgtgctggtgaccttgtgtccggcgcttctctcgtgttcgtttagtgtctctgtgcgttgggggtcgtgggtggtggtgattcggctcgcgccgaggggggatccactttctcggcctggcgcggccttcgctcttccgtcttcgggacggggaccttgacacacattgatgatagctcctccatttttctctcttcacctctcgcgtggcgggtattttgttttctctcacccgctgagcatatgtttttttctccgcgcgcgggttgcnctctctctctcgcgcgcgtggttctgtgtgtttttctgtctctgtcgtgggggcgctgattgcctgcgtcgtggtgttgtggttccccacgcacgctagtatgtcggtctgctcctcacacgcactccactcgcgcgcgggtgtgtttctattcttacatagagagggagcgcgcgcccctcttctgtttggtcttgtattgtatgttattctttgtttggttgcgtatcccgtatgcaaacctccctccccgccccctccgctgcgtcggagaggcgacggcgcactcctctcgttggtattgtttttgttatgatactaaacttgtgttttttatgtgtgtgagaagaagcatcattatttgtggcggaggaggatagaatagaatcgagctcttctttgcaaagacaataatgaacataccccaccacgtgggcgccgcaccataattgttctccattaatcgtgtgcgggagagagacaagcgaggtgtcagtatgttttttttttttccccccccccctttttttttttttttttttgggcggggtggttttttaaaaaaaaatgtttga

SEQ ID NO: 507472 - DNA, 245 bp, Homo sapiens
ggtaagagcggtctggggtcaaatcggagctatagctgctggactacaccacaacaatatgggatctgagcggcatctgccacctacaccacagctcatggcaacaccagatccttaacccactgagtgagggcagggattgaacccatgtcctcatggatactagtcaggttcatttactgctgagccatgatgggatgagttcagcaaaaaaagtcacacaatttttttttctcattgcatga

SEQ ID NO: 507473 - DNA, 952 bp, Homo sapiens
aaataggctaggtacgaggccctggtggtttaattcggccgaggcaccgctccctgcccctccggtgccctccagcgaggtggggaaactgaaaggccgctgtctttctttttggtttcctcgtgctcccggtgtgtggagtgctgcggggtgcgcagtgccccctgtttcacctgagcctggcccagcgtgcgcgccaggggcgggggtttctcgcttcacaccggtacggaggaggaaacttgtggggtggctgggaccccgcggcctgggtcctgagtcaggcatgctgaggccgtctgggaagtgactactcactctcggggtttccttaatcccgctccccccgtttgtcgttgggcgcgtgtacgctccgagggaggcggccgctgtgcggacagccatgcattagggcaggggcttcccttattgcggcccggtgatgagcgcgggacccggtgcctcggggcctgctctggcatgcttgccggccggttctgggggagcccggatgccccaagctcctgatgcctcggccggccttgcccccatgggccgggggtcgttcgaacgccacggacgtggggggcttggcccattgtggggggctaagtgcacacatcgtacgtgcggccctttttgggcccatttgacaggtacaagggtgaaacccaatgacacactagttgggtaatggggacctgtgccaccgggtactgagtggggtatcccccccatagaaaaggggagccgggggggtgcacacccccaacaggagtgagacacgtgataccgcgccctggagggtggtacccccccacgtggagaacagtatgaaacatcagggacgaaaggggccaccactaaaggttgtgtgagaacgagcgacccataataatacagtgggaggggacaagcaaccggaggcgcaatatgatactcagcgaggaaa

SEQ ID NO: 507474 - DNA, 393 bp, Homo sapiens
atgtgtcgtaggattcaaattccctggagtactcgaactctgatgtgctactgtctgtcctgtaccttctgattgataatcggttgacgtacttcctgtgccgggatctggacaaccccacagttcacggatcccacggtcagcgccaggcccaggggcaccacgggatgcagaccaatcgctctggatgcttccaccattgattcctcagatgctcggcggattccacgagatgctcgtgctcccatccggcttgctctcttgtatcttgctgcgccttttcctctgcctggcgcctgggatcctgactggctttgttctcaatctcccgaacagcagagtcttgcaccttctcatcatgagcagcgtctgccttcgcttggctgagttcaa

SEQ ID NO: 507475 - DNA, 723 bp, Homo sapiens
tcacctgatagtgtaaccatagttccatatcctcaaatgtgtgtgttctaaactaactttttttttcttttattagagacagagtctcacttggccaggtgcggtggttcacgcctgtgatcccagcactttgggaggccgaggcgggtggatcacgaggtcaggagtcgatgaagccccgtctctactaaaaatacaaagaattaccaggtgtggtggcgcacgcctgtgatcccagctactcaggaggctgacgcaggaattcgctgaactgggaggtggaggttgccagtgagccaagatctgcgccgttgcaccttccagccatgggtgacagagttagaaatcgtggtctcaaaaaaaaagaagaacgggatcgggccaagtgagaatcagcagtggtgagtcgtagtagaatgttgagtcagtgaaaaggtgcgtgggatcaccaagtagggttcggactttcgagacccaagtgtgtcccgatacactggaagataatgttaggtcaacatagatgaaaaatgccaggagttagataggaaatgatggtggatagacgacgtgttggatcacgatgtaacttagggaggctgaaaacataacgagtcggattggagacatggagacatgcacgagggtcgtcgaagggaaacgttgatagaacatgtgcggttacaagaaataactaagagtgaatggttagtcggaagaaagata

SEQ ID NO: 507476 - DNA, 620 bp, Homo sapiens
gttccgcccatttccttgtgatcgaccacccccgcttatatctatttcccccactctatggagaaagtttcacatgagcccacacctcgagtctatactcttcacgaggagaaccacaaaatggttcacattgaatggtcccttcacccccgcggagaagggcgaccacggtgctctatagaccacgagaaattcgcggagaaaaactatggcccacaaatgtacccagagccaccaccccggaatgtcaattctttggtaaatttggaattcacgagaactcacattttggtggtggcacaagacacaactgggctttggcacatgaatttattgagatttccctggagattaatgcacaagagaaaaatgagaaccccaacactatgactctgcaaagaacacatggcctgtaatgaagaaagagaaaagagcctcacaagagaagcacacgaaaaggaaacgcacagagacagagaatgaagaaaatcacagggggagctgcacaaaggccacaatgttggtgctggccaaaagaccgaaggagtaaaggtgctgccatgatgttagctgtggcccctgtggatttttcgcaagaaccattaattaacttaaaactt

SEQ ID NO: 507477 - DNA, 541 bp, Homo sapiens
  misc_feature (180)..(180): n is a, c, g, or t
  misc_feature (345)..(345): n is a, c, g, or t
  misc_feature (439)..(439): n is a, c, g, or t
  misc_feature (499)..(499): n is a, c, g, or t
  misc_feature (529)..(529): n is a, c, g, or t
  misc_feature (539)..(539): n is a, c, g, or t
tttttaagtgtatagttcagtagtaataaatgcattatattgtttttccccctttatctccctccttccccttccctttcctggcttctggtagccaccaatctactctatcttcatgagatccacatttttacctcctgcacatgagtgagaacatatgacatttgtctttttgtgctnggtttatttcacttaacataatggcttccagttccatcgatggctgcaaatgatagtatttcattttttcaatggctgatattccattttatgtatttgccacgttttctttatctattcatccaacaatgggcacttttcctttgctgtgcagaagctttttgntttgatttaatcccagtggtctatttttcctttaattgcctggcttacacaagaagtctgtctgcaccaatgtcctggagcatttccttagtgnttcttctggtagttcatagtttcaggtcttagagtcgctttaagccactttggatttgancttttgtatggtaggaactatggatctggnatctctttcnct

SEQ ID NO: 507478 - DNA, 958 bp, Homo sapiens
gcccaaaaatgtgcattattaaagatagctcgtcaatgccacgtaaggggatttggtttgggtaaactccgcagatttcttggattcaacttcttttgaaggatgtccccgcaagtccccgcacacctcctcttgagaagggaggggggcaaaagacttttcggtaaatatttccagttatgacctccaagttcccaggattaggcccctggagtaagtttgaagccccacagttgtttcccatcttttcagatggatgcctactgtggagattaactttggcataattcccagtgtccagcttttctttagcctggaattggcccaatcacatttgttggtccccgctgcttctccactggggccccacgctctttttttttccaaagtttagtaatagtataatccacacgttgtttgaaatcccaaagtagaattactctttaaagtagattttttcttccacttattgtccacttggcgctgtttcttaagattttaccccctcattagaatggttaagagacccacttaatagccagattttgccaccaaataatattttcaccattctggatccattccagattcctgctccattggtaatcctttgtttgttagaaacaccacaatggatggaaaccacattaggggttcttgtaaaccttttgtaaagcctatgaattctctgtttaaattttgggcctgtcttattttcttgcctgaaacccatcgccacaaattggagcctttggtggggcctgggagaggggttatagtatatcatgggaccctttaatattgtcaccagaaccaccagaacttatattctgtccagttatttaatacaccattgaaaattttagtgaaatagttccaaagagaatatagatagtttccccaaaaccacaccatctttatgttaaaaatagtcattataaagatctgttgtaatata

SEQ ID NO: 507479 - DNA, 274 bp, Homo sapiens
tgctcagaaatcgcgtctatcgattacggaacaggcacctctagaagggatatgaagcaccgccagtctctttgagtttaaagctgtggctcgtagtgtactaggcgagcagattttcgtatgattcaactagttagaggttaagaggctaagacatagatgaggtattaaatacccagattcggagtcttagctatttgtgtgtacagatctgtcaaatgccacttatcgtaagtactatttatgtagtcacctgtgagttgtttgacaaact

SEQ ID NO: 507480 - DNA, 406 bp, Homo sapiens
  misc_feature (1)..(1): n is a, c, g, or t
  misc_feature (41)..(41): n is a, c, g, or t
  misc_feature (67)..(67): n is a, c, g, or t
  misc_feature (199)..(199): n is a, c, g, or t
  misc_feature (208)..(208): n is a, c, g, or t
  misc_feature (225)..(225): n is a, c, g, or t
  misc_feature (364)..(364): n is a, c, g, or t
  misc_feature (368)..(368): n is a, c, g, or t
  misc_feature (374)..(374): n is a, c, g, or t
  misc_feature (400)..(400): n is a, c, g, or t
nttcacccttcctcctcccctggaatccagtccaatgccanagttggggatgaggtgaaaacaaccnccctctggggaaccctttccatgacaatttaacagcagaccataaggcaaccttaaaaatacaattttagaatccccttcaaactgtagatctacacaccccaacaaacagccatatggaagggtgtgtganattatctcncctggatagaccacgcncctgggggcggggggtggtgggtcactccttgattagaaaagaatgttgctaattatactcatgtttgtcttatgttatttactaattttaggatgaaagccggaataagagcaatgaccaccatgcctgacagacccntgtngcgcanacctgtactctccaatgaacaagacngaagtg

SEQ ID NO: 507481 - DNA, 665 bp, Homo sapiens
caagtgatgacaccattgctgacatgactgactataggagatagtgatgagtcccatatgccgtatctgtgtgctgccaggagagtcgctgattgatctctgtgaatctcgcacgtataattctgcagagaggatagtaagccgagatgacatcagatcttagactgcacagtgaggagcattcgtgtgcgcttgtacagtctagtgtatcgttgtccactgacacaccgttctgggccatacagacgataatccgttgttcctccggacaaaacttgagcaaaggaatgtacgtcgccgacgtggaaaccgggcgaatgaggcagacacaggctcttgcagaccaatttgaagataaaactacatctgtattggaacgcctgaagatttgcgtattgctgtcaagtaccacgctcactgggccacttcagcgccaacttgcgaagttatgtctctctgagttgggatgtaccagttcaggcccttcagatatttgagaggagctagaaatgtgggaagatgttgtcatcttgtgtatgaacagagccgggcagcacggcaacggcagaagaaatccttagacaagagctggagaaggaaagaggaggcctagttaatacgggttgtttggagatgtcctcggagaccattcttggtatgacaag

SEQ ID NO: 507482 - DNA, 302 bp, Homo sapiens
ccatgagcaaaaacacatagcctaaccccattccttgtaacaatccctatgaggaataaaaataacaagctaacatcttgcatacgacaaacagaactaaaatctgctcatttgcatacatatacaatcagaaccaaatagacccatcgtagtgacagccatactcatccaaacccactgaacgcatcaccggcgcagtcattctcataatcgcccacggacttacatcctcattactatcctgcctagcagacacaaactacgaacgcactcacagtcgcatcataatcctctctccaagg

SEQ ID NO: 507483 - DNA, 678 bp, Homo sapiens
ctttttgatcctgaactgggtcaggtgccgctgttgctgctcgtgttgaatctagaaccgtagccagacatgggactggaggacgagcaaaagatgcttaccgaatccggagatcctgaggaggaatctgacacagagtccaaatgcgcttgtccccaatttttttggggggggcgcgccaagagcgcgcaagccttcaggggccccccgcagatttattttcttcttggggccttctcacctcttgtagtcagtgttttcacaatcaatcctccctccataacaaaccaccaacgctgctcggctcccttgtggagcacctgttagcttggtgaacactaatacacgtactaccctgcaacattgcccccctgatggttatagggtggaagtcctccgcccccgagatcgcaccccttccacccacacccacaaatgagcgcgacaatcccacgttaacaaccaaacacccatcacacactccacgaatacaacacggggcgccttattaattagaagcctgtttttgatgtgcaatgtgaagtggccagtatctcgtccaccaaccaaacaaataagaatgacttgtcctccaaaccacttaacaatataatttatcactatatttcgcccttctctcgttgtctatctgcccatggttaatttccccccacatga

SEQ ID NO: 507484 - DNA, 297 bp, Homo sapiens
atagagctacgaggatccagctgcagctctcaggcctggccgtacctggagcacgtgggccacaacacatcgatagaacatggcacccagtggcctggactcagccgacctgccaccacccagtgccctcaagaaaggcagcaaggagaagcaggctgacttcctggacaagcagatgagccgggatgagcagcgagcccgagccatgaagatccctttcaccaatgacaaaatcatcaacctgcctgtggaggagttcaatgaactgctgtccagataccagttgagtgaagccca

SEQ ID NO: 507485 - DNA, 526 bp, Homo sapiens
aagactcacaagaacatctaagcataatatatcagcttccgcctttcaatttggcaatctctgagagagattccacctttattggatccagtatatcctcgctcttcaatatttctttggaaataatgccaatagggacatactcttaggtcatgaataaaacctttcagaaaattagtcagtgtttaattttcgaaaacttccctctctagacagtagacacctcctactgatggtcccatatgctagggaaattttaaaattagcaaatgctgatagctcatattataaatttctaaatcctagaaagacacgcttggagtgcttctgaatacacacaagttccatttaagggcaagtttccccgtagatgtatcaaaattctctcacctgtaaattgagatttaattcccgaatgtattcaacttgttctaaaacaatctgtccacaaatataaacctataagtaataaattgttattttcgcacaatggcaatctctaatgtgaaaatgtgttctatgaaaa

SEQ ID NO: 507486 - DNA, 420 bp, Homo sapiens
  misc_feature (21)..(21): n is a, c, g, or t
  misc_feature (35)..(35): n is a, c, g, or t
  misc_feature (58)..(58): n is a, c, g, or t
  misc_feature (107)..(107): n is a, c, g, or t
ccaaaacaagcagtgggccantccatggaggtttncccgggaaaaggggtggggaaantcccggaactgagagttccctccccccctttaatccatatagggtagantcccagatgttacccatgtcatttgtaaactgtcatggcactggtgagagtgtcttttacccatgctaagtataagaaccttaaggatgaccaagttgctttcgttgccatcttggtttttgtgcgttcttctggctctttacgcatctcattttaccagtggggtctttgtgatttgtaccttgtaaaaccagtcctgccaaactcctgtctcatcatgagagaatcagttgagccaaggaggttgaggctgcagtgagctgtaatcatatcaccacactccagcctgggtgacagagcaagaccctgtctc

SEQ ID NO: 507487 - DNA, 148 bp, Homo sapiens
tcccagacgtgggattacaggcgtgagccaccattctcaacctagactttttgcaattagaaagaattaatgatactttagatagatatctcgtattgccccctgcttccagatgccttggagtaccggagactcgaatttctgtaat

SEQ ID NO: 507488 - DNA, 113 bp, Homo sapiens
aaatgcacgcgggactcgagcactttccaagcagcacacgggcatctgagcgtaaacatccaaggtaggtgaccagagccatcctctagctcgcgtgctccgaggatgcgttt

SEQ ID NO: 507489 - DNA, 184 bp, Homo sapiens
acactactggagaaggtaatgggcttggaagataaagtagaatttggataacaaagaagagggagaaggcatcagtgaaaaaaatgacatgagaaaattcaggcacggaaaggaaacatttcatgcttttcagcaattaaagatttttttttttttttttctgaaacagagtctcgctttatca

SEQ ID NO: 507490 - DNA, 113 bp, Homo sapiens
  misc_feature (24)..(24): n is a, c, g, or t
ccaggtatagtggtgtgtgcctanagtcagtccaggaagctgaggcaggaggattgtttgagctcaaagtctttgagaatatagtgtactatgactacacctgtagaatagcc

SEQ ID NO: 507491 - DNA, 435 bp, Homo sapiens
  misc_feature (5)..(5): n is a, c, g, or t
  misc_feature (69)..(69): n is a, c, g, or t
  misc_feature (74)..(74): n is a, c, g, or t
  misc_feature (95)..(95): n is a, c, g, or t
  misc_feature (110)..(110): n is a, c, g, or t
  misc_feature (112)..(112): n is a, c, g, or t
  misc_feature (119)..(119): n is a, c, g, or t
  misc_feature (134)..(134): n is a, c, g, or t
  misc_feature (140)..(140): n is a, c, g, or t
  misc_feature (160)..(160): n is a, c, g, or t
  misc_feature (162)..(162): n is a, c, g, or t
  misc_feature (166)..(166): n is a, c, g, or t
  misc_feature (175)..(175): n is a, c, g, or t
  misc_feature (182)..(182): n is a, c, g, or t
  misc_feature (187)..(187): n is a, c, g, or t
  misc_feature (191)..(191): n is a, c, g, or t
  misc_feature (193)..(193): n is a, c, g, or t
  misc_feature (197)..(197): n is a, c, g, or t
  misc_feature (205)..(205): n is a, c, g, or t
  misc_feature (230)..(230): n is a, c, g, or t
  misc_feature (233)..(233): n is a, c, g, or t
  misc_feature (250)..(250): n is a, c, g, or t
  misc_feature (256)..(256): n is a, c, g, or t
  misc_feature (272)..(272): n is a, c, g, or t
  misc_feature (289)..(289): n is a, c, g, or t
  misc_feature (293)..(293): n is a, c, g, or t
  misc_feature (336)..(336): n is a, c, g, or t
  misc_feature (345)..(345): n is a, c, g, or t
  misc_feature (378)..(378): n is a, c, g, or t
  misc_feature (391)..(391): n is a, c, g, or t
  misc_feature (394)..(394): n is a, c, g, or t
  misc_feature (411)..(412): n is a, c, g, or t
ttggnctagaaatgcgaggggaacttctttgtagtttttacaggtattaaacttcatcttgcacactgnggtcntcatacatacggggcaaaatnggggcttttatattngngtttatncttcatttaactttngggggnactactatggtttgttgagngngggncaggagcangtggtgngcatnttangnttanggtgcttnactcattcactactgcacattaaangcnagcggtgagtgttattnactggnccattaagaggtctgncactgaacaccacctcngggntgatgttcatcatcctcatatgcttctccattgtggtggcgcngtctttccngatttggatcaaagtccaccagttctacttggnccatctcatcagnctnttccacttccttcctcnngggtgggggtttttccagcaaag

SEQ ID NO: 507492 - DNA, 391 bp, Homo sapiens
cagtagctctggtcattactctgacttcgagtaatataggtagagtcgttccatctctgcctttgctagtaccatttccaaagtgtactcgttctctatctcatgatactcaatatccttattttcgcttcttaatcgctctagctcgtgtcctcgaagatgtaaataatgactgcatctgttaaatagtctagtgtgattcatcgaccttaactttccatttattttcttcttgctcaacacttctctgtagcttcagtaaaattccttctgtttctgcaaggacggatttgtatctgtcacactctagctagtaacaatgtgtgcatttcatcagcttctttcaacttgtgctctagaaccttaacctcctctgaccctgaagtgtcta

SEQ ID NO: 507493 - DNA, 106 bp, Homo sapiens
tgagagaccgtgttgatgaggagttcccgttgtggcgcagtggttagcaaatctgactaggaaccatgaggtggggggttcgatccctggccttgctcaagtgggt

SEQ ID NO: 507494 - DNA, 131 bp, Homo sapiens
  misc_feature (70)..(70): n is a, c, g, or t
  misc_feature (111)..(111): n is a, c, g, or t
cagttctcaggagtgtcttcgcaacagctggtgtcggcgctctgacagaacgttatactctaaggactanaggaggatcaacctgatggaggtgagatgagccccgctggnaacttagctcagagtctacc

SEQ ID NO: 507495 - DNA, 293 bp, Homo sapiens
ggcgttcaatgtaattccatcaccactgaccaactccgaaagctcatcccccacaatatctaataaaatgcagtaagactaagattctgaaactcagactatgtcttaagaagccttataacatatctgtgggccttttagaatacttttttttgaaatgtttgttttgagcgtagccagctgctatataagaagtaaggttaccttgtttccattatgtgtggctagagagccatgttgttagcccccagaagttataactattccagctcagggaatgaacctgtgagtga

SEQ ID NO: 507496 - DNA, 225 bp, Homo sapiens
agacgtcattctgtcatgcttaacgtttttggtttggtttggtttggttttgcatttttagtagagatggggtttcaccgttgttagccaggatggtctcgatcttctgacctcgtgatccacccgcctcggcctcccaaagtgctgggattacaggtgtgagccattgcaactggcctgacagaaaaaatttctaagctgcaaagcatgcaagaagggaggtct

SEQ ID NO: 507497 - DNA, 138 bp, Homo sapiens
ccagagcaatgttagggtctgccagcgtgctaccgcatgtctacttccaacttatgcatctggcactggggtaatatgaccacaggatgagtccgggtcacccactgaacccgctgttaagtcctgagctaaggactc

SEQ ID NO: 507498 - DNA, 379 bp, Homo sapiens
ggaccaggatgtacaccacaaactctgcgcatatggttagctagacgaacaggcgcttgaacatctgccggtagctttgatactcatcgatcaaagcgggacgcagaatatcggtttccaggatgcagacgcgtagcgacataaaaaatacctgacacggcgatgggaatattgcacacccagagcctgccttgaaatacctccccaaagcaagccctcaatggccgcccacactccctgtaggagcgagctagctcgcgaaaaacgtcaacgataacgcaggtggcctgaataaaagcgttgcctgtgcgttcttcgcgagcaagctcgctcctacagtggaacgtctaaaacagcgcgccttttgcggctttttcca

SEQ ID NO: 507499 - DNA, 419 bp, Homo sapiens
tgcacgagcacgagattgagaccaccctgtgcaccacagcgagactctgtctcacaaaaaaagagagagtgagagtgagaaaaataatgtgtctgtattactgagtaggtttaactttataggaatttctggaccattctttgggaaccggttctgtacattatcaggttctcacttacagtgggtggacctaagaattttcatctttacagggaggcccaagcaatatgcctttaatagaaattatactctaaggacccttacacaccattctggtttcacttacaggataggattcaataaattatatgagatattcaacactttattattctgagcatgtgtaaaggaagccccgcttaaccgtgaagttcacaattaaattttgcctttttaacttacacggttttcactcttcc

SEQ ID NO: 507500 - DNA, 420 bp, Homo sapiens
cacgagggcgcgaccggcagacgagcgtcaccttgacaccggcgcggcagaacatctgggcgagttcgaccccgatatagccgctgccgataacgagcagcgagcgcggcaattcctcgaggtcgagcgcggtcgtgctggtcagatatggcacggtctcgatcccggggatggcgggcaccgccggccgcgcaccggtggcgatgatgatcttgccggcggcaatgcgcgtgccgttcacctcgacgccgccgtcgatgagatgcgccggcccgtcgcgataggcgatgccgttgtaagcggggaggaggtcgacgtacttggcctggcgcagctcggaaacgagcgcgtccttctgacggacggtcccgcgccaatcggtcagttcggcttcggcgttgatgccgggaaaacgggcgg

SEQ ID NO: 507501 - DNA, 368 bp, Homo sapiens
cctctcaattaatcagagcgaccgcatctggccgatgatgccgcggagtcggggcgtgtcgagttcgccctcgagttccttgcgggccagcagcaggtcgagaagatcgttgtctcccaactcgaagagatgcgtcaatgccgtcacgtcatcgtcggtaagctcggcttcgtgggcgtcgagataccgggtgatgatcaagtcgttttcgagcaggccccggcgcgcccgccaacgcagacgcgcccgttccagttcagtaagcctgctcatcattacaccttaaatacaccaaaatactagaccgtccgacggaccatcagttccttgatcttgccaatggccttggtcgggttaagccccttggg

SEQ ID NO: 507502 - DNA, 154 bp, Homo sapiens
caattaataatttatatgtagacaaaaagggacaaaaatcaacctcaagattcttaactgaggtcctccctaaaaatgtacttttcaagaaggaaagagctattgcaacttaataatattgggatttgtattgggttaagagataagtttctga

SEQ ID NO: 507503 - DNA, 272 bp, Homo sapiens
ctcaaatgggcacagaaagtttcggaacatgagtttgtgaaggctatttttcatcacccagcagttatatgtgagatagtactatactacactgttaatgtgtaatgaatataatatactacttcaattaaacctacattatatagaggaaaaatacattattcacatatttctatttcttagtccatttaaggtcgtctaggctaaattaccaattgactatatttccgacaccctataggacataatgaccatttctgtgcccatttcaa

SEQ ID NO: 507504 - DNA, 784 bp, Homo sapiens
gctattgtggcgggtgaggaacaggaagccctgaagggtcaccagaaatacaaaagcaaaggctatattcttttttttattgctttctattctttccttccttcctcgtgttctttctttcttcctttcatttatttactctttttataagagcgatgcggctctgcgtgtgtgctgtgatgtggtgtgttgtggctgcctgccgagtgctgatggtcgtcatctgcctccctgactgctgcctgagtaagatgtgtgttgtgtttcacttatagtgacttggatgtgtgtgatagactgtgtaaccatctataactcacaacacagagtgattagtgaggtcctagaaggacaagaaacctagagaatagacaacggggacaaaacatgtgactgagcaaagacaagacatcgtggacaggacacagcgtatgcgacacacacacacatgacactgacctcacagagacaagacacgtggtaccaggagtgagaagagcttacagtgcgacatcaccgcatagacgagcctactcacattacatcaccgtttggaacaaacggtggacctaacccagcgaggacaacccactagaaagcggtgaccacacgaggacactagccgctgacccacgggaccgatcagccagaacggaggacaacgcacggatataacaaaacgaggactgcacaacacacaaccaacatgggacacagcagcaggggggtcttaaaagaaagatgaacagagcaccagtgacagaacccacaaacctcaactacc

SEQ ID NO: 507505 - DNA, 818 bp, Homo sapiens
cggacttaagcgatcctctggctccaagcccactaccagtctggccaacatgtcaaaactactaaaaataaagaaatcagccatgaaaaaaaaaaaaaaaaaaaaaaaaaaaaaaaaaaaaaaaaaaaaaaaaaaaaaaaaaaaaaaaaaaagagagagggggcgcgcggtcgaaaaaattaatctccccgaagggagcgagcaacaaaagcggcgacccgaatttttggagaaaaagggggccctcaatgatatggggggggatgtatatatatataaacgaaatgaagagagcgaaggtgagtcggcggtgtatattaaaaacaagctaaggagttggtagagggtggataaaacaaggtcgtatacgctggaagtaagggagatattttgtgtgtgggagaggtacaggcgacaaccattttattgttgcgtgggagggtgaggacagaaaataatatgttgggagcacaaaaaattactttcgtattacagagagagattataagagagaagagacctcggttgagaggggaaacaataattatatacaaaacatattctattaaagccgggggtgtgtacatagagaggcggggtgaaaacaaaaacaaaaagaggacatatatagtatgtcgtggtagcatgcgggctgatggaaagaaagaagaaatgtagtgttggagtagataattcgatggagggtatatgtaagtatgaatttttatgagaaacaatatatttatttaatatatatacacggagagagagagactatagaatagttatataatagaataattaataaataggtagat

SEQ ID NO: 507506 - DNA, 125 bp, Homo sapiens
gtcgtgcatatatctgctggaagcaggaaagctgaagccacccatagggtgtgtaaccggagaaacaggacccaggccttggactgcctgcgtgggcagcttcagcgccttgagatgttttccca

SEQ ID NO: 507507 - DNA, 599 bp, Homo sapiens
  misc_feature (80)..(80): n is a, c, g, or t
  misc_feature (267)..(268): n is a, c, g, or t
atagtctcgccccgactctagaggaaccctgtggagacgggatctcatttacacttggcgcgctggtttcaaactcctgnactcaggtgatcacctgcttggctccaaagtctacaggtgtgagccaccatgcctggcacttttctgtctcttgaaaccacttctttcctttctagtcagaatttaaatctcattctgttttaccacatgtctgaactttattaagcgagagaatacgtctaagttgcttaacacgtaatacgtgtnnatatgcttgcctgacagctgtggctgtggtctaagaattaggttctaagtgaattcttaattcagagatcctcagaaatgaatatacaaaaaggcaggctccattttttaaggtgagagagttgctaaacttggttttcatttggtgtagtagaaaaagcggcatcatcactttggagtacagttcccttgttatcagcgtaagtccatgagaaaatcacctagcccttcagtaccaggttttttgaacatagagggaggtagctgctatgtgtgtaattcatcttttatgtggttcaagcgttactcgacaaaggtgggttcatgtacag

SEQ ID NO: 507508 - DNA, 239 bp, Homo sapiens
tggtgtctgttatatagcaggaaacagtgtagtcttggagcgaggttcatggactacaggcacacggaaagaaggggaagaggccccagtgctctgttcttctcctattaccgtaccacagaaatccccgaaattaggttttccccaccaaatacacatacgctgacatcaactaagcaagtgacttttaaaaacaaaactgacattcagagggagaggaggggatcctcctagagtcg

SEQ ID NO: 507509 - DNA, 96 bp, Homo sapiens
cggatccctataggcgctagtgtccctcagtggatctgctgtcacaatggagtatagccataaaattttagcctgtgcaaatatgtaggaaaatgt

SEQ ID NO: 507510 - DNA, 172 bp, Homo sapiens
tcttacccacagggtcctgtctggtattggtcacaaaacgggtacagcttttggcttatcaattcatacctcagtaaagtagtctaaatcaataaatacagtgtggatttcaaaaacaaaaaaagggaacactctatttttttcaaaggccggtggttaagaggggtaccga

SEQ ID NO: 507511 - DNA, 398 bp, Homo sapiens
cagcttggtcataagtgaggatgccaaggtcgtagggtctatatttctgaaaagtgattgtacaagtaaatccttcagtcgtccccctaatgcgatctgctagggaagctaggagtgccttcacagtggctccaagggggtatccttataggggactacatctcaagacacattttccccagcaagaggctgcatgagtcagcagactgatgaagtcagctctgttaggtcacccgcaattgcaatttctaagttaatgattacagctcccccgaggaaccagaacacagctgagggcacagagtattccccgtgacttactgggcagtggggataatatagcccagatatgtgggtcggggctgaatggtgaagacaatgatatgtgattcgcaggt

SEQ ID NO: 507512 - DNA, 747 bp, Homo sapiens
aagacagcctgaccaacgtggcgaaaccccatctctactaaaaataataaaaaaaaattagccaggcatggtgttacacacctgtaatcccagctacttgggaggctgaggcatgagaatcacgtgaacccgggaggcggaggttgcagtaagccgagatggagccactgcactccagcgtgggcaacagagcaagactctgtctcaaaaaaaaaaaaaaagactataaagctacagtaatccgaagcccgggggaaaccgggcccccagaatagcacttaaacaatcaactcaaacatcatacaaagtctagaaaagtggatgcattccaaccaaacatgccaggtaactccattactaaaatgactttctcaactaaggtgactgctggacacacaccgggatatccactttaggaaagccactaaccaaacacatgctgaaataggctcctagaaccttaaaccttaaacatcttaacaacccttaacactggctctagcacagacaccacgggcatcaacaagcatctcgtcgaacacctgtgggggtacaaccgggccctctctcttcataggcgaaccttccacacacggtgtttgcacaatggtcgaaaaacactacaaacttttactctcaaaaccacttaacacacacgcgtgagccccctcctaataagcaagaaccatcccacttactcgaacaggttcatttgaagcgccaggcctacaacagaccacggcagac

SEQ ID NO: 507513 - DNA, 305 bp, Homo sapiens
gcacattcagcatatggaataaatcttcagaaatcactgaccatgtttcttcaaataaattgcaaggcagtggggggaaaagctagggagaacatgtggagaaacagattagggagataccaattcagcagcatgcacacctatgtttagatcttgatttgaaacacaattataacaggaaaaaacaattgagaacgaatttgacactactggatattctgatatgtacgacatttagccaccctattcaggctatttatactagttttgtatttggtgtatttttaaaagtgctgagagataga

SEQ ID NO: 507514 - DNA, 160 bp, Homo sapiens
tgctgggagtaccagcatgagccactgcaccgagcctcttattattctttccagtgattctcccacctcagcttcctgagaggctgggactacaggtgcaaccaccacgcctggctaatttttgtatatttagtagagacggggtttcgccatgttggcc

SEQ ID NO: 507515 - DNA, 156 bp, Homo sapiens
  misc_feature (45)..(46): n is a, c, g, or t
gcggtccgtcttacagaggcggggagtaagagagcaagctcgcanngatgaatcaaaaggtatacaagacaaggttaggccagttaatttcttagtgtcatcagctataaatggagttatgagaaataagtgaaaatgttcaataaatatttcagt

SEQ ID NO: 507516 - DNA, 370 bp, Homo sapiens
cagtcacacgggggtatcgcctggtccgcccgtgttggacctctacggtcagtggtgaagcctacaggactcgttgacgggtccgataggccttgaccacgtaatcactgggggtgctcggtcacctgggactcctcgtaacacgtggccccgcttcctgttcaaagccccgtagattccacctgaccatctgctctggacactggatcttcacagggtagattggctccatgagtcgtggctgggcagacgcacgcgtgggttaaaggcagcgccgtgctgtggggatgatctggccccctccgcggtggatggcgtcggcgtgcagggtgacgccgtggacgtcgaagcgcacaccccgcatgttctc

SEQ ID NO: 507517 - DNA, 113 bp, Homo sapiens
tcagcgtgttggcaactctgtcttcagcctctgcagctcctccagcagtcgtgagatggcgtcaggttggcgctctgtgcggagtgtcgtaacagtggccacaccacgcggcg

SEQ ID NO: 507518 - DNA, 106 bp, Homo sapiens
agttccgggtcccccactgggtggaagggacattttcagacttttctttctggtcactgggagtgtctatgcctctcatatttccctattaaactcttcaattttt

SEQ ID NO: 507519 - DNA, 504 bp, Homo sapiens
gcaacaaacggacgcacttatcacgaccccccgcatttgcacacccacacagaaaggggagacaattcggaggggagaagcgagccacgcccacgaacaacggagcccgagagaacacgaacaagacgaccccacgcgcgccaggcagcgaacacgacaagagaaacagagagagacggcagaagcaggagcacgccagacaaggaacgagaacgaaccagcgcaccgagacccagccagacgaacaacgccacacgcgacgcagacgaaacgaccgaacaagagcagggacacaaggaacaggacgaaacaaccacacaacagaacaaaccgaagaccgacgcaaagaaacaccgcaacaaagcgcagcaagcaaacccaggcagagcgacaagccgaggagcaaacagggaccacacacacacacaccgccagcacacgagccgaccgaggacaccacaagaacgcagccaacgcaggcacacacagccaccagcccacccg

SEQ ID NO: 507520 - DNA, 392 bp, Homo sapiens
  misc_feature (24)..(24): n is a, c, g, or t
  misc_feature (128)..(128): n is a, c, g, or t
  misc_feature (203)..(203): n is a, c, g, or t
  misc_feature (361)..(361): n is a, c, g, or t
ggtccaggaaagctccccgggtgnaaagcccctgcaggtcccaaaaggactgccctcctaagtcatctggccggtacctgtccaggtggggctgcagaaagaaatttataaggctgcacatgctgtgnctcatgccctgtaatccccagcactttaggaggctgaggcaggcagattacctgaggtcgggagttcgagactancctggacaacattgtgaaaccctgtctctactaaaaatacaaaaattagctgggcgtggttgtgggtaactataatcccagctactcgggaggctgaggttgcctgaacccaggaggcggaggttgcagtgagccaagatcatgccattgcacttcancctgggcaacaagagagaaactctgtctcaa

SEQ ID NO: 507521 - DNA, 243 bp, Homo sapiens
cagatacaccacgcacctcacacaccaccacaccataataaccataaaatcaccaccaccatcacatgaccaccaccacaccatcattaccattcaagcaccaccaacataaccacatataccaccactaccatcaaatatccacaccaggccctatcactgatctactccacaccatcgcttccaatactaatgtagtaatatccaccaccatgccctatcactgctactagtccacaccat

SEQ ID NO: 507522 - DNA, 359 bp, Homo sapiens
cgctattactctctccataccttacaccagattttgaggcattaaatgtgctctctgtgtccacaagataccataaattttttaagtaaatctgtgaacacgaatgaaggaatgacttccagaattcgaaagaaactgagttccacaaagctctgtctgagactggaacttgcagaccagacaataatcttcatttttgctggctatgaaaccaccagcagtggtctttccttcactttatatgaactcggcacttacacctgatgtgcaccagaaactgtgaaaggagaatgatgcacttttgcccacataagggaccacctatctatggccgcggtactggagtaccttgactggtg

SEQ ID NO: 507523 - DNA, 331 bp, Homo sapiens
  misc_feature (118)..(119): n is a, c, g, or t
aaaggaaaggggccagggatgggagcagtgctgtgctgttatccctgttttgcttggaatgaaaacatttgagcacccggttttcaagggggacgctttccccttattccagcagggnnattttcctttttccttttgagaaggggagctttatttgctttcaaaatggagcacgtcgcactggagttttgggcccttttgttaacctgtcaggagccacaggggtccataaaacggaatcagggtttcaaaaaacatgacctatgtttaaagcaatgttcagccatttgggtttgaaaaaaaccccattaaagccaagacccgtttggag

SEQ ID NO: 507524 - DNA, 150 bp, Homo sapiens
gaggataactatgtacggttgcattgatccagcatcatgttgtgttcagatatccatgtcatgggtagtagtatgttgttggcataataattttacagcattgtaagaggttcaagtttgggacgtaatcggtcacgtatgtgtgggata

SEQ ID NO: 507525 - DNA, 447 bp, Homo sapiens
catgcatgcatctagcttccttgtctggctgtttcttcagtctctggcgccttcttccgtgcatgccataggacaggcattgtatgtttagtctgttcttctcccctacgtgcctatccagcacttccaaataaggtatgaacaggatccaccatatctcctgacctgacatgcaaatcccccagattgtcttcatctagacatgctaatatgaaattacagcagtatactctctatcaatccaaatgaagtcttccaattatctttagggaagccaggacccaccatgagtcgcataaatctggaaacttctccggacttccattgagcccgccagagggtacttgtcgttcacaaagccatcagccaagtaaatcagaatttacttgatgcaacagacttgacatagccagaaatcctgtgcaaaaatagatctagtccagaatg

SEQ ID NO: 507526 - DNA, 159 bp, Homo sapiens
ccccaaaattaaggtttttggccttttttaagcccccccctggcttagaccagcaaaaaaagccaggaaggggttagttgcttttcccagcccccccccccaaggtttttcaaatttaaagccccgccccccccctgggtaataaaagtggtttttgga

SEQ ID NO: 507527 - DNA, 462 bp, Homo sapiens
  misc_feature (34)..(34): n is a, c, g, or t
  misc_feature (83)..(83): n is a, c, g, or t
  misc_feature (88)..(88): n is a, c, g, or t
  misc_feature (92)..(92): n is a, c, g, or t
  misc_feature (97)..(97): n is a, c, g, or t
  misc_feature (147)..(147): n is a, c, g, or t
  misc_feature (184)..(184): n is a, c, g, or t
  misc_feature (193)..(193): n is a, c, g, or t
  misc_feature (212)..(212): n is a, c, g, or t
  misc_feature (236)..(236): n is a, c, g, or t
  misc_feature (272)..(272): n is a, c, g, or t
  misc_feature (302)..(302): n is a, c, g, or t
  misc_feature (331)..(331): n is a, c, g, or t
  misc_feature (351)..(351): n is a, c, g, or t
  misc_feature (361)..(361): n is a, c, g, or t
  misc_feature (444)..(444): n is a, c, g, or t
  misc_feature (446)..(446): n is a, c, g, or t
tactatttcctaatgcatgaggtggacagacatnagaaaagcctggactcagtcggaaaaacaaatccagcagtcaaaaaagnccttnaccngcaanccccacccccagccaacccaagagcattaaaaaaacaactcaaaaagcanccatcaaagacaccaatcaattccccaccggcgaaanacaaaagancccccaggagtcacaagantcccaaacaatcaatcaacaaaancaacaaaacatttgcccatgaaaaaagaccaggatncacccccaccgacgtccccacccggatggngcccagcacccccccccccccgccgccgncccccccacaggcgggccanggccaggagncggagggcaggggggggggcagcaccccccggaaagaagtaaccaaagcaccccccccagcccgcaccagacccaccaccagncnggaccccccccccccc

SEQ ID NO: 507528 - DNA, 218 bp, Homo sapiens
  misc_feature (101)..(101): n is a, c, g, or t
  misc_feature (168)..(168): n is a, c, g, or t
  misc_feature (176)..(176): n is a, c, g, or t
aaaggtggtgtctacatcagttagagccctctactgaactccatgcctacgtcgccgcgcgctgcaccgccaatatggggacagattcatcaacctcaggngacccattcctgctcacctgctgggtaaggacctgaccttgcctccgcatgttccagggtcatcctnctcatgtntcgcattccagagcatggcaccacccactccccgacacgtga

SEQ ID NO: 507529 - DNA, 979 bp, Homo sapiens
cgggtcatggcgccccgagccctcctcctgtctgctctcggtggagtgcctggccctgaccgagacctgggcctgctcccactccatgaggtatttctgacccgcgcgttgtcccggccgcggccgcggagagcccccgttcatctcaggtgggctacgtggacgacacgcagttcgtgcggttcgaccagcgactgcctgcgagtccgtagtagggcgaggcctgctggctccgtgtggtggcatgcacgtgagggcgccggagtattggtgaccggccagacacagaagtacaagcgccaggtacatggctgacctgagtgagcctgcggtaacctgcgcaggctactacaaccagagcgaggacgggtctcacaccctcctagaggatgtctggctgcgacctggtgcccgacggcgctgcctcctcctgcgggtgtgaccagtcctgcgctactacgtgcaaggattacatcgccctgaccgaggacctgcgctcctggaccgccgcggacaccgcggctcgagattcacccagtcgcatagttcggcagtgcgggcccgtgccggtggacgcagctgagagccctacctgtcatcgtgccgtgcgtgcgagtggctccggcgatacctggcagaacgggcacaggagacgctgcagcgcgcagaaatcctcatggatgacaacggtgacccacctgaagacccttgtctgacctgtgaggcccatcgcctgtgacggcagctgggccctgggcggttctacctgctggaaccaccactgtcctgctagtcccgtatgtggcatatctgcaacctgtaacgcctttttgctagcgcctcttctgcctggccctgcggccttgtccgtttcgtggggtctggggcaccgatgttcatgccagaggttggacccctcctgctgcacttcccgacgcccacctggttgtcacacctcttccccttgcctgcccattga

SEQ ID NO: 507530 - DNA, 286 bp, Homo sapiens
  misc_feature (38)..(38): n is a, c, g, or t
gtggccaaccttagtggtgcctttgccaccagccctgntggcccctggtttcgctggccccccaaatgcctgggttagacacgccagtggcctcagctgcccacacctttttccggcccctgaagttggccctgcagcaaacagctccctgggccccaggcaggtaacaaacacagccgccagcccaaacagcaacggcatgggcagcgccagcccgggttttaacagggtatcccccagccaggagtgcccccgggaatggataataaagatactaaagaactga

SEQ ID NO: 507531 - DNA, 855 bp, Homo sapiens
gatcgagttcacagagggcgaagacaagatcaccctgagagggccctacagaggatgtcagtgtggcccaggaacagatagaacggcatggtcaaagactttgattaaccgagatggactatgtggagactctaacatcgaccacaagttccaccaggcacctcacttgggaagagcggtgccccaaccatccacagatatcaaagacacacggtacaacggccgtcccgctgcgccaatgacaatacctgcaccggatgagaaccgcagcaacaatggactcccgccatcgcagacggcgaaccgaacagggcgccgcgtccaacccaagcgccacaccggcgcaccacgcactgcacacgcacccaacaggccctcatatcagccatctggcaaagacctgaccccccgataaaccccaaatgagacactccctacacctccaccatctaaaaaaccacataacaaaaatctcaacactacccccacccaacaaaaacactacaagacaacccacaagaacaaccgggcacgacgaacactaagaaccctcccccggactagacgacaaaccgcctcggcgatcggaaacccgaacacaattgcgagcgaaacacgaaacgcgacaccccacatgcaactacaaagcaagcatagctcaccgccacggctaccctcccccccctatttaccaacacgcccatacgacccgcaacccacacaaacaccctaccattactgcataacccccaaagacaaccttcccacctgtcaacatcgattcaacctcccttaaaacaacacaacaaacttatacacagaagaataacatacccacaccctcaactcatctag

SEQ ID NO: 507532 - DNA, 301 bp, Homo sapiens
  misc_feature (23)..(23): n is a, c, g, or t
  misc_feature (151)..(151): n is a, c, g, or t
tctgtaataaatgtggtacactngaattatgatttcctgagaataataaaaattgggccaggtgcagtatctcatgcctataatcccagcaccttggaggccaaggcaggcaggtcacttgaaggtcaggagttcgagatcaacctggccnaatatggtgaaaccctgtctctactaaaaatacaaaacttagccaggcttggtggtgcacgcctgtagtgaagtagaggttgcagtgagttgagatcgtgccattgcactccagcctgggcgttgcagagagactctgtctcaaaaaaat

SEQ ID NO: 507533 - DNA, 421 bp, Homo sapiens
gaaagcacttaagcactccgtcctgttggtaaagaatataccaccatttcatctggctagttcaccatcacaagctgcattaccataaggagatttttgataacgaggagttgaccacgataatatctgaagatgattgcttttccctggttgtagttgttctgcccataatttgctggcacattaatcatagataaagaaagattgatggacttagccctcaaatttcagtatctatacagtactagaccatgcattcttaaaatattagataccaggtagtatatattgtttctgtacaaaaatgactgtattctctcaccagtaggacttaaactttgtttctccagtggcttagctcctgttcctttgggtgatcactagcacccatttttgagaaagctggttctacatgggggga

SEQ ID NO: 507534 - DNA, 115 bp, Homo sapiens
agatgagctggctaccattcactgtgtctcctgtgtgctctgttgctccggctgggccagtgctgctccactgcatcagctcctcactgcctgccttcagcttgacccgaagcag

SEQ ID NO: 507535 - DNA, 489 bp, Homo sapiens
atgtcgctggtgtagcggtgtatgctagttgcgtttgtatatgctgtacgtctgtagtgtgtactagtgcgtacatgtgagtgcgtgtgaagtgccgaacgattggtcataccgtgtgtgcagtgtgtagtagcgtgtgtgtgctgtgcgtttgtgtgtgtgctgtgtgcacatctgtgtgctgttgtgtgctgtgcatatagtagtgtagtgcatgtgatcgtgtagtgtgctgtgttcatgcgtgtagcttgtgtgtagtagtgtgtagtagctgcgggaaatgataaagtatgagtgctatataggatgggaattgagatgtaagattttgggggtgaggatcgtgccaattacatttcattagcatggatttcggttttcatgctctgtcctcccctcctttggtcttactgggtccctctgactgctctgtgatttatagtgatggaaaagggagtgaggagccagtctgggttgttgctattt

SEQ ID NO: 507536 - DNA, 166 bp, Homo sapiens
cgacaccccggcctggcgcgccacggtattgagggtgactgcggccgcgccccgggcttgcgcggtttgtgttcgttcacggcaaaaacctcaaaaaggaatataaaactaattttttagtatttgacgctctaaaccgacgccttcaataatgccgatgttacgc

SEQ ID NO: 507537 - DNA, 229 bp, Homo sapiens
atttttgaggtcaggagttcgggaccggcctggccaacgtgatgaaaccctattagtactaaagatacaaaaaataagccaggtgtggctacaggcgcctgtggtcccagctgctcaggagactgaggcggaagaattgcatgagcccgggaggtggaggttgcggtaggccaggaccgtgccattgcactccagatccagcctgagtgccagagtgagactctgtcta

SEQ ID NO: 507538 - DNA, 121 bp, Homo sapiens
tcggctcggcccatgtatgcatgagagaaatgggaggatgatgatcagaggctagggctttgagctgtatgaaaaagatttgaactaactgcaagaaagaatttgaggctgggtgcggtgg

SEQ ID NO: 507539 - DNA, 245 bp, Homo sapiens
  misc_feature (172)..(172): n is a, c, g, or t
ctcagtgaagtggagataacatcaggatctgaagcacgcatggtggctcatccctgtaatcccagcactttaggaagccgaggcaggaagattgcttgagcccaagactttgagatcagcttaggcaacatagcaagaccttgtctctccaaaaaaatagccaggtgtgatnggacacacttgtggtcccagctactcaggaggctacggtgggagaatcacttgagcccaagtggtcagtcgac

SEQ ID NO: 507540 - DNA, 100 bp, Homo sapiens
attggaatgttcccagtagagaaggtagtcagcccttctggatgcggaaggctggtagccaagtcaagtctgcccacagcgctagatgtccaactctgga

SEQ ID NO: 507541 - DNA, 142 bp, Homo sapiens
ggggctttaaaccccccccctttccttccggccttttgggttttttttccccaggccccccctcccctgggggccctaaccccctctgggggggcccccccgcccatgggtataaagccagggcccttttttttaccctgga

SEQ ID NO: 507542 - DNA, 283 bp, Homo sapiens
tagcagcgcagccacatcaatgctggaacaatcagaaacccttcaccatgttttaaagaggtaatacacaaacatttttacttgaaaaggagttgagataatggcccaagtgtgagcgagtggattggcggatatcccagcatgtacagcatgtgataacgcgggtacggcaggactagtgtctcaccagtgcagcatgctcctcaagctgtcacacgtgctcagcctccgcggaagatgttgcgtgaaatcttccgcggccctagaaggctttggtatcctg

SEQ ID NO: 507543 - DNA, 320 bp, Homo sapiens
cataggctagctattcctatatatttaatattagcttttcttaaaaaaaattccagcctcataaagttgattagaaaactagattgctagtttattttgttatcagatatgtgaatcttttctcccttgtaagaaactattcatttattgttacgttatgaagtcttctgtatagtttgttttaatactaatttttgttttagtattttgtttgaaatgaaaacttcattatttgtgttcatatgttttatataaacttaacttttttatactgtttatttttagccctttgttttattattaatagttaaaaaaattta

SEQ ID NO: 507544 - DNA, 154 bp, Homo sapiens
cggttgacatgcccttggctatctaagaaatctaaatcaggctaggcactaccatgcctgtaatctcagcacttgggagggcaaggtgagaggactgcttgagctcaggaattcaagaccagcctaggcaacatagggagaatctgtctctact

SEQ ID NO: 507545 - DNA, 190 bp, Homo sapiens
tttttttcccccccccccctttttttttccatttccctttttcccaaaggggcccccggggggtttttccatggggaccccaagcggggtggggttttttaaaaaaatttttccccccctggggtttttcccttggggaaaagggggttttaaaaggaaatttttaagggtaatttaaaaaaaatttcca

SEQ ID NO: 507546 - DNA, 271 bp, Homo sapiens
tggtgtgcacagtgtgatgcggtgagtgtctggagaaggagcacgataacagggattagcatttggactttatccagtcaacctgcggagtctgccttcagttggggcgctttgatacacatcagtgaaagaagagaaaaacctcgacttgttgtataagtatattgttcataaaacatacggtttccacttcaccacacctgccttagttgtggaaaaggatgccgtttttatacctgcaggctgggacaatgaaaagaaaatagctatt

SEQ ID NO: 507547 - DNA, 149 bp, Homo sapiens
  misc_feature (1)..(1): n is a, c, g, or t
  misc_feature (98)..(98): n is a, c, g, or t
ngcacactcaggtatcacacacagagaggcacacacacagcccagcacgcagagaataacttgctgatatttgagtaacaccagtttgctaaaactanaaagatgcctttgtgtcaccttacgtaaaacaagacttgatgcctataact

SEQ ID NO: 507548 - DNA, 280 bp, Homo sapiens
ttaagctgttacccttgtgcactgtgcagctcatggtgtatgggaacttagtgatcttggcaataccgagtaggggtaataaaattaaaatgactggactgttaatatttacattgtgcactggtttataaaagtacactactcctcctatgtccaccccaatctcttaataaaatttccagggcagggcttgggaacttgtattttaaaaaatgatcccaggacttctgggtgttgggaatgtccaatttaactaggttgttacatagtgtgtatgtgt

SEQ ID NO: 507549 - DNA, 787 bp, Homo sapiens
  misc_feature (452)..(452): n is a, c, g, or t
ggccgggcgcggtggctcacgcttgtaatcccagcactttgggaggccgaggcgggcggatcacgaggtcatgagatcgagaccatcctggctaacacggtgaaaccccgtctctactaaaaatacaaaaaaattagccgggcgtgatggcgggcgcctgtagtcccagctactcaggaggctgaggcaggagaatggcgtgaacccgggaggcggaggttgcagtgagccgagatcgcaccattgcactccagtctgggcaacagagtgagattccgtctcaaaaaaaaaaagaaagggacaaaaaaaatagctttatacctcttccttgtctcaaccgccatgaaatttctgaacactcccaaattcagttgaatattccaaaacaaattttttacgtttacaataatttacctccttatagtaatagtataccttaaaaagcctcaggntatatatcttctaaacagtacaattcagttgcagcttaccttaaccaatatgttctctagtggagaacccacctaggcgccttatttcactggctgtgggttgccctccagcgggcctaacattgtggtgccccaattaaatttttcgggcagaatttacccctgaattggtaaaacccatccggagttgggttacacagtctgccaaaaatctccaaaaggccccgtatttagtgtaatccctctgcgacagtgcttcttgcgattgcggtccccagtcatgacctgctcggtgtaactaaaaccatagctcacgtttaaaagacccgaaatgg

SEQ ID NO: 507550 - DNA, 272 bp, Homo sapiens
tcccctcagatttcctgatagcttgatggcatgtgtctgtgactgtgactgtcatcattgctgaacaacatctctttgaatcaaagcttgattttcccagaggttgctgggtcaggcacttgtgttaggagttggaaagcaaaaatgggtccatagtcactctgtggaggtgtccctgtctgctctgtgttgtatcccttgagaattaatgccaggaacgtaatgtggatgtgactgatggactgaaatttaaagtaaatagcctcttctta

SEQ ID NO: 507551 - DNA, 654 bp, Homo sapiens
tgttaacaatcgtgttgaattagcacaaatagtaatacattcctgcactgacttagcagtgaaatgtgttatggtttgcgttatgtattattacttgagacagggtctcagtctgataacccagtatggagtgcagtgatgcaatcttggctcactgcatcgtctgcctcccaagctcaaacaatcctcccatctctgcctgccaggtagctgggaccacaggtgcacaccaccatgcctggctaataatagtatttaatgtagagacgggattcaccatgttgcccgggctagtctcgaactcctgggctcaagcgatcctccgtcctcaacctcacaaagtgctgggataacaggcatgagccaccatgctggctactccttttgaatggacaaaggtttgcttaggccccccaagaataagtctggcatgtggcacttcccctacagccctggatcctcagacactgatgtgagacatactggctacagaaattcgtctaacttggtaaaaaatgctatctttaggctgcaaatccagcaaacgagaaatatcatcatcttaggtgaagatcatacaaaaaccctggggcacttgagaacagcatcccaggtcccctgaagtccatatagctcacgtcacaactactgatc

SEQ ID NO: 507552 - DNA, 377 bp, Homo sapiens
  misc_feature (30)..(30): n is a, c, g, or t
  misc_feature (76)..(76): n is a, c, g, or t
  misc_feature (204)..(204): n is a, c, g, or t
  misc_feature (233)..(233): n is a, c, g, or t
  misc_feature (245)..(245): n is a, c, g, or t
  misc_feature (248)..(248): n is a, c, g, or t
ttcctggctgctgcagctgtcgacgacggncgttataaaacgcttgcacccagttcaggatcgcgatcgaaacctntccgcgttgccacatcttcaacccgatgttcttcccacaggccatctgcggcgcgaaaggtacgaatacctgattccgcagaaattcctgcccctgtcagtacgagtactcttggtttttccattgcntccggcaccactttatctctgaaaaaaantactgacgcaanacntcgcgcaggcggcgtttatttttacgaaaacgacttaaccgatgaccccgacgcgacagcatagcaacctctgttgtttaatcggttagatgtaggaaggccgcaccacgcattcctcccgcatcaccg

SEQ ID NO: 507553 - DNA, 363 bp, Homo sapiens
gctcgactgtagaacaaaaagggaggaaaactaacattctcttcctatttcatatagctaaaaagtctgtcaattgtcactatacttcacaaatgttgtttttaataacatacattagatattttcaaatgctaagaagtgtataggacaaaacataagttctaccccttagttaagccttaatgtttttaaatgacaaaagtcttacacacacatcatagaaatccatgtaatttagaaagacataagatgagatgtagaattctctctcccccaaattccactccttctccccacatttaactattaacaaaaatttttatgtatccttccaaaacgcaaaagttgaaattgacgtcgacg

SEQ ID NO: 507554 - DNA, 675 bp, Homo sapiens
gcggacgcggagcgtgctattgtacaccagtgaataagatgttataaagggcaagccagtacgcatcatgtggtcaacaccagtgatccatcacttcgcaaaagtggagtaggcacacactcatatcattaagataaatctggactaaatccatatgcactaagtaaagcactgtttgatacatctgcagcttttggtaacatcctttcatgtaaggtggtttgtgatgaaaatggttccaagggctatggatttgtacactttgagacgcaggaagcagctgacagagctattgaaaacaactgacatggacatgctcctaacactgatcgcaaagtatttgttggaccgattcaagtctcgtaaagaacgacgaagctgaacttggacgctacgggcaaaagaattcaccaatgtttacatcaacgcaatttctggagaagacatggacctgatgagcgccttacggatctcttccggcaagttcgggcctgccttacgtgtgcacagtacatgactcgatgacaacgtcggacaatcccacacggaacccgcgctcgtcaagcctcggaacaaggcatggcaacatgcccacagcaaacccgtggacacagatgacacggacaacgaccccaacgcacacaacaccacagcggcacagcccaaaaacagtgc

SEQ ID NO: 507555 - DNA, 555 bp, Homo sapiens
  misc_feature (555)..(555): n is a, c, g, or t
agcagtggtatcaacgcagagtgtccattccggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaaaaaaaaaaaaaaaaaacctggggggcggccggggccctgaaaaagttttcaagacaccatcgcggttggggcggcgggggcccaatggaggtgaacagggagacctggggccataagcggggtcccaagggagaacacccggggccagggacaaaggggggggagttctccaccacaatataaaaaacggccgggggggggaaacccgcggagcggggttcctgtggaaaacaaatatttcacgagagattggggagcgtccaagggagagggatcatcaaaaggggggagacctatatctacaacagagggggcgctccaacagagagagaccccgagaatattcaaaattaaagcgcccggcatccgtgggggggaagn

SEQ ID NO: 507556 - DNA, 195 bp, Homo sapiens
  misc_feature (30)..(30): n is a, c, g, or t
  misc_feature (63)..(63): n is a, c, g, or t
  misc_feature (132)..(132): n is a, c, g, or t
  misc_feature (168)..(168): n is a, c, g, or t
  misc_feature (182)..(182): n is a, c, g, or t
ggatccggttgcagtgagccgagatggcgntaccgcactccagactgggtgacagaacaaaantccatctcaaaaaaaaaaaagtgtttacaattattctaaggagctgtacctgctctgatcacagcttanctcgctatcatcttctgctacgtcccctcttcatgntggttcacacagcncccttttgcagct

SEQ ID NO: 507557 - DNA, 203 bp, Homo sapiens
gcgtagatgggaggggatgaggactaggatgatggctgcgaaagtcagacggtttctatttcctgagcgtctgagatgttagtatacgttagtttggtggtgagtgttaggaaaatgggcatacatggactaggacagcagactaaggaaaatgattatgaggcgcgtgatcatgacaaggtgataacgctcttctatgcata

SEQ ID NO: 507558 - DNA, 226 bp, Homo sapiens
  misc_feature (49)..(49): n is a, c, g, or t
atgtaagcatcaatgaatagtatatttaatagcaatacagcactgttgntaagccctcagtatatgccaaaatctaggctaagaaatttgcatgacatgaccctctctctttctatgtatgtatatttgtgtctatctatatagagagtatgtagagttgcttaattagggttaagtgaaagatatagatagatgatagatcgatcaatcaatccatatagggaga

SEQ ID NO: 507559 - DNA, 223 bp, Homo sapiens
cctgcacacgccgaatatcatacgccgcaagtcgaatggcgaagttgttgctgcacacgccgagactccagacgccgcgagtccgagagatcactgtggacgaagttgttgcgcaacaacttcgtccacagcgacctgggtctgggtcctcggcgtgtgcagcaacaacttcgtccacaagacctgatcttaagaagtgtttggagactcggcgtgtgcaggt

SEQ ID NO: 507560 - DNA, 208 bp, Homo sapiens
gttagggaagggggagatgagagagcccactagagtaagagagaaaaaggagggaggagggggagggaagagagagagagaaacctcaacttttatttaaaatcagagagcagttgtaagcctggagttgttgccatggcaacagcaagaaaagaagatagagagcttgtgaagccatgaaaacccaataggggtaaatgtttaaagc

SEQ ID NO: 507561 - DNA, 275 bp, Homo sapiens
actgtatgagtgacatgtgtagtgggactggcaggcacagcacatctgcttgatcgtgtatgtcacgtgcatgtagacttcgctggcactgtgtgcgaggcagtgctgtcgtgtgtacggtcccgagcatctgctaggtggagttctgcggcagtctgtcgcttcgtcaggtcaactgatggtctggggaagagcctgaccaggcatgcgacgacacgttccatcttgggggtgctgtcgagctcagcgtgaagacttggggctggtcggggatg

SEQ ID NO: 507562 - DNA, 337 bp, Homo sapiens
  misc_feature (46)..(46): n is a, c, g, or t
cccagtaggtaacaactttatctagtgtaaaaatgaaagaacattntgggccgggcacggtggctcatgcctgtaatcccagcactttgggaggcccaggcgggcggatcacaaggtcaggaaatcgagaccatcctggctaacatggtgaaaccccgtctctactaaaaatacaaaaaaaaaattagctgggcgtggtggccggcgcctgtagtcgcagctactcgggaggctgaggcaggagaatggcgtgaacccgggaggcggagctttcagtgagcggagatagcgccattgcactccagcctgggcgacagagcgagactctgcctcaaca

SEQ ID NO: 507563 - DNA, 355 bp, Homo sapiens
  misc_feature (337)..(337): n is a, c, g, or t
  misc_feature (348)..(348): n is a, c, g, or t
tatatatagtgtaaaatactgtatatagtatatatacactatagtatatatagtataaaatactgcatgtcgtatgcatactctatagtgtatatagtaaaaaactatatatagtttgtatatataaactatatatagtacatatatggtatatatactataaactatatatagtatatatgcgctatggtgtatgtatgctatatgtagtatagtatacatacatatagtatgctatgtactataggtatatatatactatatataggcataatatacatacatataggtatgtaccttaaagtataggtatatattatacctataggtataggtnttatataggtnttaacat

SEQ ID NO: 507564 - DNA, 783 bp, Homo sapiens
  misc_feature (5)..(5): n is a, c, g, or t
  misc_feature (76)..(76): n is a, c, g, or t
  misc_feature (104)..(104): n is a, c, g, or t
  misc_feature (116)..(116): n is a, c, g, or t
  misc_feature (154)..(154): n is a, c, g, or t
  misc_feature (158)..(160): n is a, c, g, or t
  misc_feature (164)..(165): n is a, c, g, or t
  misc_feature (177)..(177): n is a, c, g, or t
  misc_feature (194)..(194): n is a, c, g, or t
  misc_feature (199)..(201): n is a, c, g, or t
  misc_feature (203)..(203): n is a, c, g, or t
  misc_feature (247)..(247): n is a, c, g, or t
  misc_feature (253)..(254): n is a, c, g, or t
  misc_feature (266)..(266): n is a, c, g, or t
  misc_feature (282)..(282): n is a, c, g, or t
  misc_feature (288)..(288): n is a, c, g, or t
  misc_feature (292)..(292): n is a, c, g, or t
  misc_feature (311)..(311): n is a, c, g, or t
  misc_feature (326)..(326): n is a, c, g, or t
  misc_feature (341)..(341): n is a, c, g, or t
  misc_feature (351)..(351): n is a, c, g, or t
  misc_feature (360)..(361): n is a, c, g, or t
  misc_feature (364)..(364): n is a, c, g, or t
  misc_feature (366)..(366): n is a, c, g, or t
  misc_feature (372)..(372): n is a, c, g, or t
  misc_feature (379)..(379): n is a, c, g, or t
  misc_feature (388)..(388): n is a, c, g, or t
  misc_feature (394)..(394): n is a, c, g, or t
  misc_feature (551)..(551): n is a, c, g, or t
  misc_feature (558)..(558): n is a, c, g, or t
  misc_feature (561)..(561): n is a, c, g, or t
  misc_feature (563)..(563): n is a, c, g, or t
  misc_feature (568)..(568): n is a, c, g, or t
  misc_feature (572)..(572): n is a, c, g, or t
  misc_feature (576)..(576): n is a, c, g, or t
  misc_feature (608)..(609): n is a, c, g, or t
  misc_feature (618)..(618): n is a, c, g, or t
  misc_feature (621)..(621): n is a, c, g, or t
  misc_feature (626)..(626): n is a, c, g, or t
  misc_feature (638)..(638): n is a, c, g, or t
  misc_feature (642)..(642): n is a, c, g, or t
  misc_feature (648)..(648): n is a, c, g, or t
  misc_feature (662)..(662): n is a, c, g, or t
  misc_feature (684)..(685): n is a, c, g, or t
  misc_feature (782)..(782): n is a, c, g, or t
gcggngggggggagcccggagccttccgcggtcccccgcccgcccggggcccaacgacgccctactgggcgagcangatttccgaggacagggggtccgggccnttcgctttcgantctcggaggagccgggtccgggggctgttttttttttntttnnnttcnncgtcccgcagantggagctggagtgagcnttccnnnantttttgctgccaaatgtggtgcagaagtaatactgtcagacatntcagtnntgcctcactgtntggaattctttcggcnatgctnccanttgaataactctgcctacntctgcaggtggtagnactaacattgtgtcntatatcttgngatcttctnnctntnccaccncaagatnttacccttncatctnatgttttctttgaaccagaacattttgaagacattttggctacaatatattttttgatgcacaagaatcccaaggtccaattgtggtctacttatcaagttaggagtgctgactggtcacttgaagctttactctacaaatgggatatgaaatgtgnccacatnccncntgagncttntgangcagacaaagaagatatagcagaatctacccnnccaggaagncanacagntgaaatgctggncatncccttngcaaaggacagtcnctgaattatacctacaacctgnnctgggacagtatcaatactgatgagcaacctggcacacaaactatgagcagaccacttcagcttgagaatgcagtgggtctgaagatggtcaagtcng

SEQ ID NO: 507565 - DNA, 886 bp, Homo sapiens
  misc_feature (5)..(5): n is a, c, g, or t
  misc_feature (76)..(76): n is a, c, g, or t
  misc_feature (104)..(104): n is a, c, g, or t
  misc_feature (116)..(116): n is a, c, g, or t
  misc_feature (168)..(168): n is a, c, g, or t
  misc_feature (184)..(184): n is a, c, g, or t
  misc_feature (306)..(306): n is a, c, g, or t
  misc_feature (317)..(317): n is a, c, g, or t
  misc_feature (338)..(338): n is a, c, g, or t
  misc_feature (355)..(356): n is a, c, g, or t
  misc_feature (366)..(366): n is a, c, g, or t
  misc_feature (390)..(390): n is a, c, g, or t
  misc_feature (400)..(402): n is a, c, g, or t
  misc_feature (420)..(420): n is a, c, g, or t
  misc_feature (422)..(422): n is a, c, g, or t
  misc_feature (424)..(424): n is a, c, g, or t
  misc_feature (427)..(427): n is a, c, g, or t
  misc_feature (429)..(429): n is a, c, g, or t
  misc_feature (432)..(432): n is a, c, g, or t
  misc_feature (441)..(441): n is a, c, g, or t
  misc_feature (456)..(456): n is a, c, g, or t
  misc_feature (477)..(477): n is a, c, g, or t
  misc_feature (486)..(486): n is a, c, g, or t
  misc_feature (493)..(493): n is a, c, g, or t
  misc_feature (503)..(503): n is a, c, g, or t
  misc_feature (511)..(511): n is a, c, g, or t
  misc_feature (517)..(517): n is a, c, g, or t
  misc_feature (519)..(519): n is a, c, g, or t
  misc_feature (522)..(522): n is a, c, g, or t
  misc_feature (528)..(528): n is a, c, g, or t
  misc_feature (530)..(531): n is a, c, g, or t
  misc_feature (539)..(539): n is a, c, g, or t
  misc_feature (546)..(546): n is a, c, g, or t
  misc_feature (548)..(549): n is a, c, g, or t
  misc_feature (551)..(551): n is a, c, g, or t
  misc_feature (654)..(654): n is a, c, g, or t
  misc_feature (661)..(661): n is a, c, g, or t
  misc_feature (664)..(664): n is a, c, g, or t
  misc_feature (666)..(666): n is a, c, g, or t
  misc_feature (671)..(671): n is a, c, g, or t
  misc_feature (675)..(675): n is a, c, g, or t
  misc_feature (679)..(679): n is a, c, g, or t
  misc_feature (711)..(712): n is a, c, g, or t
  misc_feature (721)..(721): n is a, c, g, or t
  misc_feature (724)..(724): n is a, c, g, or t
  misc_feature (729)..(729): n is a, c, g, or t
  misc_feature (741)..(741): n is a, c, g, or t
  misc_feature (745)..(745): n is a, c, g, or t
  misc_feature (751)..(751): n is a, c, g, or t
  misc_feature (765)..(765): n is a, c, g, or t
  misc_feature (787)..(788): n is a, c, g, or t
  misc_feature (885)..(885): n is a, c, g, or t
gcggngggggggagcccggagccttccgcggtcccccgcccgcccggggcccaacgacgccctactgggcgagcangatttccgaggacagggggtccgggccnttcgctttcgantctcggaggagccgggtccgggggccgacggggctgccctggaggtccaccncccgcaggccctgcanccccagtatggaatgtatgtttggccctgtgctgtggccctggcccagtacctttggtctcacagaagatctctcccaggcaaggccatcttagagattggagctggagtgaccctcccagnaattttggctnccaaatgtggtgcagaaccancactcccccaccgcccnncactccctcnctccctggaaccccccccgcaacnctcccaaacnnntccccccccccctccgcngncngcngnccncccatgggnccatatccctcgggnccccccggccccccccccccnagatatcanccccgcncctgatgtgncctttganccagangnggncgaagncnncccggcgncaagagngnncnggaggcacaagaatcccaaggtccaattgtggtctacttatcaagttaggagtgctgactggtcacttgaagctttactctacaaatgggatatgaaatgtgnccacatnccncntgagncttntgangcagacaaagaagatatagcagaatctacccnnccaggaagncanacagntgaaatgctggncatncccttngcaaaggacagtcnctgaattatacctacaacctgnnctgggacagtatcaatactgatgagcaacctggcacacaaactatgagcagaccacttcagcttgagaatgcagtgggtctgaagatggtcaagtcng

SEQ ID NO: 507566 - DNA, 251 bp, Homo sapiens
gtcacggcttgcaggtctctttcccaggctctgtcgcactgccgcctggcccgtgcactcgtgcatgcgtcgtcctcggcacctccattcgttacttccgtttccccccgacgtcccgcgtgcagctctttctctcgtctcctccatctggcggccgccgcccgggtctcggccaggtctgggcctcccttactacgtacgctgtgaaggacgcactcccggggactcctctacgacgtcgaccctgcagg

SEQ ID NO: 507567 - DNA, 287 bp, Homo sapiens
  misc_feature (113)..(113): n is a, c, g, or t
  misc_feature (169)..(169): n is a, c, g, or t
  misc_feature (204)..(204): n is a, c, g, or t
  misc_feature (260)..(260): n is a, c, g, or t
gctgattctagaggatcccggacattacagccgtactctgagaactcgggtgttaacacaggaccggccgtgattcttacaagccgggggctgggaccagcttcgagtttgcncttgcaattgttgaagccctgaatggcaaggaggtggcaggctcaagtgaaggcancacttgttcttaaagactagagcagcaaactgcancagatcacttagagaaacaggccagttagaatccattctcactgtgttcactctanacaaaacagtggtaggttaatgtgttc

SEQ ID NO: 507568 - DNA, 102 bp, Homo sapiens
aggttttacatttgctgttccttctttcccgactcacttcatagtgtctcagcctggtccaggcttgcatgcaggccacctactcatgcacctaactggaag

SEQ ID NO: 507569 - DNA, 860 bp, Homo sapiens
ggatcacttgaggccaggagttgaaaccagcctggcaacatggtgaaaacctgtctctactaaaaatacaaaaattagccgagcgtggtggtgcgtgcctgtagtcccagctacttaggaggctgaggcatgagaatcacttaaacctgagaggtggaggtgcagttgagccaagatcacgacactgcactccagcctgggcaacggagactctgtctcaaaaaaaaaaaaaaaaaggttgattgaaattttgacttttttaacctagttcccattaattcggcattaatggggggaatccaaaatttgacgggggtaaatttggaaaaccatttttgcatacttggtgggtgtgaaaaaccaatctaattttgggtatacattaaaaacgggtctctgtgagggtggacacggtagtcatctggttctaaactctatacatattagtggtctctagggcagaaataggtataacttcccaatgggggacttctaatttcataggacatgtaacgctgaaggtactctaaaagagcagatgctttcagaaccctttcagaagagggtccgggcccaccaggcccggaattaacctctcacaggtgtaatttcggggggcccactactgcgccaagaatcctaatagttggcacaggccttcagacagatgggctcacatatgtgttcctataccatggtttacccactggaggcgtgaacatttcgggtaaacaaaacttttacactttcaagaaccattcctgagagaacactctttaacaatcccttcaatagtgcctggggccgtagtgactcggtactaactactcctattaggtccgagataaaccagaggatag

SEQ ID NO: 507570 - DNA, 178 bp, Homo sapiens
taaaaaccttattttcatcagttataacaaatgtaccactctggtggtgaatgttgctaaggagggaagctatacatgtgtggggaaaggagatgtgtgagcaatttctgtaccttctactcaatcttctgtgagactaaaattgctgtaaaaaataaagttcatttttttaaaaacc

SEQ ID NO: 507571 - DNA, 212 bp, Homo sapiens
gtgatagcttgagctcgggggtttgagactagacctggttaacatagaccccatctctactagaaatacaaaaccaggcgtggtggtgtgcacctgttgtctcagctacttgggaggctgagttgggaggatgacttagcctggtaggttgaggctgctgtgagccgagatcgtaccagtgtactccagcctagaagacagtgagatcctgt

SEQ ID NO: 507572 - DNA, 771 bp, Homo sapiens
gacactgtgtcttctgcttttaggggcgcagcctctgtggccctgtgacctgccccctggaagcctattaaatggtgactgttgacatttagggatgtggccatagaattctctctggaggagtgtgcagtgacctggacactgcagcagaagcaatttatagtaggaatgtgtatgttagagaatcgtagcagagaacctgtggctctcctgggttattgcatgtcgtctaaggccgatgactcgtcatcatcgtgtcatattggacagaaatacaataaatgaatagagaagataaataacaaagaagaaagaaatataaaataaagagagaataaacaaacaaaagtgcaacagtttacaaagtcgtctggggtagaaattgaagcaagacaacgtgcgacgtacccgagggctccggcaaaaaaccggtacagcgaacgacttgtctacgaaccatgatgtgttctccttgcgcgttcgaagctcaccggaattccggtgttgaaagactcttacacacgatgacgctgacggcccgattgatgtcctgcatgtctcattgtgttcaacggccagccacactggctatgaaacgggacgatctggcgacatgctttggacgtcttctattgctaaacccacccttgatctacagaagcgatctctgcaccagattactggcttcgcagggacgatccctttccggcaaagacttttctctctactctggcctatagttgaagttaccgttatagcatgatgaaagtg

SEQ ID NO: 507573 - DNA, 443 bp, Homo sapiens
  misc_feature (5)..(5): n is a, c, g, or t
  misc_feature (122)..(122): n is a, c, g, or t
  misc_feature (241)..(241): n is a, c, g, or t
  misc_feature (284)..(284): n is a, c, g, or t
  misc_feature (346)..(346): n is a, c, g, or t
  misc_feature (386)..(386): n is a, c, g, or t
  misc_feature (416)..(416): n is a, c, g, or t
gacgngtgggaagaaggtggtgtcttcgcctgggtatcaaatactctggggccgagatggggatttgcagcgatctcatttggctatctgcaaatcgccattggttttattccgatgctctntttcgtgttaggggcactctcctacatcctgaaatggccagcgctgaatgaagaccccattaccaaaactattgcagcactcatcattctttgggcgctggcattaacgcattttggtngcacgaaatacacggcgcgaattgctaaagttggcttcttcgncggtatcctgttacctgcatttattttgatcgcattagcgctgatttatctgcactccggtncgcccgtttgctatccgaaatggattccgaagaccttgtntccccggacttgttgttaaaagtggggcancctgggtaagtattttgtttggccttc

SEQ ID NO: 507574 - DNA, 606 bp, Homo sapiens
  misc_feature (45)..(45): n is a, c, g, or t
gggcgcaaggcggacatgggcggcgcagttgtgtgggtccagganttttataacgtcactttggccctggacttgagtttcccccctacaggaaaatttttggggggcgaggaaagcggggtggagtttgggatgcagaacatgggttttcatcgaagcccccaccgggctatgcaggtggtttgagctcggcctatgggggcctcccaagccccggcctcagatacagcctggggtccaattttggttttgggggggggtccagttccttcaaccgccccagctcctccagggccgtggttgttaaaaagatcaaaacccgtgatgggaagttggggtttgggtcctttgaggtcctgcccaagtgaacagttgggggggcccctcccagcctaccccttttggggtgccccagagcctgggaagggggccccttttcaggggagccctggggacaggggaccccccttggggtcaggcccttgccctcagcccccttggggggtttttttcctgggggccccccttggccatgcctccaggttcaaaacaattcaattggtttttttttttgggccaaaataaaacctcaggtgggtttgccca

SEQ ID NO: 507575 - DNA, 644 bp, Homo sapiens
gggtctctgacaggctcagctggagagggacgggtgggacgcactgtccttgtgcccttccccctccgcgagcagaagctgactccgcaggagcgagggtcgcagagctgggtgagcggaaatgtccctccgcagagatgaagtcgcagggtccgccccgcggtctgagggagcggaggtcttcctgggggactttcaggtctccacataggtttgtggagccggacttttgaagaatgattcgtgaatccggaatgggtgacagcgtcatcacggtgactttgagttgactagaccatggattcttgagcagtgcaccagagtcaactcgctagtgcatcctcaagacctgaagattactttataggtgccagctcctcgtgcagaagagcgattagaatctggtgcaggaagcagagtgtcatttagtcctgagtccatcctcgaaggaaagttccccagtgttcgcagttgcaggaagatgttgaccctcaaaaggttggattcgcttctggataaacagtggactttatatagtttaatcccttatataaattctcctatagtaatctcagagagtatgctagagttctcaatgcttgtagtgttgctgaagagcaggaaggacttgtgtggaagtggga

SEQ ID NO: 507576 - DNA, 112 bp, Homo sapiens
ccagggctcaatctctgggggctgaggagcagcaggaggggggagggaagggagccaagggattggacatcttgtcatttttttcctttgaataaatgtcactttttgaggc

SEQ ID NO: 507577 - DNA, 311 bp, Homo sapiens
cgacggactccccctaggtggaaacgcgacgtaagacaacggtacacgtaaccgacaggtctgtacccaaacagtgtacgtacttatccttcggacaccttgaagcgcaatctttatgcactcggactgacacctaattggataatttatgtcaatttatatggatacaccttcgcgggttttctttagattagagacattgcaaacaaagaaagattcaggcataccattcactgtggccgccaagtctaaacaccagatgcagataaatcctcacctctgggtttggttgcatccgcatccccaaatcc

SEQ ID NO: 507578 - DNA, 665 bp, Homo sapiens
  misc_feature (189)..(189): n is a, c, g, or t
tccaaatttggaaatatggtacaacggagtctgtgtttgccagaaaaggccctccattcatcccggggttattcgagccggggcaattggcaggcagctttatcaagcagcttggcaacattcgggtattgcagctatatgctctgtagtatagaacagacgttccggagcatgacagacaggatgtcntcaggcaatgtcatatcagtacattctcaagaatgtctgctcattgtcatgcaaaccagtgcgcatcgcaacaactggaggtctatccatgagtatcagatcctggctgcaagctctgtgctgcaagaagcgttcatttctctcaggatgatgatatgcgcagcagtcatccgtttcaccaaagggttcgagaacagatgcgctgatgcataacgtgtttccattaggggtatccagtaacctgcctgaatcttcacctacatgatcttcatatggtccatgctcaagacacggacctaaggcatgcaacggcaagactgcgctatagtactctcccagatctttgaaccatatgagcatcgtcactagtgtgggcatatcggcgaggcacgccctgggaataagtcaagctaaagagagacagcaggcgaatagacgttagcagattcagtgtgcccaaggggtatgcatttgac

SEQ ID NO: 507579 - DNA, 149 bp, Homo sapiens
cctgatacgacctttactgtgtttcccaggctgcacttgactcctggacttaaaactatccaccagcctcattctcccaaggtgctgggattacaggtgtgagctaccactagtggccttttgtaagaggaaatttggatatacagaga

SEQ ID NO: 507580 - DNA, 237 bp, Homo sapiens
acgttacagcaacagtgctcctctacaggggtatgaagcaccgccaggtcctttgagttccaaacatgtggctcgtaatgttctggcgagcagattgtagcttgactttaacttgttgagcgtttataggactaagccatatgtgggtgtatcggtgaatccctctatcagtcccacctgcagggcattgcaatgccttggcatctggcctgtctgttctatcaatcagtcgtgact

SEQ ID NO: 507581 - DNA, 162 bp, Homo sapiens
gggagcagcacttgggagagctctaccactgttggcctcttgcaggaaggtcctagtgggttgactggagtaggatggggatggggagttgggtgtgggttgggaaaaaggggatgaaacaagctctgagccatgaaagcattctttcttaaattccaagaa

SEQ ID NO: 507582 - DNA, 179 bp, Homo sapiens
ctccgacgtgcttcatccgacgtggattcagtataatcatagaaataaaatagaaacattgtaacgtgcagcagggcagtcaacttttcattctcatgagtttctcttgaatgtgtaccatttattagccagttcttcagaattctgccagtttcagatgtcaacccagcattggacag

SEQ ID NO: 507583 - DNA, 288 bp, Homo sapiens
  misc_feature (174)..(174): n is a, c, g, or t
cagccaattttttttaaacgagacatggtcttgctatgtggcccaggtgggtcttgaactcctggcctcaggagatccccccaaccttggcctccaaggggctgggattacaggcatgagccaccgcgcctggcctcaagtaagtttttataccagtgataggggaaaacctgnaaggctaagagatgtgcggttttccttcatgggaccccattttccacagtaaccgaggggtataatcatttattacgtggtatgccatttttgccttagacaacatgggtctgg

SEQ ID NO: 507584 - DNA, 355 bp, Homo sapiens
  misc_feature (36)..(36): n is a, c, g, or t
agctatccaaggcacaagtacagaatatatatgttntcaagcagtcagtactcttattgttcacttaagaaaactcagctgagatgttgatggaatacctggggcacagtaattgcttatacccaacttagtagaaatgcatcacctgttcttcttccgaagtctgttctgcacttaaagaggcactaggttcttttaaggatttcatgcaggcaccagcatacagagttccacatggggaatctttgaccgggtaccatatatttgcaagccgggaggaaagtctaaaaacatgtttggtcctaatatgagtctttctgtgagaaggacatttcttactagggataatttcttt

SEQ ID NO: 507585 - DNA, 1292 bp, Homo sapiens
cgacgacgacgacgacgacgacgatgacgacgacgacgacgacgactacgactgacgacgacgacgacgacgacgacgacgacgactacgactacgacgacgacgactgacgacgatgacactgataactatcgtatccgagaactgcgacgacagcctagactgcgtactacatctacgactacacatcgtctctgttctgattatgatggtaatacccatagaccaactgtagtagagtgagcaatacaccacattaatatgtcagatcaaagcacttctctcttccacagcacgattagtgatgtggagttactacgtataacgtcctcatcacactataccaacaagctctctgattgattgactgcgttcgcactgatactgatgtcgtacatccagctatacagcagaacgtattacgtagatacatgggacgtccttaggatgtagtcactcgatcgaggcgcacatcgtacgtcgacaaggctacacgaatacattgagtatcgttcatcgtgaggctctgaacgtggtatccgtctgcgaagataccgatgacatagtcgctgatgaaggctacctgtgtttgttggcacgatcgatctgggctgtaccctgtaggcttatacttcaataacgaattacgcacgatctcatgatttattacataatcatagactatgtttcaattctgattgatattaacggctgtaatcgatgcaaatggcaatagtgtgcgtcgacgcagtgtacggtatggatgaccaccacaacatcccggatgatgctgtacgattgcttagagctaactggctaccgctcattctacacgtgcatcctgtattatgctcataccgaatcaagcaggatgaggagccagcgcacacagtatagcactcacatcactgtaagcatataaatacctaagatcatgtctttggattatctgactacagataatgagacatagaatgaccagagtagacaccagctaacgcgacgaagcagctcactatcggagactcacgaccacgattgtatagcttgatcaacgaaaggctgaatgtgatagactagcttaattcatcgccttagagtgataatacacatcgcgtcctcacatcttaactgagtgtacgttgcattgagtaacacgtgcattcttgcagccccagtgcaagtagagatagttatcaattgataacatgatattggtctgctgagaagaacgaagaatcaatgcatttattatgccccaattgtttataggcatcacatgtcggtctttc

SEQ ID NO: 507586 - DNA, 455 bp, Homo sapiens
ggtatagacggaccggggtccaacactaatgcagtgctcacgccaaacgggaaatgatcaaaccggaagaagtacactggcggactatgaggagtggcatcaggattataggaactgcagggaaacaactatgtatctcataatggggctagaaaattttcgaagacgaaagttatactacgattcctggctgttcctcatctgtgcttactcagaataacaaacgaactctcgtcctaacggcttataccgaggacatgactgaagaattgatatcactttatagaagacgaactgttggctaaaattaacatgacgcaagccgcaggacactcttcgaatctggagaggatcgagaagtacaacaatggtttgattatactgaatgacgttacttgtcccattttggccattattactggtggactgaaatggaagacaaggatatactagct

SEQ ID NO: 507587 - DNA, 409 bp, Homo sapiens
tgagacctggttatctgaagactcaagatctgggctacgtgttgaaaaaatgtccagtgaggctcacttatgtctgtaacgatgggaaaaccatacaagaacatggttctactaataaggattagaggtcatcaatgattcatcatttaagacatggttaagtccttactgagcaacgcatttaaacacttaatttaaaaatgagcagcaagagtatgaccacaattcagattgctgacttgatggcagaacagttccgcagtgcatgctggtttgggcaaactaataaaaattttcgaagatataccaacgcttgaagacctgggtgaaactcttaaaaaagcacagttaaaacgtaaaggagcagccctattaagaaagaggaagaaggaagtggatgctacttcac

SEQ ID NO: 507588 - DNA, 559 bp, Homo sapiens
gtgtgattagaaataaaattaaagatggcccagttagatcggaatttcagataaacaataggttttttatatttaacatggaatagtgggaaaatacttatacggaaaaatggttggttggaaatccaaatttaatggggagtctggtatttaatcgggcaatcctaaaatacatgggtatgaaacaaatcactttaagaggtatatggctatttggatggggtggttttggtgtgtagaaacgtacaataccaactcaagggcacaggagattcctaaacatggtgaaacgtggagtagatcatatattaatcctcatattactttcactattactaaaggtgcggatccagcacatttagtagagatagttatatgggctatataacacacgtaacggggggtcgggaaagttcctccattcattggatttcctttagaaggcgatttccagggtgtgcaatttatccatgaccacatacacggatccacggacctagataaggtcaagtctctcaggtaacggttaaatttggaggtcggcttaaaaaatacttca

SEQ ID NO: 507589 - DNA, 404 bp, Homo sapiens
  misc_feature (404)..(404): n is a, c, g, or t
gcacgagggattaataaatattataatccaatgtaaaagtcattacatttgccataatgtaatgattcagttcttgttcaataactaaattgctatgtatatatattatatatatataaaatatatatataaaatatatatataaaatatatatataaaatatatatatataatatatatataatatatatataaaatatatatatataatataatatatatataatatatatataaaatatatatataatatatatataaaatatatatataatatatatataatatattatatatatatatttgtatttgtttattttttcactcacaggtcaaccatgaactatattcttatttgttattttttatttcctgctttgggcatagaagatgagttatctttn

SEQ ID NO: 507590 - DNA, 553 bp, Homo sapiens
aacggtcatggctggggaagcgtggcaaggtcaccaagtctgcccagaaagctcagaaggctaaatgaatagtattaagtttcccgcccacccggtttttacaaaccaaaagtttaaagcctgccaccccactcttaatcagtggtggaagaacggtctcagaactgtttgtttccaacgttcttgggagagccccaaacatttggtttcgttttaaaaagaaaaggggctttaggttaagctaaacacaggaccctggggtctacaggtgtataacaatgcagtcgtaaaaccttcagaaggaaaggagaatgtgtagtggaccactgtggttatctttttagcgatgatggccacaagggggtatagtgtttaaagaaggggaggttttgttgaaacagttttagttttgtaaaaaaagggggaatgtagtggtgtttacaaagacaaagaagttcgaaggcttacctctagtagtacatgggagagacgaagcttgcacgcaaagaattgtgtcacaggaattttgaggaccattaaaaaagttaaatga

SEQ ID NO: 507591 - DNA, 360 bp, Homo sapiens
gcaaacaagcagatggtgaacaacagatctaaagatggactggggaagccgagaaagggagctggagtctgagctctgggagtgggtcgggacctcgtgacattactccatctgctaccccacgcttccttaggctccagcctctggctagcttgagaggaaggacgatggtcaaggtacatgtctcttctcctctgactctgggcacatgcagcatttttctactccccacaggcttgaacgtctccattcatcaggcagtgtctccacatgccaaaatcagaggaagtccgcaataaaacctcccaaggctgaaaactagagctggcacgtagtccatggtcagtaaatgttttcagg

SEQ ID NO: 507592 - DNA, 249 bp, Homo sapiens
tgcagctcatcatgaggcctattatgcctctaaatttctcttaactttgtcacgtctttccatctcactatttgctaatttaggcttctatcgacgtcttttctgttgtgttttagtttagagacagggtctcactcgctctgttgcccgggctgagtgcagtggtgcaatcatggcccactgaagcccctatcttccggactcaagcaatcctcccacctcaggctcccgagcagcgagggaaagaca

SEQ ID NO: 507593 - DNA, 856 bp, Homo sapiens
tgttcgtttccgggtcccggacagtccctgggccccaaccggtccctggcttccgatcttgggcccatgtttccgcgcgccgtgtcccctctgggcaccctccgcttgcaccttgttttggacccccccgttggccagtgtggccacagcaccaccgcggggcttgtttcttggcattgacccgtgttcccttcttgtcgcccaacccagggcactggtccgccgggctgacgcgaccctgtccggttcgtcgactgtgtacctcaggagagccaccctttctcccccggaccacacacaatttacgaatcctacaacattgggtcccccccccaagattgatcccctccactcatgttgcccacaagcatttttcctcgctgcagcattaactattgaactcatacacctcttttttctgcggtaaaaggccactctcccctcacgtaatcatagatactccggcacactctctgtctaaaatctaggagattacatacaaccccacacacgactatactcccctcttttggatcctccaaacagttccacctctccaacattatctgcttccctgggaatttctctcttcactattataaccacagcgggtatatttctcttctaaaagatctttatacaaaattacttttatttcaaaaatcaacacgcaatttttatttattatcgcttcctcgatgaattctcatggcgtcaacaatgtgacccttctttagtgttacgccaccaccacaacggtccccctttcttctctaggaaaagaagacacgaacatgctcttttcgtgtcgacaaaaattgggtaacaatattccccccatttcttcaccaaaaca

SEQ ID NO: 507594 - DNA, 934 bp, Homo sapiens
gactatcagtccattggcagtaccgtgttgtggggcggataatctaagctgcgagttcacaccatttgctgtatctgaaagctgtgtcgattgcttgttcggaggagccacatctcatttctgtgtgcaatgtgtcttggaatgggtatcgggtaccttgcaacactgacattagccataggtctgatatcccacgcatttgctaagcacaaaattactctaacagattagtcaatcaaagacagacctctttcaagacagatggcaaggctggctacacttcacatttcgggcgtataagagtttaaatgggtttgtgggacccccacaagatgccaatatccaccatgctgccaacgcatggcagatgtctttaggggatcgacaagatgccacgtctttcttcaaacccatgtttggcactattcgacaattctacagaatattaatcgacaccaattatattggggagaaatataacaatgttgttgatggcaaaaaaattttgaaacacgcaattaaatttcgcaaaatatatgtaaaatcaattaggcgttgtaatggacatttgcacttaaattttggtggcgaataattgcaaaagagcaactgttcaactttgtgtgaccattttggcacatgtagagtatgggcacaactttcccctctccacaggcccatcgtttgtgacaccccacggactacaggacaacattctgccacaaaagatctgcccaagcgcagcaccacctgttgccccgcaccaccggcagatcgcgctgctccctacaaaaattaccacctaagatgtcaaccttctaccacactgtggccacaagtttgccctcggccaacacttctttggcgcaacaaacggccaataactgcgctatacattggaacagcaatgggggcacaaggctccatatacagc

SEQ ID NO: 507595 - DNA, 108 bp, Homo sapiens
gcatatggcaaggtcagtacctgcgtaggggcacaactccataggtagctttttctatttctacgttgtccgctgctttacacaactccttggccttgccatatgcaa

SEQ ID NO: 507596 - DNA, 515 bp, Homo sapiens
  misc_feature (106)..(106): n is a, c, g, or t
tatatatatgtcattaacatgaaggattttgtccatgagcttaatgttattattgccaacgtattaattcatgggacttcccaggaagtcttgtaacactgtgacncaggtcttatgggtaagacactaaaagtgagaacaaaattatggaaacaaaggttggaattattctttttagtcctgcctttagcttattagataacacactctcccaatgatatcttaatattttaattcatatttatttttgttggaccaattagcatattaaattttatgaaaagctttaatccaagatatagaaagaaacagaaaattatgtgaatcgtccagataagtgagggtgttataacctagggagactttgagaagtactggcctttttattgaccacattatttggctctaatgcaataatgctagaaataaataacaaaaaataactagaatgacatctacagaagaaagtaaaaccatagtacaaagaactcatgggtcatagaataaagtccagc

SEQ ID NO: 507597 - DNA, 349 bp, Homo sapiens
taattgaatttcgctgctaaaaatacaaaaattagccaggcatggtggcacatgcctataatcccagctactcggaggctgaggcgggagaatcgcttgaaaccgggaggcagaggttgtggtgagccgagatcacaccattgcattccagccagggcaacaagagcgaaactccatctcaaaaaaaaaaaaaaaaggaaaaaaattggggggcttaaaaaaacattttattgaagcccaggagggggggctaatgcctgaaaccccaacattttgggagcccaggggggggggatcatttgaaataaagagttcgatcccaccttggccaacatgaggaaatctcgtt

SEQ ID NO: 507598 - DNA, 227 bp, Homo sapiens
ccctgctgtacatagtattgatagatattgatagtaactgattcaggcttgggagcgcactaaagtgctgcagctccttatctttgctgcttgttatagctgtagctagagccatagcacaggaagttagtcagttatgagtcagcacagctgggtgccattaccattttaacgatcaacactcatgttcagccgggggtaccgagcctctgaaattccgtctcgtg

SEQ ID NO: 507599 - DNA, 95 bp, Homo sapiens
ctttcttcttggtggcttttcatttccgggtgttctttccggcaggctaggtgtcgtgaccggagtggccgagtagacggcagtggagaatgcac

SEQ ID NO: 507600 - DNA, 103 bp, Homo sapiens
cggctggtacgcccccggagttacgggatggcgtagtacggactgggcctggcctggggcgtccccgcgaagcctgggcctgtcaggcggttccgtccgtgtc

SEQ ID NO: 507601 - DNA, 158 bp, Homo sapiens
tgtactctaacattgtattttttatagtagcacccagaggtgtggggttctcgacgtaagtctatcttggttccaaaatttgtaataattgaagcacctgaggactcagtctccctgtcttccctttcccatctatttctattccttttggtgatctc

SEQ ID NO: 507602 - DNA, 493 bp, Homo sapiens
gcgtcgacattcatgagccgtgtcctggtgtgggattgctctttgtgtgatacactttctcagtaaggtaggctcactgtggcagaaagcgggattaccgtgggagatatattgagaatcaccaagaggccggtcatggtggctcactcctataatcccagtgctttgggaagctgaggtgaggtggattgcttgagcccaggagttcaagaccagcctgggcaacatggcaaaaccctgcctctacaaaaaatgcaaaaattagccgggtatggtgatgcacacccgtagacccagctattgggggtgctgaggtgggaggatggcttcagcccaggaggttgacactgcagtgagccctgatcatgccactgcactccagcctgggtgacagagtgagaccctgtctcaaaaaaacaaaaagacagaatcactgagaaagcaaaacataaggtttaaaacctttaaaaggcaagaaaacctaggtttgcat

SEQ ID NO: 507603 - DNA, 857 bp, Homo sapiens
gaccctgaggacttgaaattgtgtccagaactggtgggttcttggtctcactcacttcaagaatgaagccgcgaccctcgcagtgagtgttacagttcttaaaggcggcgtgtccggagttgggtgtgcttctgatgtccagatgtgtccggagtttttcccttctggtgggtccgtggtctcgctggctcaggagtaaagctgcagaccttcgcgtattacggatcagtattgtttcaacactgaataattgaattctgaaaggcagtatgtggtatgaccaaaaagcaagactttgtcttgctttcatcagtgcatggacatttgagctctttcaaccttttgtggctatgatgaacatgtttgaatgctatgaacattttatgcacaagttctgttatggagaagaaaataagacacacaggaggaaatgaatatttccataaggaataactactaacaggatgtgagagaatcaatgatcatgtgtccagaaggtgggttattgctcatggctcagaacaacaacaccttgaggaatgtttcctctgtcatgccatatacctgatggcggacggagcagttgtaccagtattggaaaaatgcttcctgatattgattgtccccggtttgaactgatccaactgatcagttccccaggtgctggtaattcttatatatcctgtttcacctccaagttaacctatgacggcaaattggtatatgttacacggctacaggtgttgggccaggatattggggaggggaaagagcaacggtggccactccactcttcacactcgctctttggcggtcacacggacacacttctgggacaggaaagcgtctggcgtcaa

SEQ ID NO: 507604 - DNA, 123 bp, Homo sapiens
tctatatatgcttggttaatttttcatctttcccttcggactatatctatgcgcaggttcaattctatcgctatacttatttgggtaatggttagctaaggtgtctgagatacaaaatgccat

SEQ ID NO: 507605 - DNA, 225 bp, Homo sapiens
aaggcggcgtcaggtcggaaccggtctaggcgactgaggttctgcccctaatccccctcaagggcatccgtcactcaggtgtgtaccacacacccgactccggggttagcgtcgatagtcgcggcttgccccgtcacaccctcgacgaccccacagtgcagggaacacaccacctgggggtgatcgcgggccaggtcgaggaagggacagtggcgcagcacgatg

SEQ ID NO: 507606 - DNA, 572 bp, Homo sapiens
tgtttagaatcagaagcagttctgatttaggcaaggcttgtatagacaccaaagaaagacttgcttttctttacccctatcttggtgtacttgctctgtgttagcttcattttcagttacactttctctgagtgggagcaacagtggccattgatggtttcaggctttcattattttcaaagtaaatgattccaaggaaaatccttcatccttctaaaatccttcatcatcgtaaaatataaatatgattatttctctgtttttcttaattctattcagtggttcctcacccccttcaggataaagttcaaattctgtggcaagcaagaattcatgaattcttgatttggcttttacatattttcattgtcctgttgctctctgctttaaaatttgtatccataaataccaagttgcatgtgcagtttcctctgcctgcagtggcttttcacattgtttacttgccaaattcattatcttttagctaaataaaccccagttcagatattactcttccaggaaaatcttatttgataaattttgtgctcaatcccagacaaggtagagccgag

SEQ ID NO: 507607 - DNA, 1455 bp, Homo sapiens
gccggcgcccttccaccccgagccctgactcagccctgcggccacctgcgccccgcccctgtctggcctgctgccctgagcccagctgcctgctgagcctgcatcccctgtgctgtggcttggcatcctgtgcccctgtgaagctgctgagctgttcacgttagctggctgcagttggctcctgtctcctgctgtgacatgagctgctgctgcccccctgtgccctgtgccctgctgatggggtgctccctggctgctggtcccctgatgcagtttccctgccggggtgtgagctgggcctgatgccctgtgctgggagtgaccatgcccctgctggcctgctccaaatgtcctgtggatgatcggactttgttttgatgccccgggagagcgccagaaaggcttgtgctgggaatgcccagggctacgcattgcaaacaccgtgtgcgggccctggctgctggcagtgctctgcagaagatccctgcaattgacacggacgccttgggactgcctgtgcatgcaacacccgcgaccgctgtcgaaacgaacgaaggagccgaaggaaacgacacgacttttttaccctaggaacaaaacgtgctggtccttccgtaaaacaatttcgccctggtgtggccctgttcctagacacgaccaactggcttggcgcccttcatcctggagggctggggagaacctatacccatacctcgggaacggcagttgcacggaaggtggagacacaccctcccattctttcccaattccgagcaacctgatgtgccattcccgattacatgcggggcaaagttcaacagggaccttccttcctacgccacgacagtttggcaatgacggaaaactaaattacgcaagtgcgccgtaagttggggattacccaaaattggacttcaatgattaaagaacagattggaaaaatgaagcaaaagaatttcaattggtaaccccacgagatttcagacgtagccccttaaaagagaggacaaattagtttggctgggaaggctttagtgacagaccacagagctgtggatttgaaagtcattctgtgcagaggaatatataggaagcggagagataacgcacacggacatcttgacaacccgggcatacaaacacgtgccccagcaggaacataacttgcgcagcttccatgttttaggtgcatcttacccgagagtgcccattgaaagcgcatagacaacggaaacgctgtcgataggcacactttggcagtaaaccgaacagtctgagagttacgctaccaatgtgtgcgaagctccaaacgcctctagtattttgcataccagggctcatcaagagtctcaggacggtagtcccagcagcatgcgatgcatacacaaccctcgaggaggaggcacaatacctagtcgttgcgcgtcacagcatactgcggacgcagcaagggaa

SEQ ID NO: 507608 - DNA, 685 bp, Homo sapiens
  misc_feature (156)..(156): n is a, c, g, or t
  misc_feature (167)..(167): n is a, c, g, or t
tgtgttcagtgacttacgtgcttggatttctctatccaattataaaaatcgcccggctgggaacacgagtcgttcttgaacaatctccatgatgtgcatgttctgatggtcattactggtgatctatgcaatcaggtagtccaaggcgagactcgnatattcaaatntacgccctcgccctgagagttatttccacgcgacgtggaaggcaggccgtcagacatgcctgggtccaatttggtaccctgccaggccctccgtacacactacactcgtctctgaggcgttctagtttcgcaccggcgatgaatgatggcctctggaaagagcgttgagccatcttctatccggcgagactggcccgagcgagaaagcgcgtaggagctacagaagcgtctccttgaacgatgctacataccaagccgtggctggccagcgcatctcttccagtgacattcaagaaagccgagctgacagattgagttggggtaaaaaccccaagacgccatgaaaagctgccaatggccctggaagaaataagcttgaacccaggccctatatgcgatccttcatgaccctgaggtacatgacccgcacggaacccccatcttctgtgactttcctgtgagacttcacttcctagaatgagcgacagttgagcttattcaagacgattgggtgacca

SEQ ID NO: 507609 - DNA, 138 bp, Homo sapiens
attatatccggtgccgaggattatagttggttgttgttcttaacggtaaccggcctactgcagaccttgaagtgtaatacttctaggcagactaggtaaacacgtgggtcataccttatttgtcattgaacagatacc

SEQ ID NO: 507610 - DNA, 279 bp, Homo sapiens
taagcatacgatgacagtatgcgacatgaactgaattattaaaactttaaaaagaaaacatatacatagctgaagcagtggtggaaatcttccattctgatagccccatatattcaaatattatttttccaatataaacacatcaattttttggtcactgtgttgatgaatgatgaaggccatgctgcacagtcaactaggtattccttatcttagctccagtgcatcagagaatagatgttagtgttttttttttttttttttttttttaacgtttcc

SEQ ID NO: 507611 - DNA, 444 bp, Homo sapiens
gaccaggagctgaaagctctgcggacagaaacccggttctccgtgcttcaggaggaggctgcctggggccaggtcgaggcactgcaggaggccctcagcagggcccaggctgtgctgcaggaaaaagagcggcatctcctggagcagacagaattgagtcacagtctagaggccagcaccgccaccttgcaggccaccctgaacacctgccagacacacgcccggcagctggaggaggccctgaggacgcgtgaaggtgagatccaggaccagggcctgcgacaccgggaggacatgcagcagctccagcaggcccttgcccggagggacgaagagctgaggcttcagaaggagcaagggcagctgctggagaagcttctggcccagagggaccaagaggacgtgctccaagagaggcagaatccggggcagcaaaaaaaagag

SEQ ID NO: 507612 - DNA, 166 bp, Homo sapiens
ctccagaatcatttatacgtggctggcatctgcttcactgtagtactctcatggccacaatgtcttcgaacatcttcccgccggttaccaggtcaaatcatcgaggtatctgtaaacccatctatacacataagtagctgctcactggtgacgcactatttatagg

SEQ ID NO: 507613 - DNA, 897 bp, Homo sapiens
aaaaaaaataaacacaacatcttttctgtccctaaggagtactgacgtagctgaagaaagaagaggggaaaaacaccacaaaaaatgtaaagaatgaagcaacaatataaggaatgtcacaagacagaccatgatcatttgctaaatgagtggaatggaaaataagtacagtgagttgagaggcaggagcaatcacctagaatctgatagtcttgctgaagtgccataggagtgatcacggttcactgcagcctcagcctccttggatcaagtgattctcctgtcgcagcctctcaagtatctgagaccacagggtacaacagtcccagccccgcccatcacacccacaacccttatgtacgcccaagggtgcctggcatgcaagattctaagagcaatgggttgcaagtccctttgacaaagtttgcctggggaccaggaaatttaaatctacatccgaggaccaaagatatttaaattaaaaacttcctaccaaatccaacagcagctaagagagtggcgaatgcgatattacagaaatcggtctgcagcctccaaatgccaaagtggcagcttgttatttatgataacgataaggagcagctcgttactaaagatatccatgtcaaccccacgcattgagcagaacaaaggatcgttaatgattcctgggcttgtcatgtcagaatggggtggcgatgataaaagagcatctatatatgctttccttgtgacatttcttatttttaaactcccatataaacaatatgtgttcaatgtcatgatttgtgtcacatgctatgctcccaggctggaccaggaaacagtgtccccattctaagtattttataactaaagcaataaacaaccaataaccaatgaccaagagaagagaaa

SEQ ID NO: 507614 - DNA, 966 bp, Homo sapiens
gctgtggctaaggaggggagaacctctgctccccgcccgtcttctcttctgctgtttcccgtggctagggtggcgtgggtgagtggttttagtgcgtgcgaagccgctcggcagcaccttccttctttgccagtgcagacgcccgttgtagccgttggggaacctgttgagaatcctgtcatggagcctagagatgggaatggtgacctgatgagacaccccatggaatggtcatgtggaaatgcatgtgcatggcccacaaagtaatgctaggtctgtgggcaggctgatggctgattgaatagcctgtgttgtggattctcagagcgacgatgtcagtccctgatggcgcagagaagagccgcgcttaatcgtacgcatatattaattatacttgagcaacgtgtcgaatgtacaccacattgacacagactgttgtgcaagtatgcttgacaggtattgcgagtatcttggagcagaattcgcaaatgattcgcaaatacccgagactgtgtgcgcagacgttatttcgatcagaaagccagccgtaaagcatacgatagatgggtactgttgttactagcagggtgacatgcatgttcagtcgtaccacatatttaacacgtgattcatatattgagagctttgcgagtgatctgtcgcagaaacgcgattacagtgaccattaacataacctgcgtatgcgcataccagccaatacgatactgtacatttatcatagacgtgaatagtgagaataaggggcataacatatatcttaggtaggcgtaatagtgatggcatgtgtacgtagttccgtgtccgcagcagtagtagcgcaacggtgtggacacagtgcgcacctattgtaacaccttagtcatttatagttggctaatagttatgatccgcgtccattcgacgacgctttgtcaggtgaaatggagttcctcaatacgagttgca

SEQ ID NO: 507615 - DNA, 875 bp, Homo sapiens
ggtcaataggatcacggaagccagctctctagatgccctacccggattgctcgcagccgttcaggccgtcgaatgcgctggtagcgcagactaaggcggcagcgccgtgaattagttgacgacctagccgggcacaatggatggcgcgtgttctggtagtccggtgcgcgacctcgcgagaggggccacaacatgtcgacggccagatcagttcaccttgctgcgaacggcgctgaattagcacgagcaccgtagttgcgcagccagaccgggatggacgccctgtcctggcatcggtggagctgacattgacgtcgcgcgtagccgtctcgatgcgtccgcgtggggaccgtagcccatggagaagacggtggctcgttccccgactcggtccttggataccgggtcccggcttggctgccggagcgttgcctccgagccttgcagcgcgctctagaccgggtcttccggtctgctggtgcagcttcacctggccgggctgcgtacgtattcgcatgcctgcggtcaggtgtggtccgggcacgtatcccgctggagccgcattggtcccggcgtgctgcgggatgtccgtaggggctgctacggagtctggcacgtggctgcctgtgtcatcgtaactggcttgtcagacggaggacctgggctgcctggtgctggcgcggaattccgcgagctgcggagtgtggcgttgggcggctgcgggcaactgagtcgccgggctgcttggggctttggccgagggcgtgcccacgcctgcagtgcctgtcgtcgcgcactgtgactgggtggacgggtggcgctggcggctcgctgatcgctgccggcctgaggagctgggtctcaccgctgcgcag

SEQ ID NO: 507616 - DNA, 545 bp, Homo sapiens
gttgatgtgactggttctggggctatcatttcaaacttggtctttttctatttgataaataatgattgcatctatttatggggtacaatgcgatggtttgatacatgtatacattgtgaaatgatcaaactaggctaattaatatatctaccacttcacatatttatcatttctttgtggtgagaacatttaaaacctactcttgacagggcgcagtgggtggttcatgcctgtcatcccagcactttgggaggtcagggtgggtggatcacttgaggtcaggaattcgaaatcagtctggccaacatggtgaaaccgcatctccactaaaaatacaaaaattagccgggcgcggtagtgcacacctgtaatcccagttacttgggaagataaggcacaagaatagcttgaactcaggaggtggaggttacatgagccaagattgcaccactgcactccagcctgggtgacagaacaaggctctgtctaaaaaataaaataaaataaaataaaacctactcttttagcaattaaaacatgaaaac

SEQ ID NO: 507617 - DNA, 261 bp, Homo sapiens
  misc_feature (38)..(38): n is a, c, g, or t
  misc_feature (51)..(51): n is a, c, g, or t
gctccttactagttgattatccgatttaataaaaatancaaaacctgatgnagactagggctgattgtagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcat

SEQ ID NO: 507618 - DNA, 408 bp, Homo sapiens
  misc_feature (38)..(38): n is a, c, g, or t
  misc_feature (51)..(51): n is a, c, g, or t
gctccttactagttgattatccgatttaataaaaatancaaaacctgatgnagactagggctgattgtagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatactttcagtattttatgtgagaggttttgttgtcaaaatcaagtctgagagcaatgtttgttgggcctttaattggagtcaccaagtgataaaggggacattgtcctcaacaataaccctataataaacacgttttcgacagtaaag

SEQ ID NO: 507619 - DNA, 201 bp, Homo sapiens
accaagacccttgcttaccaacctccaatgccacctgaggtgtatactacttggggatccgtgcacgttaacgattactaggactatgcagaaaccagagagtttaagaataccgcatggcttggttcgttgttttctttctttctctttttctgttctttatttctttcttcaattctttttcttctacacactcccctt

SEQ ID NO: 507620 - DNA, 279 bp, Homo sapiens
  misc_feature (23)..(23): n is a, c, g, or t
  misc_feature (29)..(29): n is a, c, g, or t
  misc_feature (41)..(41): n is a, c, g, or t
  misc_feature (72)..(72): n is a, c, g, or t
tgggggtttgagatattattatnttaganatttttaatacnctttgaaatgactggcaaactcaggacagangtagggctgatttgagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcat

SEQ ID NO: 507621 - DNA, 550 bp, Homo sapiens
cttaaaatgtcaaaatgaaatattgtctattaaaacagaagaattaaaataaacaagagaagttgggcattggtcatttgatggttgtaacctccagctttcccaggaaaaaaaaaaagacatgaaaaaaaaaaaaaaccttaaatggcccttcgctaagtgaaagaagcctatctgaaaagactacatactgtgagtagggctgattggagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatactttcagtattttatgtgagaggttttgttgtcaaaatcaagtctgagagcaatgtttgttgggcctttaattggagtcaccaagtgataaaggggacattgtcctcaacaataaccctataataaacacgttttcgacagtaaag

SEQ ID NO: 507622 - DNA, 426 bp, Homo sapiens
  misc_feature (23)..(23): n is a, c, g, or t
  misc_feature (29)..(29): n is a, c, g, or t
  misc_feature (41)..(41): n is a, c, g, or t
  misc_feature (72)..(72): n is a, c, g, or t
tgggggtttgagatattattatnttaganatttttaatacnctttgaaatgactggcaaactcaggacagangtagggctgatttgagccattgtacagtgtcgggaacataccaggacactgagaatagtgtcatgtcataaggacccagagcaggtggaccctgctgtgatgcacaaagaggaccacgcaagatatgataaagatctacatcactgaattttggttccatttttgtatctcagcttcccggaaataaaaaagaattctaacattcatactttcagtattttatgtgagaggttttgttgtcaaaatcaagtctgagagcaatgtttgttgggcctttaattggagtcaccaagtgataaaggggacattgtcctcaacaataaccctataataaacacgttttcgacagtaaag

SEQ ID NO: 507623 - DNA, 183 bp, Homo sapiens
ccatcatatgtgtgcgatgtgtcaggtcaccttggcacacctgttacgaacagaaggtttcgtggaagggactgtcagcccagctcaggaaggcactttgttctcagaattccccaggacacggagccaaccagaatccaggtttgacaaacaggaggatcaacctgtggggggaaaatgagt

SEQ ID NO: 507624 - DNA, 132 bp, Homo sapiens
cacgaggacgatggttccacctctggaaacattggcaccctcatcactataccaacagcagctcctccttctagcaccggtgtaaggaaaggctggcacgaatatgtcactcaggaactgaggagccatcta

SEQ ID NO: 507625 - DNA, 557 bp, Homo sapiens
  misc_feature (206)..(206): n is a, c, g, or t
gaaaaccaataaagagttttaatggacaccttttcgctctccagagtcactaatgctattgggaatctgaagaactggctctgttacacttaaaaaaaatttatcgaccaatgaacattagtccagaacagccccagcattgatcaaacttcagttttactggacttttttgtttgcacaaaaagtcccaggacaacttccattgntgagaaaatcctcaaaggactttcccacttggctcctgtgatggatgacagaagagggattcattaaccattgctcaagccccaattttgggataaagggattcaaaagccaggatccagaactaacccagtgaaaaaaatcagtcccccatttggccagtataggtgagaaaacataattataaaaatgatcccatgaaaaattccccagatcagtttagttgtaaagttgtcaaagttaaatgtgaaaccaatgaaaaaaaatttgtagcatgtaaccggttatttctgttttttaaaaagaattgttagggggctattaaacttggatttttttttttattaatccca

SEQ ID NO: 507626 - DNA, 1291 bp, Homo sapiens
gcccatagtttgtcgggtacccgtgatctgaggacccgctttgtaagggacatgctggcgcttcgtcctcccaaactcgcgtacgcgcacgtactgactatgacatgcacttctcgcactaccatcgttacgagccgaagctgtctgtacctagcactcggggatgcccgtgcgtgcgatcctctagcctgggcgtgggaacaccggcagtccgagcgcccgatgtgctcacgtatagcccaacgctgcacaaaggaaccactctgcgggtcgcagcgatcatcgacgttcgcctctcaagcaaccttatctatcaggtgaacgtacaggagcggctgggcataagacaaccgtgcacgcatttggagacttgtggtatgtctgtctagacacgtctctgcgcataaacgcgtatctaagtctatgttcgcatatggatacgtttacacgtcaaccttgtgcgaccctgacgcaggcggcatagtctgcggtttctctacacacgtagacatgctaaggctccaatatctaacctaaggtgctattatgggcaccgagaacttgccttctgactcgaaagtgaaagcatgaagtggacaccccagtaaggcgtggcaaggcataaaccaatctgcaattgtagagggccaataggcggaaggagaattcccaaattatcggagaccgcggtatggggtcgctttgacggagtacctcctgccacatttttcccaggcggaaattgacctttcgagtgtatgaaaaccccaaagggtagacctaggcccggggagatatgcaattattcgcagcggggagccatttatccgttgggggcgtttgtaataattcgcacaagacaaaggcggtaatgatgcgggcttgggccgagttgtgtgacccaccttttgtggggtttaccatagaggcggaatattcggacggcaattcctccccagtggtcctatacctgatagggatggagaaccaggattcttttccgttacaagactctctggcagattgtgccatacggtgcggagacgacggcaacaaattcttccggagcccggccttcaggagggaggttggccgtgctccgaaatgttatacaacaccacctgagggaggcgaaacacccacccctattgatgagagttctattcgcgcagaactgaagggaggctcagggtgcagctcgcgaattagaaaggccccccgtttacacagaagaggcgttacactaatgcgcccgttcgaaaacccggaacgcgtctgaggccacgccgaa

SEQ ID NO: 507627 - DNA, 82 bp, Homo sapiens
gcggccgcctactactactactgctcgaattcaagcttctaacgatgtacggggacatgtttttctattaaaaatagacagc

SEQ ID NO: 507628 - DNA, 756 bp, Homo sapiens
gtgtacggtgtggaacgctgcatccggctctgcgagtccggtcgagagaggacgttaacccacttacagccgtcaacatgtccccagcgtcagcatcttactagcggaggaccgcttccagaaccgagctgtgtccactcactgcttcagaggacatattgcagtgacagcacaaggatcgttccgttcagcccaaggaagtcagcgccgctggcgcccaaccagagagcgcaattcgttggctaggaacattaggcacgcacgatgcgtgagacacgtctcaggtgttgatacgaccgcgacctaaccacacaatttcttaaaaattgcccataggaacgtgccaacggccagggcagacccaagaccgtgcgtattttggaagcgtggccccagacattttgcacgtgagcagcaacacgtcaagcgactatgcgcctatggaatgtgtacacgcacacggctatgacgttacgaaggcccagaaatgtaccttcggatacctggcttggccaaacgccaacatttccaaaacaaaaaaattattccgccccatagtggccttgcacgagacattccccccttatggacacacaaacccttatcctctggcgcacaccacacgcaaacttccacattggaaaaccttggttccactttctgcgaaggaaacgcctttactttcggactcggaacccgaagggtccccaatcagaaacaccaaaccaaatttcgcattcccattcatggctgagg

SEQ ID NO: 507629 - DNA, 201 bp, Homo sapiens
catcattattccaaccattcaaaacagcaagtgcagctcatccaagcccatgcaccagcacatggggtgggccaggccatggtggctccaccctgtcaatccgcagcactttgggcaggctagcaggtgggacggatccctatgcagtgtccaggcagttcgcagcacgcagcctggtgcaacatcagtgcagcaccccat

SEQ ID NO: 507630 - DNA, 178 bp, Homo sapiens
catcattgaagtgtgcagtcatgtgcacgcagaagtctggtgtgctcacaggtctgagtcacaccacatctacttgaggcacttgctgaagcccaacatggtcaccccaggccatgtttgcctcaagcaagttttctccatgaggcagattgccatttgtgccagcgggggttcccgc

SEQ ID NO: 507631 - DNA, 272 bp, Homo sapiens
tggtgagctattttttggcaagagcaaaggagacattaaactgaagtgaactaccatgtcgtacatgctgaatccatgcagaacactgtggcgaaggctgatacctgacatcattgatttttgtatactgacttggtttttgatgaagcagttctgttatagccagatgctttttcaatacgtgctagacagaggaaaaatgggctgtaaataaatgaaagctcgatcagcaatttcaggatgggaacctggatttgaaaaaaactgtatca

SEQ ID NO: 507632 - DNA, 297 bp, Homo sapiens
agaggatccctctacagactgcgccgaaggggcatacaaatcttcgatgtggctgtcttgaggccatttcctacccgtgcacatttctgctttcacggccaaatacgcttgcgtagcagaagaacccacctgcgaccacacatcccaccgagctcaggttgagggtctcggtagccctgtacccgccatccgccgatgaccacacatcccaccgggctcaggttgagggtctcggtagcccctgtccccgccatcctgccgatgaccacacatcccacctggcgcagtcttgtgagg

SEQ ID NO: 507633 - DNA, 109 bp, Homo sapiens
gatagcagaggtaagtagtttgggattcagcgtcatctatagcagacacgaggtgtgggcagtgccactgttcctggagggaggtagaaattggctgttacttggaagc

SEQ ID NO: 507634 - DNA, 110 bp, Homo sapiens
agctttttctccgtagtatgcgagttgacaaaacagccagagaacagggcttcccatttaccaatccttttcggggatcttttccctttgctaaccggatcttaatttgt

SEQ ID NO: 507635 - DNA, 300 bp, Homo sapiens
tactactactactttgtgcgcggccggtgcgactctcccctgtacccatctatttactagataactctgaggcaggccaggcgtggtggctcacacctgtaatcccagctctttgggaggccgaggtgggcggatcatgaggtcaggagttcgagaccagcctggccaacatagtgaaacccccgtctctactaaaaatccgaaaaattagctgggcgtggtggtgggtgcctgtaatcccagctactcgggaggctgaggcaggagaattgcttgaacccgggaggcagaggttgcggt

SEQ ID NO: 507636 - DNA, 551 bp, Homo sapiens
cactagaggatcccacaggtggatgctgtgggaggcagagctacatagctcatgctcaggttctttgtcaagtccctggccaacaagacctccgactggctaggctaattgagcttactcattatcccgttcggttctcaccctgtggccaaatacttggggtcagtcaacagtaaatacagtagttccttcctggattctggttggagagatctgttcagtcgctcggagccacctgtgtcagagcaactggccgtggtatggaaggtgatgcagtacgtcaacggggcagccacgacacaccagcttcccgtggcctgaagccatgctgacttgccggcatatgttacctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctccctcctccccatctatgagca

SEQ ID NO: 507637 - DNA, 476 bp, Homo sapiens
cccaacagtgagtcatcaaggtcactggtgcttaaacacaagatgtatcctttcacgtcttactacactccaaatcggagtccatcacttcacatcaattattcattaaggagttcctctacagcttacctagggggttgtatagtcttctgattggaagccacaaatttcatataaactagtccaagtaattgtgctagagctaagatactcaaacctgaaatcagaagagggccatgcattggtatacacgccgcaatacagagactcagtccaaccacagcgaggatataggctatcacctgaataaccaatatggcaatgacgaaggaggttaatccaatcgctgtactaaacacatagtagtgaagtaatattaatatccctgtagaagtcacaattaaaccaaggccagtagcattctttaatgaatattcacctgggacgaaaagaatggctccaacagtgacaatgac

SEQ ID NO: 507638 - DNA, 180 bp, Homo sapiens
gttggactcacgggcggggcatgatggtggtgggtacgggcacctcgctggcgctcttctccctcctgttcctgctgctctttgctgggatgcagatgtacagccgtcagctgggcctccaccgagttggtcacaatcaagggcggcttctttggtccgggcttctcgggtcttggccaa

SEQ ID NO: 507639 - DNA, 139 bp, Homo sapiens
ctcgtcccatagcaggatccccctacatttattgatagttacttggttgaaggattgattattatcccccttagatcagcgaatcaaggtaaagtaactattcagtttcacactgctatgcatagcattgtatctggta

SEQ ID NO: 507640 - DNA, 428 bp, Homo sapiens
tagcgtgtgctcaggagaggagaggcttctgacataggctaccagagtcatcttttctattggcggatgagaacaaaggttttctaattgctcccgagaaggtgttctaatggtcttttctctgagccatgctcagatcggatcttcttggcgtgcagaggcaccatgtgcaagagaggcctgggtctgagcaggtacttgctgtactagggttgcttcttccccctgctgaggtactgatgataagctctgacaatccatctctaccatcctcagaggggaggaggaaggcccgggcccttactcaccctcctttggggcaccgcactgcctctgctcccgacggctgaggaggggtggtctggcagtgaggatggaggtcgctgctgctgtactgtgcagctgcagctgcttagcgtgcgggtcga

SEQ ID NO: 507641 - DNA, 2995 bp, Homo sapiens
  misc_feature (1)..(1): n is a, c, g, or t
  misc_feature (12)..(12): n is a, c, g, or t
ngttctcgagcntctcggagcatgttggctgtgctgtgcaggaggctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagagagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 507642 - DNA, 718 bp, Homo sapiens
cgcagtggctcacgcctgtaatcccaacactttgggaggccgaggtgggtggatcacctgaggtcaggagctcgagaccagcctggccaacatggtgaagccccatctctatcaaaaatacaaaaatttagctgggcgtggtggtgggcacctgtaatcccaggtatttgggaggctgaggcaggagaatcccttgaacccaggaggcaaaggttgcagttagctgagatcgcaccactgcactccagcctgggcaacaagagcgaaactccgtctcaaaaaaaaaaaaacacccttattgtaacccatgggacttgggcgtggtacacgatgtctgattgtcggtccactcaatttttaccacattgtcccccctttccgggggggactataatatattctggatacttacttataccttgagaaaactcctttcatttcctgatacttctaagcaaattcacatcctcgtgaccattaatttcttcaacttacaaacagcgctctagggttccactccaaacaattcttcctttccaacgagaaccttatttctatctggccccaaattgtcgtccacatttccccccgtgaaacccttcccaaattttcctaacaacggtccacgctccacaactttctttgatctcttctgaagagaacaaccgttttaacggccgcttttaacgctgcggaacactaccttagaccagaaacc

SEQ ID NO: 507643 - DNA, 940 bp, Homo sapiens
  misc_feature (11)..(11): n is a, c, g, or t
tgccagtaggntggcgcttcgaggccattctggaggccagtcgcttactgaaaaggcaaaactgactttaaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaaggaaagacatacttgaaactacacaacaaaaagcttgctgctttctggctaatgaaagccaaggactatccagcacacacagaggaggataaacagaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 507644 - DNA, 873 bp, Homo sapiens
  misc_feature (765)..(765): n is a, c, g, or t
tgtagattttggtaactgccaccataatcaagatacagacctgttccgtcatcacaaagatccccagtgctgtccctttacagtcacacccatctacctcctcctctcccccacccatccctaactctgacagcactaatctgttctccataattttgttatttcaacaatgttatacaaatggaatcatacagtgagaccctgtgatactttttttcactcaacataattcccttgagacctaagttctatcaatagtttgtttctttttacagttgactagtatttcattttatgggcataccatatcaaccatatgctgaggggcatttaggttattcctgatttttagctattacaaataaagctgctatgagcattatatgcaggtttttatgtctacatagattttatctctctgggatacatgcccaggagtgtggctcctgggtccttttatcttcatttttcccctttactctctgagggttaggtttcttctgcaagacatggtgccttcccaagattctgattctgtgcactaagtctcttccatttgacttcccaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaagtangttggtagtactctgtgttctaagtgtattacatacataggctatatctctccattatagatgtttccttcttccttttgaggatatgagtagaatactggatttgga

SEQ ID NO: 507645 - DNA, 388 bp, Homo sapiens
actccttggaggctgaggtgggcagatcgcctggggccgggagttggagaccaggctggccaacatggtgaaacctcgtctctactaaaagtacggaagttgtccaggcatggtggcgcccgcctataatgccagctactcgggaggttgaggcatgagaattgcttgggtccaggaggcagaggttgcagtgagccaaagctgtgcggctgcactccagcctgggtgacggagtgagattctgcctcaaaaaaaaaaaagaagacggcaagttaatctgttttcaaaacaaaaataattgcagattaatacaattaattacagaagagttttacacttgcaaaggtgaagggtctctcctaaccagttttcacatcacttaggggca

SEQ ID NO: 507646 - DNA, 487 bp, Homo sapiens
ggtcgacgcataatattgttgaaaacaagtgtgttcatttcaagtgtaaattgattgacatttatatttctatataggaaataatttagttactatcaccaggtggatgttacgggttgcctgctacaatgcagaattattcctgtttgacacacatggcagatcgagttaacatttctaaaacataaaagtcatgggatgtgtactaaagtggaagagctgagagtctcatctggtcactgtcaagacattttattgttataatgtcctatctggtttttggaaactcttagaaaccccactttataaacttaaatttcacaagttagtctcttagctctcctgtttacttataacatgtatttttccattttagatacagacagaagctgctcagttgcttacaagtttcagtgagaagaattgagaacttttcagagaagatttatgaaatagctaataaacattgccttttcttttaattcta

SEQ ID NO: 507647 - DNA, 174 bp, Homo sapiens
gggtcgcaactgatcaggtactgcggcgcggtacgcctacgattgtgggggcatgaactgatgcgaacagattttcgtttcatttctggttctcagcggtttgttataattttttatttctatgggctttgatgagggaggtaggtggtagtttgtgttttggcccttatcgag

SEQ ID NO: 507648 - DNA, 3042 bp, Homo sapiens
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagagagactgtgtgtgtaggtggatttttcccaaaggatttgggaattgtaatgttacaatgaactgtatggatatgtttgtcatgtacattttcaaacaaaaaggaaaactgaaagtagtgatctttgtatacccatctcttagattcagtgattttgctatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 507649 - DNA, 2988 bp, Homo sapiens
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacagatacagacagaagctgctcagttgcttacaagtttcagtgagaagaattgagaacttttcagagaagatttatgaaatagctaataaacattgccttttcttttaattctaaacttaatatatgaactataactgttctacggctttttaaatgttgtgaccatttaaccgtgtaaatataaaatattctaggcttcttcacaaataatagggtaaaataaataatcgccataagagtggtagaaataaatctccatggctcaggcaaagagattattttgcatcctggataccagcaatgcaaaatggtatgagatttctaaggattgatcacattgggatgggagatcaagcaaagaaatatttgtagaggaggggaaatggatctataggggatatacagggggatggattttcaaattggattgattctaagttgaaatcttgaagagaaggtgtggtgacagtggttaggatgttgtgggttcctgacataaagtagttaaatgatatatcttggagctaacctgtgtaagtaaagaactaagtaaggagatgactaaaaatggagtagtttccttttttatttttttgagacagagtctcactttgtttcccaggctggtgtgcagtggcacaatctcggcccactgcagcctccgcctcccgggttcaagtgattctcctgccttagcctcctgagtggctgggattacagggttgtaccaccacactcggctaacttttgtatttttggtagagatggggttttgccatgttggctaggctggtctcaaactcctggcctcaagtgatctgcccgccttggcctcccaaattgctgggattacaggcgtgagccaccgcacctggccagtttactttaaatgtggtgtagtctcatggtaaactgaatttgtcatcagatgcaaagttctattccctaatggaatggaaggaacacaaaacttaagagtgaaatggaatactaagatgtttttaaataggcaggactatgctactcacttgaggctggagtgccaccactgcaaaatctttttaagttttgtaaaaaggagcatcttgaatccacttagataaagagagactgtgtgtgtaggtggatttttcccaaaggatttgggaattgtaatgttacaatgaactgtatggatatgtttgtcatgtacattttcaaacaaaaaggtatataggttgtgtatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcacaggaacaaggatggcaaaaaaaaaaatatgacacaccactgatacagtgaaaaaataatgtggtcagggtagctaggcaacagtagcatcaccagaaacctgtatcagctgttaaacggcaacaacaatggcaggctttcagtttcccacttaatgatgctgtattttaaaaggttattgtatactgtaattttatttttgtaggtgaagagaaacagaagcagctgaagggccaggaagtgggtctttctagggatgtggcattctgctggatggctttttaaaatgggttttttcctttagggagaccgaataaactgtgttgtgcacctgcaaaaaaaaaa

SEQ ID NO: 507650 - DNA, 97 bp, Homo sapiens
gtggttcggtccggaatgtagggatcaccagcgctctacagtctactgtcagcctcagctcgccgaagcaaagctagcgagtacgcagcgcggcgat

SEQ ID NO: 507651 - DNA, 276 bp, Homo sapiens
  misc_feature (10)..(10): n is a, c, g, or t
atgtgagttntttacaggtttgcatatggatagccctatcagactaggatgatctgggtgcattcttgcttgaaggcaaggagaaatagtcttttcttttatttctcctttttaaataaagagccgggtttttatccgtgtggctcaggcgggggcttaggggccccgttttagctcagtgcagccttaaagtccagggctcaggggatctttcaacctcagcctccggaggagcggaaattatgggcacatgcccacataaccgaggggggcaag

SEQ ID NO: 507652 - DNA, 2972 bp, Homo sapiens
  misc_feature (2933)..(2933): n is a, c, g, or t
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaaggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 507653 - DNA, 550 bp, Homo sapiens
ggatttacttcatcaatgactctataataagtaataagggtagaacacattacaattcacaaaataattccacaaacattatctcacttgcttttaataacaacagtggaagaatgaacaactcattccagtgaggaatttaagactcagaggttaaataaagctgaatatgggaaagattaggcaatttgcccacctcaggacttgaactttggtgggcaggctttagctctaaagttcttctataccaaagctgtgtcaacattaaagctgggactggacttccaatctgaggacccagaagagtcagcatatcctacttaacttctaagggtagggtggcggggtatgatttctttattttgaactataatttatatggtgtctcctagaagtttatggcccatacaggtatcttccactgttgcgggaagtcaaggaccccgaacagagggaccggctggagcctcggcagaggaacataaattgtgaagatttcattttaatatggacatttatcagttcccaaataatacttttataatttctt

SEQ ID NO: 507654 - DNA, 1541 bp, Homo sapiens
gtctctgctgcggacgcctgggggcctggcgctggtgttggcctgcccccggcctcgccgagtgcatgcgctgcccgaagtgccagtgcctgcgctcctgtcctgctggccctggctgcccagtggatgtgcttgtggatgtgcctgcctgctgcagtctgcctgcactgcatacacctgcctggctgcctgtcgtattctgctgtctgccctgcttatcctgtgccacctgctgtgcctgccaatttttagtatcgggctggaatgctgcctgctgggtaggtgtgttgggaagcccaaaggctgggaggatgcctgctggggcatttcgctgtgcctgccagcccattagccggtcggtccccctgactagctgggttggctgtgtggttgttgctccgaagcaacgcaaggaaccctgggaaggccatttgggagtgctgcacaaagcaattcgcatcaatgcacaaacgtgtggcatttccatgcggttcccgaatcccttatattgagagacactgtggggatctaccaaccgagttgaaaatggctttcccaatgtgaacccaggctataccccagaacaaagggcacccaaaatatgatataacatagagttctatcaaaaaagacccagcattaattgaaccacaggaattgattacaaagtggaatcctatcctatacggagaaaagaacaaagagaaagctcctattagcaacaggaactggggattttatacgcattaatatgcttgagagcacggaaacattacagagagaattcaaatggcccccgtgcacccaggaaaaagcaaattcgccaggaaaaccttgctgaaaaagagaccccttggtatttagattccttaagaactcacgtcaaccttattggacagaagatggaagacgaacgattgtaattagcaccccaagtgttagggttggggacaaggactcgtagaagatttcgcaagaaagaaaacagtggaagaaactcttagccacaagcacattgatgccaccgtatggtcccaaatttgtttgtcacaatttccaaggacacaacactcaaactgaggggaaggcccaccccattgtggaggacagtataccgttccaaatcccttgggagaagccttatctgacgcacaagtgtggtaatctcccacagccaaacaactctgggaaaagcacaatattttggagaacaatcgacaggattcccgacacgagaagccttatgcattatgacaggagaagctattcagaaggacagagaacgaaagtatgacccgacaaccatttttactttgacaaaaccgggcctaagcgttcatacgattgagccccccagcgagaccacaggaaaaatagtaggcagtgaccacttgtagtaagccgtccagtagattgtgcacaaaacgtttatatccgcatccctgagagactattgattaaacaaaacgaggagagatcaacagagaggcaaacagagagcaataacaccacaaataacagtgtgcataaataaaagaggg

SEQ ID NO: 507655 - DNA, 2495 bp, Homo sapiens
  misc_feature (2456)..(2456): n is a, c, g, or t
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 507656 - DNA, 2688 bp, Homo sapiens
  misc_feature (2649)..(2649): n is a, c, g, or t
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaagcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcattcaaatgcttatgtaactcttcaatccatctggcttcataaaaaccaaaattttgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 507657 - DNA, 894 bp, Homo sapiens
ctatgtcggggccgtccgtggggagcggtggtcctgtgaggctgcgcggggctgagtgcggcctcgatttgtgcgaacttgctctgaagatgcctggatctaagcctggagtccaaggtcatggacttccccacaatttcccgatccccttcggggcctccagccatgggacttggagtgggcccaggggacattcttgttgccttcggacgtgatctcatcgccatgacacgtcagttgggaccctatgccaggagggccccggtaggctcaagtcgggatggaacttgatagatgtcaagccttcatggagctcggttgcagctagtttgaaggctctgcccaggcagatctaggttgtgcccgatcgccccaggttggagccccctgtccctctactacatttgctcgacaggccggagtggccattggtggcctcctcgaaggagattggctgagtgctgcacgtggctccgtgtcgtgccgaaggcgtgggctggggatgacactgcgtgggcctcttgcgacggtgcggaggaatgcctcgccattctccagacgtggctccgttgaacgagcctctagagcctgtcccccgacttgtcgcgagccccctgatggatccaaatgaggattcctggactccccgaggaatggggtggaggcgggctcctgctgacgcaggaagggcagcacgggagctcaagcaggttccccggaacctggctggagacggtgtctctagtccacactgaataagccacccgctggtgcccagagccccgaaacctggcttctacctggacccccaagaggttgcctggtccctgtgacactgaagactctggacggtctcaacttttgggcacggaccttgcggttcaccaccttgtg

SEQ ID NO: 507658 - DNA, 2918 bp, Homo sapiens
  misc_feature (2879)..(2879): n is a, c, g, or t
gaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgctcgactgtggcgccttctgcctttccgacgtggagccgccccggggtctcgtctccctgcggggacttcgggcagccgcgggcattgcggcccctgtcgattccgcggcttcgaggtaatgggaaacccaggaactttcaaaagaggccttttactctcagctttgtcgtatttgggttttgaaacttaccaggttatctctcaggctgctgtggttcatgccacagccaaagttgaagaaatacttgaacaagcagactacctgtatgaaagcggagaaacagaaaaactttatcagttgctaacccaatacaaggaaagtgaagatgcagagttactgtggcgtttggcacgggcatcacgtgatgtagctcagcttagcagaacctcagaagaggagaaaaagctattggtgtatgaagccctagagtatgcaaaaagagcactagaaaaaaatgaatcaagttttgcatctcataagtggtatgcaatctgccttagtgatgttggagattatgaaggcatcaaggctaaaattgcaaatgcatatatcatcaaggagcattttgagaaagcaattgaactgaaccctaaagatgctacttcaattcaccttatgggtatttggtgctatacatttgccgaaatgccttggtatcaaagaagaattgctaaaatgctgtttgcaactcctcctagttccacctatgagaaggccttaggctactttcacagggcagaacaagtggatccaaacttctacagcaaaaacttacttcttttaggaaagacatacttgaaactacacaacaaaaagcttgctgctttctggctaatgaaagccaaggactatccagcacacacagaggaggataaacaggagcctgattccccacgtgtcacattggtccgtgacgtttccccactaagggtgagacccattactgagaacaaaccccaggaatcccttacattctccttcccgtgcagcccccacctgattgttcttgtgtggattccagagctgactgctggattgagatgcttatttccccacgtacatgtatatcaaaggttctgtgtagcctcacctagtgcatcgtaatttcttacttgagggagaccagcaccctgaaaacgaactggaaagctgccttcttcagtcaaatctgctaaatcatacctacaatgaatgatattcaataacttctgtcatggcaaaatttatacagcagtggtaccatttgtaattctaatacttaactcttttatggtatacgcagtcctttttgaaggccagtttccctctatcacataacctgtcacatacattagaattttttttttaattctttaggcttgaaaattaccagagtgttcataataaggatttggaaaaggagtctattcaaccaagcagatctctgcctttctttcgtctttactatgaattctgaataaaatggagaacacactctcaatatgtagaaaaataaaattttggcaaaacaataattactgtttttctgtatgtacttagcagtgaaatatttataggcaacagattttaagaagtcagttccatggctattaaaaaatgtttaagttaatgaaatttacagtgcatattaaaagcatgatacaaatggaaatttaaaattttgtattaggaagcccagtttgctaaaagtagcattaatatcattcacatcagattttaatttgttacacatttttgtagttcagcaaaggcccctatgatgaaaaacaattaaaaagtgttatgacaaaaataattatctgtgtaaaaagggggagacccaaaagatttttcatatggttatttaattcagttaaatagaactgttatgaatttgagaggaatgaagatattcaaacactaacagaaaatcattagccttatattagagcatgaacacaaaaaagtggcagagtttacattaccttttgtatgttcctaagtatgaaattgcatcaatttattatgaattaaatttgaaaagcatcacagatttaaaaacaaagtacaaaagagcctgattctttttaattccacaaatacctagcatctcaaagtaacatgtaaacaaacttctatgctgctcaatgaatccttccaatttcgataataaactaaatagtattggatctagtatatgactttcatgtgtaagttatggttctatccattactttaacaatattactgatgtaacagagaaaaattttcaactattgtatttatttaaaacaaactgacaagttcaagcacctgtcttcagaaaagccagcagcatttttttttttttaacatactcaaagtaagatttggcctaagcccttaatacctttctgaacagccatgcaactaaacaccctcaggagatgttacataagggagagaagaacatggagcaatttgcactttttcccctagataatattaacaaggtaaagcaaatccagatctttatgaatgaatggctgtcatgtttaatacacttggagctctataaaactagagccactatcatatatgtttatatagatatatatgtatttttaataaagtctctcacttgcttcaaaatttaaggatgatctttttcctggtcagtcatttcaagggaacaataaataaagtagaaaaggatgaactgttttgcatatttctgtggaagaacggaaaacatactttgagaggttcggaaaatncactgtacagaatgaacagcttatatacactatctgtgc

SEQ ID NO: 507659 - DNA, 338 bp, Homo sapiens
  misc_feature (71)..(71): n is a, c, g, or t
  misc_feature (74)..(74): n is a, c, g, or t
  misc_feature (113)..(113): n is a, c, g, or t
  misc_feature (189)..(189): n is a, c, g, or t
ggtggtcttgatgcagttgtaagcttggggtatgaaggtttgggccccgctggcgctttccggctgcgctngcntgttttcctttccgctcccaggggcgttgggaacggttntaggacgtggctctttattcgtgagttttccatttacctccgctgaacctagagcttcagacgccctatggcccgnccttcgaacccaaccggcggccttgagcgctgagcaagcaaaggtggtcctcgcggaggtgatccaggggttctccgccccggagaattgcagtgcgcatgggacgaggtttcgggataaacgccttgcaacgacatggggtaaaggat

SEQ ID NO: 507660 - DNA, 623 bp, Homo sapiens
gataggcttgtgtcttacccctgctgacttctcgccgtcgccttgtaagctttgtcttcgccttgcaagctttgtcttcagggttggaaagatgagacattcaaagagaacttactgtcctgactgggatgaaagagactgggattatggaacatggagaagcagcagcagtcacaaaagaaagaagagatcacatagcagcgcccgtgagcaaaagcgctgcaggtacgatcactccaaaacgacagacagctattatctggaaagcagatccataaatgagaaagcttatcatagtcgacgctatgttgatgaatacaggaatgactacatgggctacgagccagggcatccctatggagaacctggaagcagataccagatgcatagtagcaagtcctctggtaggagtggaagaagcagttacaaaagtaaacacaggagtcgccaccacacttcgcagcaccattcacacggggtatgagtgccttttaaacgttctgaaaggttttatttcccatggagaacaggaaacagtttgtgtttgagaaaatttcaagataaaagtcatcacaactctaccttgcaggagtattcttttagtatttgtgtattacataaga

SEQ ID NO: 507661 - DNA, 196 bp, Homo sapiens
tacaggatctagctccattggtagcctgagcagcgtctcatccatccgcgctatagtcaaatgtcacctccgccaagaggccctcctcttctaagtgcaactcctatcttcccatcttgggttaggagctcatttgacagatgaggaaactgaggttaacgcaaatctatacaagctcctaagggaaaggccagga

SEQ ID NO: 507662 - DNA, 874 bp, Homo sapiens
  misc_feature (381)..(381): n is a, c, g, or t
agcgcgcgttgtcgacgctaaaccccggggccaagcgcgaccggtcaaccacgaccggggttccggccccaccagggtcgtcggccgagtagaagcccgcacggcgccggacaagacaacgacgggcacgcgagccagacactaacgggaaaacaggcaaccccgccaacggcggacgaaacagatcccaccttcaggcagacactagacaacccccgtcgacacacctgctctggggcccacccctggcccaacatgtcaaggggcagcccccacgaacgcgactttgcgcacccttgccccagagaacaccggcgctggccccagaaacatatacgaaggcaccagggcccctccaaggcgtcatactttgtgcccggncgcaacgttgccagccggtaacgcgccctggccccgagacatagacccgtggggcccgcaacacacaccctcgccggctacccgcctgtgggagaaccacccagcgcccgccactcctccgcgtgctactctactgcagcacggcgcccggaggccctcacggaccacaccatcagtacaaggcggggccgcacagtcagacacgtgggcccaacagctcgtgaaggatacaccccgtcctgaagagcttctaccgcaagcacataggtacttcggagcgcacgcaggtcggcagactcctaccgtgtcactcggatcgttggaggtagttgagcaccacagcacgaaggttttatgtcccctcgatctcgctccccataggttgaaggaagtcgagagggacgccggcagtacatccgacgggggtcgtccacccgtgcagatgatccccggggttcgggtccccacaaaaagcccccgcccccacattaac

SEQ ID NO: 507663 - DNA, 357 bp, Homo sapiens
attatttatttcgcggccgtttgtctgttataacggggctcttctttctacgttactttatgttggtgtttttgtaaaacagaattagggtgaccgcggggattgtgcggaaatttagccaccgtttacatgtcgggaggctgaggtgggaggatcgcttgagcccaggagttttacaccagcctgggcaacatggtaagaccccttctctaccctcccccccaaaaaaaaaattttagtgtggcatggtggtgggtgcctgtggtcccagctactcgggacgctgaggtgggaggattgcttgagcccaggagtttgacaccagcatgggcaatatggtaagaccccattatctac

SEQ ID NO: 507664 - DNA, 142 bp, Homo sapiens
ttttggttctcaaaaactgcattattaataatattttagtatacagagctattccacagtttttacattgtaaacatggctgtggttttgtatttgctaaatataggggctggactaaaatataataaatctgtaccttatc

SEQ ID NO: 507665 - DNA, 289 bp, Homo sapiens
gtatgacataggggggcgattctctggtggcgacgctgccggcgcctcaagggcgcttcctggcgaatcttcgccgagtgggccgatacagggatgcggcatgcaatacgggacgcatcagccgggggcgtatcgacaccacgtctacaagcgcggctacgttcaccacaagcgggtgcttgggccatcaaatcgggggagacgcggaactcgtcagcctgggtggcttgcttggacgacggcaaacacgagcgcgatgctggtcgggttaccgagcccgaaattcgta

SEQ ID NO: 507666 - DNA, 80 bp, Homo sapiens
  misc_feature (5)..(5): n is a, c, g, or t
gcgcnaatggtggcctttaataccaagaaagaccatgacaagtgacagaacaggagcaaattcccttctgtcgtcttctc

SEQ ID NO: 507667 - DNA, 110 bp, Homo sapiens
ctcttggtcgtgtgaagttctttctcttgcgtatgctcctagtctcatgtcatccctaacagtactgagtgcttatgggcatgagcctacatgccctgcatccagtcaga

SEQ ID NO: 507668 - DNA, 564 bp, Homo sapiens
cgaacatgtcgatggctataccagtgtatgttgtactttcacttgttgattggacattatctatcatctccgcgtttgggctattatgaatgaaactatcatgagcatccatacgtggcaggccaggtctcactaacacaggcctccgaaacaactgtttcagtaccgactgagtggttcaataaaatattaagaggaaaaaaaaaaaaggatctctgtgcccttatacaaggggcgggcaatgtcatcaaaagcccaccaagagttattgcctaggatttctccggggcgtaagagcatgcacggaaataacgaaggctttatgaagaggaagcgcatgttagtaattaaataaagtgcttcctggggggggtctagaaagaaatcccccagggctccagaaaccagtttctgggagatctgaagggactcctcgaaacctcgtgggatctagcaggaaagaatagtaagggcccccaaggagaacaccctatttagataaagtgaatataaacctagaggttccagaggaagggtctatccgcgactcgtcctgtgttctag

SEQ ID NO: 507669 - DNA, 1692 bp, Homo sapiens
ggccccttacaacgcagagactctcctcttcgcagcaaacaagacgcaggcgctcctccaagctagcacatattgacagaccttccactggcactccttacccgacagggctctatccccactcgtgctgctcgtaatactggtgactttgcccagctctcaatctcctaactacaggacgctggcagctcaacccattactcaacgtggacgcacagctcaccagcgtcgctcgcacgtgcccacgccttcgttcctgtggaacacttcgtaacctccaggaacgtggcacactccctgcaacctaacttgcacttaccatgtgatcaagccacctacactggcgcgctggatcttcgcgactctccacgtggctccggcccacgccagctccttaccacagactggccaggccacctctagggcacacttcctgggcagcacccccttcacaacccccgttcccctctttccaactcttttgccaccttcctatgacgtcgcgcgcaccccgaggccacagccatgcggcgcaacccacacgcaagcgcaacacactccgtggtgcgcttggccctgggagcacaacttgggcccaaacaccactgtggacacacgggacccccctgatacatgaaaaccgacccttagatgggcccactgcaacaaacgggccggccctaggcgcacgctcggcgccacaccacactctatacgccgcccaccgagacgacgcgcctgggcatcccaccacacccatttcacgcaggtggggcgcccaacatctacctgacaagcacgccagcgacacggggcgctcaacaaccacaccgatgccgtgcgagcgaaggacgaacctacccgcgcacacggcgcacgaagatgacagaccgaacggccgcatggcgagctgtcacggcaacacactccagctagtggcgcagggcgggacacgactctcacactgtcgtcaccaagacgaactgttaccacagtcacgctgcggacacctgctcccgtcatctgactcttatcagccgactcttgtgtacactctgtgcaaccccgtcccccctcctagctacgtttcggacacgaacggcctggggtgaccaactagccgcctatacgccagcccacagccggcacgtgagcctgctgcaatgcgtgccgccgtaccacagccttggtgagtcacatctcgcgtctcacgccacgcgcacgcctcgaagactgcgcctggcacccgcttattagcgctaactattagggcgccacaagggtgcccctagccgtatggtaccatcttctccgcgtataacgtttccgtaccacgcaagaccctatagacagcccgctaccattaacccatgcaatactcctctctgggctaacgcgccacacgaccccaccgacactccccacgacgcctagggcacccaacccaacgcaccggacagccagtggcagaccgcggaggtgcacagcgctccgatcagccccctcacaacagctacgggccagcccacatcagcggagtacgcactcacctggacgccagccagctcgccgcacccccaacacgctgaccggcgactccccctcaagcgcgaaaccaacgcgactcgctcgagccactgctcgcgcaggcagcgcaccggcaccagacgaaccgccctgactcgaactgct

SEQ ID NO: 507670 - DNA, 474 bp, Homo sapiens
taggttggagggggaatgctgggaaatggtaaggggtatggagacttgtcatataagtaaggctagggtgaggggtaggaagtttttcataggaggtgtatgagtgggtcgtagcggaatcgggggtatgctgtccgaattcataagaacagggaggttaaaagtagggtctgggtgacaaaatatgtggtgtagagttcaggggagagtgcgtcatatgtggtccctaggaagatggcaggggtgagggtgttattataataatgtggtgtatccgggctatgaagaatagcgcgaaggggcctgcggcgtatccaggatgttgaccgcctgagactagtctcggactccccttcggcaaggtccaagggggtccggtgaggtctctgctagctgttggacacaccccctatcacgcccacgggccatgatgccggacgtcaccagaggtgtctcgcgtcgcgacaagggcca

SEQ ID NO: 507671 - DNA, 143 bp, Homo sapiens
gggctcatgatagaatcgagccgttaccccgccgttgcatgcacatgcaaggcaatctgtggaaaaccgcaataagatgctcaaggcgcagggattaacgaaacactgtttatggcgctgattaccctggatgcgcaggagag

SEQ ID NO: 507672 - DNA, 733 bp, Homo sapiens
  misc_feature (11)..(11): n is a, c, g, or t
  misc_feature (15)..(15): n is a, c, g, or t
  misc_feature (24)..(24): n is a, c, g, or t
  misc_feature (26)..(26): n is a, c, g, or t
  misc_feature (29)..(30): n is a, c, g, or t
  misc_feature (36)..(36): n is a, c, g, or t
  misc_feature (41)..(41): n is a, c, g, or t
  misc_feature (49)..(49): n is a, c, g, or t
  misc_feature (64)..(64): n is a, c, g, or t
  misc_feature (86)..(86): n is a, c, g, or t
  misc_feature (116)..(116): n is a, c, g, or t
  misc_feature (118)..(118): n is a, c, g, or t
  misc_feature (136)..(136): n is a, c, g, or t
  misc_feature (172)..(172): n is a, c, g, or t
  misc_feature (217)..(217): n is a, c, g, or t
  misc_feature (239)..(239): n is a, c, g, or t
  misc_feature (270)..(270): n is a, c, g, or t
  misc_feature (290)..(290): n is a, c, g, or t
  misc_feature (322)..(322): n is a, c, g, or t
  misc_feature (327)..(327): n is a, c, g, or t
  misc_feature (346)..(346): n is a, c, g, or t
  misc_feature (368)..(368): n is a, c, g, or t
  misc_feature (386)..(386): n is a, c, g, or t
  misc_feature (394)..(394): n is a, c, g, or t
  misc_feature (396)..(396): n is a, c, g, or t
  misc_feature (399)..(399): n is a, c, g, or t
  misc_feature (419)..(419): n is a, c, g, or t
  misc_feature (453)..(453): n is a, c, g, or t
  misc_feature (455)..(455): n is a, c, g, or t
  misc_feature (464)..(464): n is a, c, g, or t
  misc_feature (477)..(477): n is a, c, g, or t
  misc_feature (513)..(513): n is a, c, g, or t
  misc_feature (555)..(555): n is a, c, g, or t
  misc_feature (564)..(564): n is a, c, g, or t
  misc_feature (566)..(566): n is a, c, g, or t
  misc_feature (569)..(569): n is a, c, g, or t
  misc_feature (581)..(581): n is a, c, g, or t
  misc_feature (589)..(589): n is a, c, g, or t
  misc_feature (628)..(628): n is a, c, g, or t
  misc_feature (644)..(644): n is a, c, g, or t
  misc_feature (652)..(652): n is a, c, g, or t
  misc_feature (659)..(659): n is a, c, g, or t
  misc_feature (721)..(721): n is a, c, g, or t
taccaaggaanaaanacctttatnangannataggnatgtnagaaaaanccagttcagtcaaanaaaaggaggcaaaaattggganagagcaagaatccaagtgtgaaaaaaaaancnccatctaaaaatcccaanagaaatgccgcggaatttagcccaggggaaacttcngaaagcccctggggaaatgagaattttgcataaagagagagcccnccagccctgcggcatctgagcntcttataaagggacagggcttggccagcagnagaggaagagaaaaaggggntgtctcaacacccaagcaagggcgtctgtgtncaagngagagaagaaccttagggntttggacagagtaaactggggnagcggagggaaaatggcngaggaaananaangtctaggccgggtgtggganaatggggggggggctgtgcagtgtggggtgagtncntctccaggngggcttgggaaanactggcattccttcctgaggccattttggttctgtnctgacttcattcagagcagaactgccaatgtccagcgccaantcctggatnanaantagctgagtggnatgcagtngccaccctatgactcccatacctcttcctttctggagcngttacttttctcagancaagtganaacttanccagtaggggcccaatctagaaatcactcccaccttcatatgagcaccaggtggagagaatnattctcatgact

SEQ ID NO: 507673 - DNA, 236 bp, Homo sapiens
tgctggtgtcctggagaacagctggctgggagaccttcttccccacaggcagctgctatgcgtagggaccgcgggggaccgagtggcatcacaacaaaccccgagcacagtccagcccggccacagcctgcctccttagtgtatctagtaagtcttccctgctgctgcccacatcctttacccaccgtgtctctcggcccactggaggtatcaggatgtgggcacgcattatggag

SEQ ID NO: 507674 - DNA, 588 bp, Homo sapiens
taactcgcagatggcaataagatacccgctacaaactgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagataaaaaagagcgaatagagaaaaatcaagatatatcgacgtacagaagtgtagagaaagaggtgtatgaaagagggagacgaaacaagggagtatgatagatagaaatgtgacgtacaagatgggagaaattacagatggtgcggatcgttaaaattagatagtgcaagagcaatacaactttacgtcgatagatatgaacaacaaagctgtaaagaagtaggactcagcacagttatcaagcaagattatgaggcatgtaacataaacgagtcgcaagcaaaaacaaatgggcacatagagatatgctacatgtagagcagatacaacagagttggaaccaactaacatgagtggatcacatatcattgtaaaaataaataaattatatattacaatcagctgagacattatgcgtatatcctagaataa

SEQ ID NO: 507675 - DNA, 131 bp, Homo sapiens
  misc_feature (5)..(5): n is a, c, g, or t
  misc_feature (46)..(46): n is a, c, g, or t
ccttntgctggaaaggggtagggcagtcttctcgtaaggtgctgantgagcggagtcttgcagaacgaggagtcaccaggcggacaagggaaattccaggcagaaggaacagcatgtccaaaggcatgggc

SEQ ID NO: 507676 - DNA, 164 bp, Homo sapiens
tccataatgtgtcccattcgggagaatgggatgaaggtaagaaatcgtgatgagagtgttctgtaacattcactctcagtcgggaagattcgtgggaaacaggaaattttctcttttttttgatacagctcttgctcttgtcaccacaggctgacagtgcagtg

SEQ ID NO: 507677 - DNA, 102 bp, Homo sapiens
cccccccccccccttttttaaaaaaaggggggttttcctttttttggtggggggggggggggggggcccctgttttttccttttaaacgggtttggggggca

SEQ ID NO: 507678 - DNA, 1554 bp, Homo sapiens
gtgcatccctttgcggactccgtggaggctcggcgctgcggcggactccggcggtgggcgggcttccgcgcagggcggccgggctccgcgctgccgccgccgtggcccatgggcacaatcgtctcggaaggccggcattaaaccaaaaagatgtccctatatgatgacctgggagtggagaccagtgactcaaaaactgaaggctggtccaaaaacttcaagctcctgcagtcccagctccaggtgaagaaggcggcgctcactcaggccaagagccaaaggaccaagcaaagtacagtgcttgctccggtcatcgacctaaagcgaggcggctcctcagatgaccggcagattgcagacacaccacctcacgtggcagctgggctgaaggaccctgtgcccagtgggttttctgcaggggaagttctgatccccttagctgatgaatatgaccctatgttccccaatgactatgagaaagtggtgaagcgccagagagaagagcggcagaggcagcgggagctggaaagacagaaggaaatagaggaaagagaaaagaggcgtaaagacagacacgaagccagtgggttttcaagacgaccagaccctgattctgatgaggatgaagattatgagcgagagcggaggaaaagaagtatgggaggagctgccatcgccccaccgacgtctcttgtagagaaagacaaagagttaccccgcgattttccttatgaagaggactcaagaccgagatcacagtcttccaaagctgctattcctccccccgtgtatgaggagccggacagaccaagatctccaacaggccccagcaactccttccttgctaacatgggtggcacagtggctcataagattatgcagaagtatggcttccgggaaggtcagggactggggaaacacgagcaagggctgagtactgcattgtctgtggagaagaccagcaagcgtggcggcaagatcattgtgggggatgcgacagagaagggcgaggctcaggatgcatccaagaagtcggattcaaatccattaactgaaattcttaagtgccctactaaagtggtcttgctgaggaacatggttggtgcaggagaggtcgatgaagacttggaagttgaaaccaaggaagaatgtgaaaaatatggcaaagttgggaaatgtgtgatatttgagattcctggtgcccctgatgatgaagcagtacggatatttttagaatttgagagagtcgaatcagcaattaaagctgtggtggatctgaatgggaggtattttggtggacgggtggtaaaagcatgtttctacaatttggataaattcagggtcttggatctagcagagcaagtttgattgtaacttaaagtcacctccttgatccttacatgagctacagactgaacaatgacacaggcatggctgttgtgtccatggctggtggacactgaaactcttggatggacttctaaaatatatgttgatggatcccttttttattttgtgttttttttaatatagtataaaaatcctttaaaaatc

SEQ ID NO: 507679 - DNA, 329 bp, Homo sapiens
ctcggaccggaagttccagacacacaacctcgcagcctttggcccactctccatgatgaacctgcagcacaccatagcagtgccctccgcacagcaatgccctcctatggagttatgtaactgcatgagactactgcctgtggcacatggcacacatgacctactatgtggccacctatttcatgcataaatgctctacacttgccctactggaaaggccaacacctcttcttgaactcacatgcagtcatgttccctgaatcctgccctaaccctggtggatacctactagcagtctgaccctgcatggcattgcaatgctatgtgca

SEQ ID NO: 507680 - DNA, 733 bp, Homo sapiens
tccaccagtggtcaaatgacccttaattggaaatgtttcccttggggctaaacgggcggggcatcccacagcaccacggtggattgtcatcgataatgtcatgaggatgggcgggccatcaactattaacagcccactggactggggcagcccccaggatctcttaaatggtgtcccaaaaagtcctcgggctaaggatcggtgccgctatctggtcgagcaatgggttgcacaatctctatcaaaatgtgattatccccacgttggtgtgtttaatgtggtgtttctcgtggtgtgtctcttctcttggtcctctttggtgtgggtctcctttgaggggctattgggatggactcagggtggcaagatgtgcaagatatgtgcccccaccttcaactcttgggcgccttggtctggtccctagaatttgtgctcatgttctcactgggttactctcctctcaggcgcccttctcacatgttcccccctgttgtgctcttgttggtggcaatgcgctcatctcacacatatttttttttgtgtgggagaaaccatgcaccccaggggggtggcgccagatctcttgggagttgcgccagttggggccacacattgtggtggcccggaatgttcaacctctcgcggtttgcccccttcaggtggttttacccgactttgggaccctcgctggggggctccaaactctcgggggggccagtggttggacgtgtgg

SEQ ID NO: 507681 - DNA, 574 bp, Homo sapiens
  misc_feature (522)..(522): n is a, c, g, or t
ttgcaataccccaatctgcgctcaagtagaacgctggtcatgccgagtgtaattcatggcgtcagtcccttactcatacccatagtggtgatccttagaatcgccaccgcatccacgatatatcattagagcgcgtctcaagcagcccatacatctagatcatgcgctctcaaggcctagcttcctctcctgtcggcctgcgtgaccaagcgcggcgaagaatgccctcggtgcagggtttgaatgcgttgcattccattattatattctagtcgatagttctaatgagtcgaaagatcgagcagtcagggagccttggggtgagaataaggcaggcacattaacgcgccctgatcttgtccagagactttcacgaagtccctcaataggttgcaacttcgacgccaacttataagccctttctagcgcaccacaacgttgaaatggcttcggcaccgatccctgttgtatgaccaatagctgtcttccctaacacataactcaacctccacagagattcanctctagaggatagctaaacctattctacacgcgataggtttaaatctctagg

SEQ ID NO: 507682 - DNA, 112 bp, Homo sapiens
gagacttctccggggcagacgccgccgcgatgcctacgtggctcctacctgctggcggccctagggggaactcctcccccggcgccaaggacatcaagaagatcttggacag

SEQ ID NO: 507683 - DNA, 127 bp, Homo sapiens
tgagaatagtcacggtcggcgaacatcagagaggattgcttaaacccaggatgttcaggctacagtgagccatgatcacaccactgcattctagtctgggtaacggagcaggaccctgtccaaaaag

SEQ ID NO: 507684 - DNA, 1015 bp, Homo sapiens
gggacgcaggagctagacagtctgctggccatcactgcagaccctgctgggggccctgtacgagggagtggagaacgtggtcctgatgacataatgaagggccctggggatggagatgctgctgtccatcagaagagtggtgatgcccatgtccattctccagtgcttcggcagaggttttcgggaacgtggcccggcgtgactagggctcatgctcaggtctgagttcggagctcccgtggtccgtccctgtgcaggaaacttgctggatttcatctggcggaccctcagcggtcagtagcaagaatattagcttgcatggaagatgggtcccctgcaggtgctgctgctgccctcgtatccagcttgaggtctaggaccatgctgtcgtgcactcatcctcgcgtgctgtgcaagccggcgcgttgcgctgtggggatcctgatcgggcgcctgattgcccaggtcctcaattcctggatgcatcggtagagattccctctctccaggccacgagcacggccttacagcacggctcggaccacggtgtatgcgatgttagagctgagggtgcaggtgtgtggggcctcggcgggaatgcttcagggaggagcctctggagaggccctggtacacgacctgctcagcgacatctacccggcagtctgatgcgcttaagctgcgtagcccgcgggggagcctgatgtgagtctggaagactgggaagactatggccccgcagaaacgcaccacgcggaatcgtggggggaaggctattggggccgcaacaaaaggcaaccggtcaaaggggcgatggcaaatggcggaacacgagaaaacgtaatacgccggcaggccatccagaaggcgccaagcaggagcccccccatgttagtggcccctgcatcttcgggcagcacacacaacacgaacaccctcgagcagaggagctaccccgggcacggctgtatcaacggagtatatcgcatgagtgtgccacggcgaacaaccacca

SEQ ID NO: 507685 - DNA, 432 bp, Homo sapiens
ggagagtcatgtacaatgagcaactcagttctctgtacaaaacatcaatcatgcggttcggtatcatgcaccaactcagccgagatcctactggtagcctatcacagggaggatgtgacgactattggcaagtcgataggacacataatggaacatgggaggggacacatagggaataaaagctggccaccccagccagcagcaacaagctgctcaggtccccttccatggtgtggaagctttgttctcttgctcttcacaataaaccttgctactgctcaccctttggatgtgtgccatctttgagagctgtaacactcactgcaaaagtccgtggcttcattcttgaagtcagcgagaccacgaaaccaccaaaggaaccaactccagacacattatgcctgtacgttataattctaccactcaaattat

SEQ ID NO: 507686 - DNA, 315 bp, Homo sapiens
tggacccacatgaatgagcctcttgacttagagtgcttcctgggcaggtctcattatgatcttccatactcctgtacgtgtgctgacagtgaattcttttccatttcttgctcgtgagtgtaaagacttggtgtccgtaccctgacacgggttctggatgccagctctagagtggcgaaatctcaccgtaggggggcagaaagcccctctgtcgagaagggatcggggaggcgtgccaggtaatgggtcacagcgacaggctttctaagtgggcttatatagttgacagatcacggaaccggagcggagttgagg

SEQ ID NO: 507687 - DNA, 866 bp, Homo sapiens
gaatctaaggcttgggtacgaaatagtaggaggtgttacgaagtccaatggaggcatagatgaagaaggtgctgtccagcgctggacacctaagtggtgcacctccgtacaaggtcctagtcactgtgggatgccaaaaggcgggaggatggcttgagtcgcaggtagattggagacgcagacctgggcaggcgaatagggagaaccctatctctcaggaaaaataaaaaattagtcgggcctgtagtctctgcgacttgggaggctgaggtgggaggatcgcttggagttcaggcagattgagacgtgcagtgagccatgtttgtgccactgtacttcagcctgggcaacagagcgagaccctgtctcaaaaatacaaaaattaaaaataatcccctgctgggctgcggtggctcacgcctgtagtcccagcacttgggaggctgaggagggtggatcacttgaggccaggagttcgagaccagctggcaacatgatgaaaccccgtctctgctaaaaatacaaaacaattagctgggtgtggtgacatgcaccttgtggtcccgagactacttgggggggctgaggcagtgagaatcaacttgaaccccaggagcgcggaggtttgctggtgagctgcacaatcgtgccacttgcactttcagccctgggttgataagagcgagactccatttcaataaataataactaataataatgcccttggtcccacgaggagtccaagaagactttacacgaaggaaggtgttattttcataccatctattcaatccattcatcgatcattcttcatccatattataaacatatttactgtgggccacaaatctctggtattacgggac

SEQ ID NO: 507688 - DNA, 507 bp, Homo sapiens
gcactctaaggatcccatgatagcggatagggcattggaaggactgcgggctctaccgcctgatgtggactctgagtggggtaacagtgaagcaggtctgcagggtgtctctctcacagcaacaagcaggcttacagtggggcaggcttagtgactgtgcctcagttatgctgtacctgggagtgggcaggccctctcccatgtcaccatcaaaatccactgatgagggctggtgggagtcttgagggctgcacccgggtattgtgagttcccctcagtgattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccagtggttcttgcacacagcagggctcgggtttgaatccaggct

SEQ ID NO: 507689 - DNA, 337 bp, Homo sapiens
cagaaacgcagacattatgaggacgatgatgatgtccagagtctgtagaaaatttggatgaggcatcaaagaatgaagctaactaaaagttgggttttgggaagctggcatggacatagatttaacaaatcagctatgtggttccaaagtttaacagacatggagaacatcaccggttactagctcagtaatataaatatttggtatattaataatgctagttggtccagcattttccggtcatttgatttggcatttggcacttcctcccaggatattttttgggtcaaaatatgaagtatgggtgcagttggagggtcttacggtttcaagtggt

SEQ ID NO: 507690 - DNA, 671 bp, Homo sapiens
ggaccgtaagtgtcaatcctgttctcagttaatgcagtatcagtctgcgtgcatattgctcagttccatgagtactggcccatgcatctatgcaagccaagcatacgagagactcattatcgcctccagcacatgacgcagatgcgatctgtagagcacaggcaatgtctattcagagcacagcggaggcatctgtagactctcaatacggtcatcagtcgctagcacttgacacaagatgctgatactcatgcagattgcatcaccatcatctgattatgaacatgcacgtcttacaatgtgaaaagctgtacaattataccattacacgtgtcagctatggtacatcggtcgtcgatctgttccacgcgctctatctaagtctttaggatttggcaatctgaatgcattacacatgcatatactagcacacactgtaaatgtaccgaactgtccgaatgatgttcacatacgcttcaatctgatcgcaagtttcaagcgcacagctttagtgtgtatgacgcgttaataaacacgtgctcatccgtaaacatcactagcaacaatcagaatgcactttccatcgttgatcactcttaggaccctatcagatctggtcatgcgctcatagagcgcaaccttagatcccacgtagctccagccagtggcct

SEQ ID NO: 507691 - DNA, 250 bp, Homo sapiens
gcttatgaaagatgaggatatccactgttccccgtgcagacaaatacagtgatgtggtcaggtagaaagcagttaaaccccagtgcttatggaggggttggtgctgctcccttgcagagcaccttgcttgtgggactcttggaagcataaaccctttgaaaactaaaggaattggtttctggccaacagcttgaaacaaagggagaactttgtaggaacagggattgaggaggcaacataaccgtgggaa

SEQ ID NO: 507692 - DNA, 120 bp, Homo sapiens
  misc_feature (2)..(2): n is a, c, g, or t
  misc_feature (50)..(50): n is a, c, g, or t
anatgaatcttttttcttttttatatattttaaatttatattatattttntattttttattattttatattttaaattttacttgaagttctggggtgcatgtgcagaatgtgcagtttt

SEQ ID NO: 507693 - DNA, 338 bp, Homo sapiens
tataaccaagtgacattattcagtcatttcacatagctagactttagtgatgtgatgattaaaatgataaaagttcatatgttctcaaacttggggtaaactgaggtatttagctacctgggaagatcttcgtaactttgagtgctcctgtgaggagcggggatagcagctacagcaacaatagtttccctgccccgaaccgcttccacaacatagcaatgtggtatagcagctctgacttctgctcccagtaacccatcgttagggcactctagcactatggaggtacccaaggctcagacagtctctatttaagacactttaacaaatacgagtaa

SEQ ID NO: 507694 - DNA, 461 bp, Homo sapiens
cgcctgcaccggcgttgagcgaggtgcgggtattcaaggttcagtcggccaagtgcactgaaaccattcccgagcgggccgacagcacccagatgtgcacgcaccgcgggcagacactggtgtacgtgatggaagtcggcctgggcaacagcccacaggcatttttcgacggcgcgtcggtgccccgtatcagcaccaccgccgtctgccaggtgggttccatcagccagccatgcagcggcgcgggaacgttgatgggctacatctatacgttccagctggataatgtcgaagccggcggcacgttccagtacagcaacacctcgatcaacccaccgcgcaaccagttggtcaccaccctcggcattcgctgatcgccacccatcaattgccttgaacgctcataagctccggaagtcggaccgctaagacggcgacttttctgaacgccgcgattgcac

SEQ ID NO: 507695 - DNA, 164 bp, Homo sapiens
cgtaccccaactgacgtagcccacctgacgtagcccacctgggcaacagagagagactctgtctctgaaaaacaaaaatttaaaaaagtcctattttcaaccattgaaacaaaaaggtatttatcaagtataatccgtttcctacggtctaggtgtggtggctc

SEQ ID NO: 507696 - DNA, 278 bp, Homo sapiens
tttggctgttcttttgtattttggggaatttaaaattcctgggtgggaaggattcaaaatgaaattcagctgggcttagaaaaagtgggacttttgggtcggtccctggatttttcccccgggatttcaaaagctttttaggcccttctgtttgggctaatgtgtgaagtcccccctggtgaggggaaaattttaggatccaaagggttgtaaaatggggttgccccctcataaaaaacaatgaaaataaaattttttcctgggagagcccccctgca

SEQ ID NO: 507697 - DNA, 186 bp, Homo sapiens
  misc_feature (77)..(77): n is a, c, g, or t
taaaacccccccccccccaaagggtgctttgttttaaaaacggaggtgggattttctaaattgggaaattaacgganccgaagccccccccggcaagacttttcctttaaaattttgcaaatttagattaattaaattaaaatttgtttttaaaagccttaaaaaaaaaaagtttttggggaaata

SEQ ID NO: 507698 - DNA, 869 bp, Homo sapiens
cccacgcgtcggcagcagaggattctgggggaagaatcaggagcccctagtcccagtccacaaataagacatggcgtagtcctggttgatgaggaagtttggggtctgcctgaggagatagaggagcttagggtgcccctcctcttgttaccccaaggagaggagacattgttggccaggaggaggtctggtgacgtggcagcttgtgggggaaggaggatgagagtcttctggtatgaggagtttagatgcttggcctggggtccagtggtcccagctatcctgactccccgtccctgaagtgacggagtgcaagtaatgagtgaagagggggctccagattgggcatccctcgtaggggatcctggcagatggttgttcctttcccgcccgtaatataccgctcctggatacctcccttcctaggctagcacgctgtgatgtcctctgatccctgtgccgagcccagtctgcgcctgagtatctcctgatgccgccatgtgcactgcctgaggcgtgttctactacctttgtgcagttggtgcgtcgctctcttacattgggcacgtcccgtgcctcgcgctctcatggcattggcgtaggcgttgccttgggctttttcccagtttcgtccttggactagccccaccacgtgccatgtgagagtggtaggctccttgtcgagtgctatgtcggctttgtcttcgtggcaccttttgcagcgtttgagagtgccttgggtgggcggtcttaaggtgagggccctttcgcattatggcttgttcgtccccttttttggtgccacgacccccctggcagtgcattggtcccccttcccatggtcctttggttcccctaatcatacctga

SEQ ID NO: 507699 - DNA, 280 bp, Homo sapiens
tcgtcgtttgaggacccgaaacctacttacgcagtcactttgtcataggcatttagttgttttcacatcttaggtattatgaatagtactgcagcaaacataggagtgacaatatctctttgaaattgtgatttcaattctttcagagtaaatacccagaagtgggatttctgaatcattaggtaattctatttttaatttttcgggattgatagtactattttctgtggtggctgcactattttatattcccaccaacagtgtgcaagatttcaacttc

SEQ ID NO: 507700 - DNA, 710 bp, Homo sapiens
gtgctgtagaacagaacattaacccttgtaccaacgaagaaatggataaacttggccttgtctaagtggtaagaatgactgtcagatataatatactgtatgtgtacgtttgatttaaatttaatctcgtaatgtatagggggataatctttcccagaaagaaagggatgcgattgttttctagaaacttctttaaaagtgccatcattgagagtacagaatgagtctgagtgtaataggccagagatttatatatagtgagaagtgtcgtaacaatggtgaaaagtgtgccattgtgtcagagttacagtggctctatgtttttcatagtaattcagagtgaacttgcctatttttgagtagtacacatgtgattttaatagtatactttgcccattgtgagcctcgacttgcaaagattagggcagaggagaaaacgagatttttgaatgtaatcttgattttgaccgtcatatagtgtatcattccagaaaggactcttaaacgtatcttaaaagatcagttggatacactaccgtaagatattcaccttaaaatgggtataaggctgagtgaacttcatgccaacctgagaaacatctcatacaagtgctaaactcatgtagcgaagtgtcgtaaaatcctggaaaaacacgtgcccatcctttgtgcaaaatcaatccggtcaacatacttggcgccccccctag

SEQ ID NO: 507701 - DNA, 268 bp, Homo sapiens
cccataaggttatgcgatgtaggtgactgggataatgttttcttttaggatgagtaagtgattctactgaaatcgcttcacatactctattgcctggagctgcacaacgattcacacaccgttcttgttagggctgtcatcccaggaacacagggcaccaggcagcagcatccgggcatgacacatgttcgcatcggtagcatggcaatgtgtccgcaagcacagcaggaagccccccgtgcaagccagcaccatccagacacatgtc

SEQ ID NO: 507702 - DNA, 325 bp, Homo sapiens
ctcctgtgcccaggtcctggaggagagacacttgtggggataggccagccgcgcatcagactgtgaaccccacgaaggagcccattgtggcctaagaggctgccctcctgtgctcagccctgaggacagatgcctccttcctcttttcctttccaaagaagcaagaggccgttgcttctgttggaaatggtactgtacagactggctctactttcccatggccctagcgagtggagttttcaaccaggatcccaaggactttaggggaaggatctgctgtcctcttcaatggtttctgtgactgaacaagtcggtcgaagatttt

SEQ ID NO: 507703 - DNA, 781 bp, Homo sapiens
gggagaccgcagctcctcaggcgcccggtgcgtgtatctgttgggtcggtcggcgtcagggattcgcagcgggcctgtggttggcgtcgtccggccactggtgcgcccccggcggcaggcggagctctcgctcctgtctcccgcggctgcgtccgcgggtctgggtccgccagcgctctgcactggcgagttccggagtgacgctgcagtcccggtgccggcagccacatgccaccgagcggactgcattgtgaggcacctgcgcttacgttcctgccggggtcacgtggtgcgggagcttcggccgcgggtccgagcagctgggcagtccccacagctaattttcctgagcaagtggtacgataatcttgcacgctgatagtatccactggtatttactagtggtttgggccagctgttggaagtggagatgtccactaagatggtggtgagcaataggattggagcccaatatttaccaggaatacgaatgaacgtctatggaaacggcatatcaatggctaccctctcatgagagggactctgatgggggaaattccgtcaaatgtgggccattgtgtgggataaccctgaggacccacgaaaggagaccctgtagaattcgtggttagcacgttcactttattttccagcgatttcccagggggcatcttgggacgcgcaagctaaggaagacggagttagacagtttacccaggaccctttcggagcattctacccgggacaacttcttgccagggtctaaaagcagcatgctcgg

SEQ ID NO: 507704 - DNA, 183 bp, Homo sapiens
caggttgtgtcaaatcaacgtcgggatgctttttggcaagttcttcagctgtcatattagctgtgtcccgtagcaatgcgatgtatttatcttcaaagttagccccatcttgttgggcacgtgcgtaaatacccgctgagaagagatagccgcagtataagggaagttgtagattggcacaga

SEQ ID NO: 507705 - DNA, 919 bp, Homo sapiens
ggcgggtacccgcagagggcctggaagaggtgctcactcatcgccgagatgactgtgtctcacaggccacacggagaagatctgctccctgtcgcttccacccactgagcagccaattgtgcgtggcactcgttcctcctatgacctcagctgttcgcagtctgggaccttcaggcgtggagctgatcgggcgtgaagcttgcgagggctcaccgaaggaccgaggatcgttctagctcgtggacctggagtccgtgatgggcagcagctgggcactgtctgcaaggatgggcgttgtgcggcgtctacaggccccggagtggccctgcagcccctgctaggaaggcccagggacccaaggggaggacgcgagagactcgcattgatctgggatatgtgatgagtcagcatgtcttgctggttgtctggtctttgatcatgcgcccacataatccgcccttggcacgtccaatatgtgaagcgccagactggtccgtattatgaagcttgaggccactgtggccgtgctggacgccttggcgaacgggtagggcgctggtagcgtggctcccgtcaacgctctgtctgcccagtgtacgtagccattgacacgtggcctaggtgcgtcctgacccgcggtcgaaggggcgaccatccgatggtaattccatgtacgatgcgtgcgtccccgatgtccaccattctcgttcctgcgagtgcagtcagctttcacgttcgccttgaactcccacataggggcctcggtcctcctgtgcgtaacgacggagtgcgacgtgcgggaagtggatgctgatgcgggtgccttgcggttgcggtgaggcctccgcgtggagcctgtgggccttccgggtgccccggagtccggaaggagttcttccagggatgacggtgttcccag

SEQ ID NO: 507706 - DNA, 108 bp, Homo sapiens
tcgcaagagatagtcttgttaagaaaataaataaagaagcggaaaggtgagcactttaaaaaagaaaaaataggccaggtgcggtggctcacacctgtaatcccagca

SEQ ID NO: 507707 - DNA, 257 bp, Homo sapiens
tgaagttcaggtttgtacgtggacacttataaaggtcaagcaaattggcaaagtagtccaggtttacaaggaagaaatatgtttatctacaattgaaccgggtccagccgggaaaaggctaatggcacaactgtttccacggtagggcatttaccccagcaaggttggttatcactaggctaaaacttggacaaaggaccgcaaaaaggatcctggacggaaagcaaaaacttgcaagatgggaaggaaaaggccaa

SEQ ID NO: 507708 - DNA, 168 bp, Homo sapiens
  misc_feature (107)..(107): n is a, c, g, or t
gtggtaaaggggacccttttccgtaaccccccacccccgcggttataggccgctccaggggccggctgagcgcggtttttccctacgcatctggcgggattacacgnatgatcgatacttgatagatcatatccgagtattattggatgggatctagacatctgcgac

SEQ ID NO: 507709 - DNA, 162 bp, Homo sapiens
gtatataactggaacatgtgcgttgaggtagtggaaatgatacatgcatctgttatatttccgtgaaacttggaaggggaaagatctgagggagtgggaggatcacataagatcaagggagaattgtaatgaagatgacagagacttgggagtgtgcatatg

SEQ ID NO: 507710 - DNA, 1047 bp, Homo sapiens
  misc_feature (462)..(462): n is a, c, g, or t
  misc_feature (714)..(714): n is a, c, g, or t
gcaaaaccccgagctctgcatcaagctgaacgcaaagtcagccagctttaagttaagctaagcccttactagacgcaagtgggacttagaacgcgcacaaactactgagttaacagcgtaagcgaccctaatcgaactggtcgttcaatctacttctcccgccgccggaaaaaaaggcgggagaagcccgcggctaggttggaatgcatgcgtgtcatgtcgcacatgtgcgaagtatccaagtaatgacaagaatcaccgtgcggagcgtggctacaaacagaggccctaacgcccgtgtgtcgaattagcacttgtacgatggtccgagagtgcggtatccacagtctaggtccccactctcttgaacgcttcatccctcctcagactagagtagtgtactgcacgaaccggtgtggagctatgtactgctgagcaagagcgcatcagagaaggatcatntgggtgacaccaactgataccctaacttaattctggcgcattgagctgggagtcctaggcacgagcatctagagcctccttgattcgaagccgacgcgtgggccagccgaggcaaccttctaggtaacgaccgacatctacaagcgtatatcgtcacagcccgatgcgaatttgtaatcaatcgttccttcgaataggtaaatacgccagtcgactaagtacgcgaggcgtcttggccaagcttggactagnttcccccgtaataatcgggtgcccccgatatggcgtttccccgcataaacaagataagcttctgactctaacctcgctctctcctactcctgctcgcatctgctatagtggaggccggagcaggaacaggttgaacagtctacctcccttagaggggacgactcgcaacctggagcttcgtagacctaaccatttctccttaacctagcagggggttccctaacgtaggggccacgattcatacacatgtccgtgtaaaacccggcatacgataccaaggcccctggagaaagcgaaaaggggcgaatccatatccgcaggggacaagacaag

SEQ ID NO: 507711 - DNA, 193 bp, Homo sapiens
cttcctcttctgcctatttttaaaattttgtggttttttgtttgtttgtttacttttcaaacttttttgttaaaaactaagacacaaacacacatgttagcctaggcctacacaaggtcaagatcattaatatcactgtcttccacctccacatcttgtcccactgaatgtcttcacgggcagaagcaggaag

SEQ ID NO: 507712 - DNA, 409 bp, Homo sapiens
ggtacgacaggttacaaaggatacaaacaggaagaggttagaggaatgagctgagtagggttgttatatggaaccctctcaccaaacccattcttcttcttctttttttttttttttggaaagggagttccgctcttttaggcccgggctgaagggcaggggcaggatctcagctcacggagttcctgcggcctcccaggtacaggcgattctccggcctcagcctcccaggtaagggggataacgaggcttgcgcaaccatgccgggctaatggggtattttttagtaaagcaggggtttctcaatgtgggccaggcgggtctcaaagtcccgagctcaggtgatctgcccgcctcggcctcccaaagggctgagataaaggcttgagccacgccccgggcctcaaaa

SEQ ID NO: 507713 - DNA, 305 bp, Homo sapiens
cacgctgaaatgcctgaaggtcgaatctagagtatccccattcaattgcgcgagccatcgtgcccagccgaaagcagtacgttttcaataacggcagtaatgtacaacggatagtgttcccatttgatcaaatgtgctattattcaaaatagccctaagcttagcacatgatatcttcagagtgcaatatatgtgcaccgaaatcacatttgtgtacttcaatcagtagtctcgattatatgcctttttgctgcatgtttgcattctcggtgatgatcctggcggatgtgcaggatagagcctcg

SEQ ID NO: 507714 - DNA, 147 bp, Homo sapiens
ctagcaggcggtacttagctctcaggccctcttggcttgctggaggagagctgcttcaccacacagaatgcctgtccctaggcaagtatgtgccagtgcctcatgattgagagtgagcatgctcgagcatattccagtagtagtagt

SEQ ID NO: 507715 - DNA, 802 bp, Homo sapiens
gcagacagcctagctggcactttgaggatgaggcggttcagccatgaggctggctgtgctttatctcgtgtgggccctgactgagtgctactggcagtagagcactgtaacaaccagccactggactaccaagagccacaaaaaccaccactcacaggacaaccaccacaagtgcgacctactcagtccatcgtgcacccgacgagtgccactcacaatcccctatcaccacctagcgcatggatagactgtcacttgttctatccaacaagccaatagcgctgcctcgcagcctagtggacgcctcaacctgctcgactcgacatgatcctgccattcacttagtctattggaacatgccacggttcagtcgcaacaagcaacagcactgcgcaccagcccgagtgagttcaccaagttctgcccacccaagataccagctccaccctctccgagtcctagcccgaagcctccaaggagaccattgggcgactactcgtgtaccgatggttcccagtcctgtgtccacctccgtgcccagattccgattcgagtcgtgtcactacccagggtggaggatgcggcctgggtgcactctctgtactgagtcccataaatagccaccggtccagggaaagctgtgagaggtggccatcgccagctgggttctctcattcccctatggacagcctctggttttggattcatggcagggctccaccgcaagttgctaccggagccccttggggcgggtccaagggtcttccccggcagccgggggttccgggccaaggtcctccgt

SEQ ID NO: 507716 - DNA, 737 bp, Homo sapiens
gggactgcacaactcctcatcctggcgagattgctgtcatcagcctagactccttcgcgctgctgtcccgctgtgctggaacaagccctatgactgtgttttggctgtttggctcacctgagaccatgcctcatctctgtgtggaacctgcacctgcatcggagatatcacctcctgctcgtgtgctgtgtgctcaacaagtgccttccatggatgtggagtcacgagaactgtcaactgtggtgaagcggctgttcaatgatccatgaacctcaagttgccatgcacctgtcctgcactgtgttgattggttgtgcctgacttgcatgcctgccttctgacatgcccatgaccttgctgcttggaagccggttgaccctgtgccactgtccccctggcctgctatctttgacccatgaggcacgcgacacaccgaggaagggtagggtgcgctaggccccatggcccccacgcacacccacagccacaccgcaggggctctagcgggcaacttcccatgggacccgccggttgccttgcgcccggtgggctgggggcagccacgcgcccaccaacgcctggctcccgcaacgccgccaattgcctaagcgacaacccgaccgggccgcgccccgaagactcgcctcgggcccccagagggcccacccccagagcccaaccctgaacgcggcaagctgacccccatgtcagacccccgaagcccagctacctccatc

SEQ ID NO: 507717 - DNA, 265 bp, Homo sapiens
tctgtagtcccagctactctggaggctcacttgatcctgggaggttgaggctacagtgaggcatgatacgcctctgtactccagcctgtgtgacacagtgagaccctgtctcaactaagtaaaaattaaactcaaatcggtttccttagtttggaaacttttcaaagaacatctccacgagagctaccttgtaagatgaaaaccagcctggtgcaggggttcacgcccataatcccaaaactctgtgaggcccaggagggtggat

SEQ ID NO: 507718 - DNA, 1566 bp, Homo sapiens
tggggggggaaaaaattataaaacccttttttgtgtctctcccccctcctctctctttgttttttctccctcctctgtgaaaaaaagagttgtgtgtgctacaacaaaaaatcacctgtgtgccccaccaccacaaaaatttgtctgtgtggggagagaggtgtgtgcgcccccgcggagagaagaaaaatggatgtgtgtgtctctctctctgtgtgtgtgtgtagatactctctcccgcgcggtggtgcagtttctctttgtgtgtgtgtgtgtctctcgcgcgcgcgcgccgcggtgtgcgataaaagttctcttatattatattttctctcccacacatacatatatcttcttctctctccccctacatcttattttctctatatataagagagtgtgtctctctctgtgtgtgtgctctacacctattgatatcgcgagctgatgatatctctcgcgcgcgggggcggaggcatatatatatattttttctatactacgatagagagagatatatttattattatcatctatgctctcttgtgtgtgtgtggagacacgcgtgtgtgtctctctctcactatatatatctctctacacgagatatgcggcgctatggtatctctctctcttatatgatgtgtgctgttgtgtgtatctctctcctcccatacaaaaacgaggtgcgcgctgagcacacacacaaaatacaaaacacacacacacaaagcgacgcgacgagagaggcgcggggtgtatatatttatctgctgtggtgtaaacgtgctcccctccgcgacgatgagatgaggtgggtgtcgtccactccactatatataatatataatgcggtggtggtggggtgaggacacccccaccatattattatatactctatgtggcgcggagcagcaaacaaaagcagaggtgtgtcttgtgttatatgttgctccaacaaacatggcgtggtggtgctggtgccgcgccgcactctatcacacaaccagaagagtagttggtggcgtgctgaccccctctggtgtgggtgcggcgccctcttctattagaacaaaacaacacaacaaagaggagcgggggggcgggggcgggccacgtatctactaaatatacagatgactctcctcctcgcggcggaggggggggggcccgccacaccatttctatagatcgtgcgagtcactactcaccccagtgggtttttttgtcttgtcccaaccacaagaggcggggcccccccccccaattacaagggagggccggcgtagcatactactaaaacgacgacgctacgcgcgaggcgggccgcccgcgcttgtatataacccccaccccgccctgcggcaggagcggcgcgacaaacccaccttgcgcgaccgctggagtcacaccgttgagggaggagcgagccccccaaacttagctgcgggggggcggagcacgccactctatgtgacggaccacacacccaccacggacgggagcaccatcccgcctcgggcggagtacgacatctaactaccccaggcgctaagcacgagccgc

SEQ ID NO: 507719 - DNA, 381 bp, Homo sapiens
aactggctgggcttcaccctctgcctctcgggaatatccctccacgttgccctcaaagcccttccagaagcctctgttttctgttcttctccctgtgactcttagtgattctgatgcaggaagtgtgcccggtggctctgctgccgtcccaccggggggcatatgcatgggacatctttccaatggttgtgaggttctctccgctactcaccccacattgccatcagagcaaaccaagaaaaccacgactgggcctgtaactgcggtctctgtctaccccatgaaggtgtacaaagacccccctgtccaagaacattggggagagaccacgaatttatctgctgttccggaactaccatccttaggaaggctacaatgagg

SEQ ID NO: 507720 - DNA, 669 bp, Homo sapiens
ggagagcgtgtgccagattgtgttccaatgccaaagaggacagtctaattttgtacagattatgcttacctcaggtaatcctttaggtgtgcttgaagtgcccttcttggccatataacacttatcttcttcttaagttcggcaatggaatatcttttaagttttaacaaaaactgggaataattatatctatctttattggccgtttactattctaggggtttctgtctgactaaaatcaagtctctggttgtggcttgctgaattaaatatttcatgagctggtgcatttttaagctatagtgaacaagacaccatattaagtacagtgataaagcatctatattctgtaaaaaacacaaaaaaatctgcctagtccagtttttttcaaagaaaaaaaaccgtggctgaattcggccgtgtagtgggaaccgcaaacgacgccttaaagggtccgcgacatattctgggaaaggtactggtataactggggcgtcaccttgactagtccgtctgaaagaagtgtcctaaacgtgccctttgcgaaatcattttggccaattccacaacaaaaaacgtctttggaagaaagcacctcacaggggggcgaacgtactatccttagacaaggttttagagaagattcaagcgttggtccatgtgcgcata

SEQ ID NO: 507721 - DNA, 167 bp, Homo sapiens
ccaccacaccgatccttgccgacgagagcgacggttgtagcgcggttggtgagcgtcaatgaggcgtagttcgcgtacccccgcttctagctgagtagagcactcgcgagctttgacgcccgtagctattcgcaccatctcgtccatgcggcgtcgtgtttccgatg

SEQ ID NO: 507722 - DNA, 878 bp, Homo sapiens
tacggtggctcacgcctgtaatcccaacactttgggaggccgaggcaggtggatcacctgaagtcgggagttcgagaccagcctgaccaacatggagaaaccccactctactaaaaaaatatttaaaaattagctgggcatgatggcgcatgccttgtaatcccatctactgggggaagctgaggcaggagaatcacttgaacctgggaggcggaggtggcggtgagctgagatcacgcattgattccagcctggacaacaggagcaaaatccgtctcaaaaaaagtactagtgagaaaatcatcaagaatatagaaaatctgaaaacaactcaaaaaatcaaattaaaagatacaagctatacacagaaaaaagtacccatggaatattcataagatagaccaagtcctgagccatgaaacaaatctcaacatatttcaaagagttaaatcaatatgaacatgttatctaaccataattggaatcaaactattaatcaataacagacggataatgggaaaatctctaagaaacttctaaatatccatgggtcaaagaagttacaaagaaagtctaaaaatcataaaactgatgacattaagacagaccaccaaatatgtttgatgcagtaaaatccagagggaaaaagaacttatattagtaactgcttacttgaaaaaagttttaataattgccctagttctatcttcagaaggtgaaaaaggaataacctagagggaggggggaccatagcgaacgccagattgggggacatggggaaccacaagaggtttgtgagggtataaacacggggaaaaagaaaaacacgggggaataaagagaggaacgggagaaaacccttaagaaaaagctagatg

SEQ ID NO: 507723 - DNA, 1755 bp, Homo sapiens
  misc_feature (168)..(168): n is a, c, g, or t
  misc_feature (1008)..(1008): n is a, c, g, or t
gctctagagcgtgtgcacgctgtccctgatagggccttccatcgggaggctggaccggccgcagaaccagtggtggagtgctgttggatgcaagcttccttgttgtgccgctagaggcgggaccatgttccctatactggctactatggtgtaacgacggcatggagntcatgcacgatcagtctcaggtatcgtggtggtgcacctctgacagtgctcatggactctaatgtcgtttctctcttgcttgaccagacacgccgtgtgacgcaaaagaggcgctgtggagacgatgtcatttgatgcacgtggcgtgcatgagcacgcggtgccagtgagtgtacccctgggaggcaggcgggggctccgcaggccctggcccgtgaaactctctccacacttcccccggggtagtacttgattgcacggcagagaagtcaacgcttctgcgatgtgcacacgattcacgcagagaagttgcacgatacctgaatgcgtcgcagcctgtggtcgcgtatcaccatggtcggaatgaatataaggagtggctacttccacgcgcagacaacacccatgtcccttgtgcacgaccttggcccattgcgcatattcttcgccgcggtttgaatcgcctgcaaagccatcggtatctctctctttaaagacatcggtgcggtggtcgaagcgtgcacatggcccacgcgttgggccctgggacctgtgggctccccattttgatagagggctagttggcctccttttgacccgacgtctgcgcggtgggcggacagtgcgcggacttcttaaggtccggtggctttcatagacttagtcatgggtgaagagaggggctgttgggccctcgcagcttgcccccatgggccagattcctaggccccccttccttgccggggtttgtcaggggcaccaagaatcacttgccagtttccttgtgcgggagtccattgcccattttgggcggagagcggtgtggcacgtgcgccaaantaccggtcccaaagcaggacttcttcacagaaggacattatttcccatccaagcgagatataagctcttttcaatgggcgttccccctacagggaacacgtggtcttagtttataaaaagtcccgttggtgctcaatctcggtgactctattccacggaagacttccttctataaagaagagtatctcgcgtagatagggcgactgcgtgtgacctatggtccgcggatacacaattaacggagcgcgaaataggggacatctcctgagtaaaggctagaaattcatggcggacaagggggcaagacatggctgagtatggcggaagcccacttggaggtaccaggtaggaacgcgagtcgtcgcgacagaccaggagggatctcggaggagagcgcagggttgagggtggccctccccttggggtcccatggcgggagcctgggcaaggactcgtggagaaaagagagagggctcacttgcctaaaggggagaagtagagaggagactctcacacaagcgcacaggaaaaaacaatgactatagtagagtacataggacgcaagactcaataagaagaaacacccgtgagtaaagacagagacttaattaacaagtagtcgtggagcgacacgaagaagtctctaacaccgagaggtagaccagacacaagaagaggcgcagcacctagtgtggtggtaactcagcgatagttcagaaagactaagagaaatacactacacagtct

SEQ ID NO: 507724 - DNA, 183 bp, Homo sapiens
  misc_feature (54)..(54): n is a, c, g, or t
  misc_feature (63)..(63): n is a, c, g, or t
  misc_feature (75)..(75): n is a, c, g, or t
  misc_feature (92)..(92): n is a, c, g, or t
  misc_feature (102)..(102): n is a, c, g, or t
  misc_feature (108)..(108): n is a, c, g, or t
  misc_feature (110)..(110): n is a, c, g, or t
  misc_feature (112)..(112): n is a, c, g, or t
  misc_feature (114)..(114): n is a, c, g, or t
  misc_feature (117)..(117): n is a, c, g, or t
  misc_feature (120)..(121): n is a, c, g, or t
  misc_feature (129)..(129): n is a, c, g, or t
ccgcctccccctctcgccccgaaccctttactcccgctcgcctcaaactatgcntcccccatnattgggccactntctggaaaaccggaacncaccttaacntccccnanantntcnaannccccgacnacccccgcgtctcggaaccccggactccgagcccaggaacgccaaaacggcaag

SEQ ID NO: 507725 - DNA, 144 bp, Homo sapiens
ccaacctgccatttggcaggctggtcttgaactcctgacctcaagtgatctgcctgccttggcctcccaaagtgctgggattacaggtatgagccaccgtgcccggccagaaacatacatttttactgaaattgccttcaactc

SEQ ID NO: 507726 - DNA, 322 bp, Homo sapiens
cggagcgttccacggcaggaacttcaccttctttccctattttcccagctgactgtcttcttgcatactagatagttagcacatgttgctaagcatatacttatcattaaacatattactgaggatatgaacatcatgacgtacaggacggaggtctgcccttacagaaaaagaacaccagatttgaactctagagaacctgcctcctagtctcacctctactcctaactagcctgcttaccttgggcttgtcccttttcctggaccgcagtttcgccacctgttaacagtgtggggctcgagcttggtgctcctaacatcc

SEQ ID NO: 507727 - DNA, 244 bp, Homo sapiens
ctcccgggcacctctgtttgtccatcagattttatgttttagggccacaactcgagtagccaaaaaaaaaaaaaaaaaaaagagagcgagagatttctaatatcatgtcagcttagagtcaaaaaagtaaacttggtttggtgttcctcactttacaataaagttataagggtggatggggttcctcctcccagaaaggggtagatccccagcagagaattgaccccttgttccaacagtttgt

SEQ ID NO: 507728 - DNA, 394 bp, Homo sapiens
ctcagaaatgtcttgtccaaatgtgtagcaagcaccacgtgtgtgaaataccccatccaccgcgttcatcggtatctgcccatccgagttcacacattgggccttcatgtgaaccttccgtgtaaccgtatccagggttctaatatgatccagtgtgtctatgatatgaagagagcccaccatgaagccagaatatcgtgtcctatctactaaacctgtaatgtgaaagatattcaaagagttctgtaaaatatttccaaccgttgccattcccacactttcgcagacattctctcataaaagccatacacgtgggtaatttgtcggctctcgtgatcccctctctatagtgtaatgcgttgtgtatcgcgcacctttaatgccacaaaaagag

SEQ ID NO: 507729 - DNA, 1104 bp, Homo sapiens
gccttttcggggccctcaccccgacccacaccgcttccattcttgggtgcaaagtggccttccattaacatgtcgtgctggcagctctggtggcctggcgcatttttttcatgtgtgtggtgacaccctggcacaagaatgggtggaggaatggggctgctgcgtcactcccacagcttcttagagagcctgttcgcaaggaggaccgagtgtcacagtgagtgagctggaggagtgtcacgttacctttccttccttgtaacgaagtgttcaaaccacaggttcagagattttcaccagatagtggacgacgaaagaaacacttcaggcgcgtgggcgcgggttggcgcctccttgttggccccaaggctacctcttggaggccgaaaacagggagtggatttgctttggtgccccggagatcggagggcttgcatgttgaaagcctgactttgtgttccacgtgcaacttcacatgacgcttgtgggcaaacatgaagcaaatgagtctccttgggccatagtggagggagaatgaggcgaacgcgaccgcacaacgcatcgcgcaacaccatcgtgacgagtgcgacaacaacacaggcagcacagcaacggacccagtgaccacgcacgccacgacaaacaaccgagccgcaccaccccgcaggcccccaccagcaaccagaaccggacaggaacgcagtagaacacaacaaacagacaagagaacaccaagacacacgcagcaacacagacaacgccgcacacacgcggactgcagaccgcacaagaaggcgccagaaacagagcacccgccagcagcaacgaccgcggggcacacaccagcgccaccgccaccaaacgctccacacgacaacgcgagggagagcacacacgcacgacagagaaccacgaccacacgcaccaacagcaacctgtccaaaggacatccacgcagcacgtacacgcacaggagaaacaacacacaccaggaacgccgcaccaagacgaacgcacgaacgacaacccgaaacagcggcacggaccctcacgcggcgtaggaacacccacgcacccacacacccccacacacatacacagaag

SEQ ID NO: 507730 - DNA, 716 bp, Homo sapiens
ttgttcctctatccgcctccttgctcgccgcagccgcctccgccgcgcgcctcctccggcgccgcggactccggcaggtttatcgccagcagtccctgaactctcgctttctttttaatcccctgcatcggatcgaccggcgtgccccaccatgtctagacgctagccgtatcacaccaagctccgcagacatcaccgaccatagggacttaagaggagatagtaacggaatggttgtggagagaggcagtacaaatgtgatagaagtagcgcccgctgactacacgggtagatgtctacatgaagtgagaagagtgggcgaagcaaggaaggtcgtgatcacatgaggtagtacgtacagaagaggcgaaggtaacggtggtgtgaggtagatgaggaggagtgatagagagagaggtgattggtgaggaaaaggtatggagaatgtcgattaggaaattgtgtcggctacgtggtcaagacgggtcagactgtagagatgatgtcggagttgcatcgactcggtcggataaccgaacgaaggcagagaggacctgacgacgttatgtctcctactgccgaccatggactccgttggctaagattgtcaattcgccgccttgcacttctgctgcccttcgcctccctgttcagattctaaagcctcgtgtcctcgagatcatgggtcctgcttgtccaggctggcaggccccctg

SEQ ID NO: 507731 - DNA, 1407 bp, Homo sapiens
ggacagccctgtcccactcactcttacccctggccgactcctgccggcagctccaaccatgggatggccgcgtcttctctcgcattctgtgtctggctgactcatgaccgtggagctgaaactccaggactccaggggcttgtgaccctggttggtagcccgtcgagaacatccttcagttgtgtcaagtgcctagccagcactgtcggcttgacaatccagggattcaggctcattgatcttgagatcgatccactctacctcctgacaggagtacttgtgacggactatcagaccgatgtgtgcacagaccagtcggacatacgtgtcgtatgcatcgaaaaattctctgggactcgctcggcaaccacacgacgcggcgcatgctacagcatctgcgtagttgcgtaagcacctgcggatcattgaagccctggtattcgtcgggtgccataaacacattcaacgcaatcgagcagccgaagtaacagcgctgttaccaatggatgtagcgaccgcatggtggcaagccgtcgctggcgcacgacgattccaagttgttgaacaggtcctcacagcgcggtacatggcttctacagaatcaacactggtggaggattttccataacactgcttggcgctggctttggaatcgctcacaagagggctggaaaaggctcccccatcgaaccgagcggggcagagtaccccgtagtagtcaatgccaaaaatatggggaacacaactcggttgcgttggttcgaagacggaactagttgaaacgtttttccttccgccaggcccattggggcataagcgcagcgggaccacccccatgctgacagggttcgcaagcgataggcccatggaacctgccgtttatctccccctgacagttgcccagtattgcgagaaagccagacacagggcatacaccaaaggggaacccccttgggcaggcgaaaggaacggaaaggtcccccaaacggaaacagacaacaagccgatacgggggccccggaaagtaggggtcgcaggccccatagatagcccaacagagaggtcgggcaccacaatctccgaaacaactaggcgacagggcgaaatagcgaaagacgcgttggacggtcggcgacaacgcggcatgtccatacggggaaggaaacgggttaagcaagacagggcagcccaccatggcggcccgaggaccacaaaacccagttgttacgccgagggacaacagcacagtctcgagagatagggacacacaagcgcccacagaaggaggtagggcgtcaccgcacccaacggtaaacgcccactatggggacaccgcgcaaatatagtaccaagaaataggtagggcaggaacaccctccgcatgggggcgacaccaagagagggaag

SEQ ID NO: 507732 - DNA, 137 bp, Homo sapiens
acaatagttctggaaaagccactggagacgagacaggtgctaaaattgaacgagcagatggataagaacaaccagtcaaagaaaaagattaaagttcagacttcaaaaaatgaaaaataaaaagtgataattaagaa

SEQ ID NO: 507733 - DNA, 352 bp, Homo sapiens
tcaattttaaaaaattattaatctggtggcgacttttaattcctatttcaaaatgggtttccttgaagaattcaggaaacaactttttggggaagacagctttccttcacacactatttttggggggggggaaaaatttgatttgggaagaatttaaaaaacacaaagctttttaatttgtttgaaacagactttttgcctgttacatttttggttttaaccaattaaaaaagccaagggcattttagttttaaattgggttttccacaagaaaatccccgttgatttgtttgggccttttattaaccgccattttttaaaatttttttcaaaaaaaggaaggaaaatgtga

SEQ ID NO: 507734 - DNA, 207 bp, Homo sapiens
ggaagtatcggcaaatagtgtaggcgaataggacatatcattcgtggcttgcatgtggggcaggggtatatacacgggtaggctcagggtataattgtactgggtcgcctcacaagtcccactacctaaacacataccgtattactcgcgaccaggcagtatcaactcacctgcagctcaccagtagtctaatagaaaacaaccgag

SEQ ID NO: 507735 - DNA, 112 bp, Homo sapiens
  misc_feature (28)..(28): n is a, c, g, or t
cagagggctgcattcgaagaaacccttnctgctttagtcccgagtaggtaatttgaccccgatatatttaagcattttagattctctccccctatttattgactttgcaatt

SEQ ID NO: 507736 - DNA, 709 bp, Homo sapiens
gtctcctttctgatatagaatctcgtttgctaataactcagccacgcaggtgtctaaagcaggtagcgagtaagctgtgccgctaccgtgcttgcgaccacggcaccccgtatgaagcagcaacgagattcccattgacaaaagtctatgtgaataacatggccagaatcaccgatgatagcgatgacatggttctatgcctatacatatcgcctgacctatcctcctcctgtaggtctcttagcagtcctttcagatagagtcacaactttgtcctgcgcttcatggagagagggcatgcagccttcctgggtaaacaaactctcgctccatcgctagagggctgcgcatctactctctactctcgtgttctacccctgagatacgagctgggctcggacgtggggtgcatagggtttccagagacttcatcactgtctcgcaatagttgaaattcttactcaacactacaagacaatagattacaatggggtgcagcgcggtggctcacgcctataatcccagcacctgggaggcatgaggagggcagatcacgaggtcaggagatcgagaccatcgttggctaacacggtgaaactgcgcctctataaaaatacaataaattagctgggcatggtggcgggcgcctgtagtcccagctactcaggaggtgaagcagaaatgcatgacaagagtcgagcttgcatga

SEQ ID NO: 507737 - DNA, 671 bp, Homo sapiens
  misc_feature (19)..(19): n is a, c, g, or t
  misc_feature (21)..(21): n is a, c, g, or t
  misc_feature (62)..(62): n is a, c, g, or t
  misc_feature (167)..(167): n is a, c, g, or t
  misc_feature (190)..(190): n is a, c, g, or t
  misc_feature (225)..(226): n is a, c, g, or t
  misc_feature (338)..(338): n is a, c, g, or t
  misc_feature (359)..(359): n is a, c, g, or t
  misc_feature (371)..(371): n is a, c, g, or t
  misc_feature (383)..(383): n is a, c, g, or t
  misc_feature (663)..(663): n is a, c, g, or t
cgttctctccttaatagtntnttcagattagtactcatgctgagccagttcatagctctacncaactgaactcctcatacactcacaagagtcattgtgtctgtgacacctgacatatccacgaagcgtagtacatagtgtcatttgtgtgatagctgtggttgacnaatgataatgcatgtgccgctantgtatattcagagtagctgcactgccctaaaatcnncctgtgctccatgaagataggtatgactattaatacagatgggctgaattgaatagatattaagtttaattgataaagatgtcttctggctttgattccttgtggttgatanatggctcaaagtgcaatgganaatgaggtaaanaagggagtaaanaaagaatgagatccagtcatttgcaacatgaatggaactgaagattattatgttaagtgaaataagcctgtcacagaatggcaaacatcacatattcttccacttatttgtgggatctaaaaatcgaaacagtagaactcatggacatagatagtagaaggatggttaccagaggctgttaagtgtcatggggggctgtgagggagaggtgaggatggttaatggttacaaaaatagacagaatgaataagatccactctcgtgccgaattcctgcagcncggggatc

SEQ ID NO: 507738 - DNA, 328 bp, Homo sapiens
gtaccgcacttatatgccgcaagggactcacagccagcaggtatattctcccctccctacccccaccaaaccctggaaaatcacagacagtcgtttctatcagctcctcttactcggtctccttcttcatggaaaggcagtcaggatgtctaggctcttctgcagcgcctcctactatccctgtcactcatcttgttctagcttatcattcttgctccctttgctctggcagcaattgtctgtgaactatccgagcgagtctgacctctgagatggccgtcatggaaaactatggctgcctttatcaggtaatctagtatcgtatcgc

SEQ ID NO: 507739 - DNA, 165 bp, Homo sapiens
  misc_feature (5)..(5): n is a, c, g, or t
  misc_feature (49)..(49): n is a, c, g, or t
  misc_feature (68)..(68): n is a, c, g, or t
  misc_feature (142)..(142): n is a, c, g, or t
ggtgnacgcctccctggacaagttcctggcttctgtgagcaccgtgctnacctccaaataccgttaanctggagcctcggtggccatgcttcttgccccttgggcctcacccccagcccctcctccccttcctgcacccgtncccccgtggtctttgaataaagt

SEQ ID NO: 507740 - DNA, 161 bp, Homo sapiens
taaactgcgcgtctgctatatctacatactgctattaaaaaacgcctcggacatgacgactcacacctatatcccagcactgtgggaggccaaggtgggcagatcgcttgagtccaggagttcgagaccagcctggacaacatggcaaaaccccatctctt

SEQ ID NO: 507741 - DNA, 130 bp, Homo sapiens
aaaaaaaacaataaaataaggaatccttttaaagcattgtggagaaagtatttttgggtatgaatgggtgacgggcctttaaatctttcaggaatacatataagcaggaatacttagccggtggttaaga

SEQ ID NO: 507742 - DNA, 364 bp, Homo sapiens
  misc_feature (81)..(81): n is a, c, g, or t
  misc_feature (159)..(159): n is a, c, g, or t
  misc_feature (172)..(173): n is a, c, g, or t
  misc_feature (224)..(224): n is a, c, g, or t
  misc_feature (226)..(226): n is a, c, g, or t
  misc_feature (228)..(228): n is a, c, g, or t
  misc_feature (238)..(238): n is a, c, g, or t
  misc_feature (268)..(268): n is a, c, g, or t
  misc_feature (294)..(294): n is a, c, g, or t
  misc_feature (296)..(296): n is a, c, g, or t
  misc_feature (311)..(311): n is a, c, g, or t
acaactgcagatggtaattatcccccaggatcactagtcaaaggctgcttttggtcaagaatctcaacctgcgtgcctgtntgtgtggcacaccctcctcaggaacagcctcgcaactttccctggaacctccccttccccactacacctggtcctggngaggatattattnncatcagtgaataaaatgctaattttagtggggggctgacaaacagttctcncncnccagtgtgcnccaacatcccctggagagtgtgttggagcncagactcctgtcggcccggcggctcncncctgtaaccccagcnctgtgataggccaaggcgggagggtaacgagaatgcatctctacaaaaaaaaa

SEQ ID NO: 507743 - DNA, 133 bp, Homo sapiens
tacggcagtgtgaggtgagagtgtatgtcgacagctcagacagcatgttcccatcatcatcacacttgaagtcaggtctcatgtatttctggctttattgcttccgagcgtgttctgctgtctgtagatcagt

SEQ ID NO: 507744 - DNA, 885 bp, Homo sapiens
gtgcctgaagtgctgccaccgaaggaagtggtcccagaaaagaagagtaccggtgcctcctggccagaaaagccagaagctccacctcctaaagtgcctgaggctcccaaagaagtgttcctgagaagaaagggccagtgcctcctcctaaaaagcctgaagtgccacccagaaaagtctcagaggtgccaaaggaaggttgtcccagaaaagaaggtgtctgaagctattcctcccaaaacggaagagtcctcccgctgaagtgctgagagtgtctgcaccgaaggaaagtggtcccagaaaagaaagtaccggtgcctcattgcaaagagagccagaagctcgagctcctagaggtgctgaggatcgccagagaatgtggtctcctggaaactgaatcgtgcagtgtctcatcgtaaaaggccggaagtgccagccactagtatgtcccagaggtgccgaagggcgaggtgtcccagaaaagagggtgcggatgggatattctccagagcggaaggtccctcccgtgaagtgacgtgaagggctgccacagcatgggacggggacccagaagtcagacacgcaccgggtgcctcagacacataggcaggaagcattcaacttccctaaaggtggcgtcagtactccccaaactaaaggtgcgcaggaacaaagaaagggggcagggcacctggaagaaactgcagaccgccctgtcacaggtgccgagcacctacaagggggtcctgaacaaaagcccgtggacctacagagcccgagccctggaagaccgagcaccaacggtccgacgagcgacagggcccaacagacacggcatcaccgccaaagcgagcaaacgaccaaagagagacgagccgggaaacc

SEQ ID NO: 507745 - DNA, 942 bp, Homo sapiens
  misc_feature (582)..(582): n is a, c, g, or t
gcggaaccaggaggatggagctgctcatcgccttcgaggtcatcggaggtgaccctgcacacaagggaccttgcaggtgcaggctgccgctctccacgtcgagtcaccaggatcaatcctgtggcccagtgatcgctcactctgctggtggactatacagctccagactctcgtcttagtcatggataaatcaccagtgcgtactagagctctcttttggagggggggacatgtcggcatcgaggtgatgtcttggacctatagataacactgtcgtgccaggatggttaggaatgcccccctcccacatggcctattgaatgacaagttgggtcgcaataggcgggaaggggctcgtctgggcactggggatcgcttggggcacgtacgtctcgcagtggcctctactgaagtctcaccctgggcaaaggtttgcggcgtggctgtagtacgcaaccgagagcatcgaccagtgctcaatgggtcatactgaggattccttggtcctctgaaccgaaaccaccctgtgggatgaattctctagtctagaaccacttcctcgaaaactcgacgtacttatantcgtagaacccttgtggagcaaacacgggtgcgatgcatcgcacctgacagtcgtaccagtcgggccgaacgatgtcgataggaatcgcgggcgagggaggctcgaaggagctctccgcacgaccctagttgcaccagtcatcgagcgtggggctttgtgcggaaaagaggagccaatggtcatgatggaacatgctgcttagaaggctggggggctagcgatgtgcagtgactaccaacatggcgagtgattgggttacccatttggagcggccaattccaccttggattgcccccacggtccgtacagggcaaaatggggcaacaatggaagataggagggtaccctaaggtaggtta

SEQ ID NO: 507746 - DNA, 663 bp, Homo sapiens
  misc_feature (285)..(285): n is a, c, g, or t
gcaattcggcggtcccgcgggtctgtctcttgcttcaacagatagtttggacagtgaacagatccggggactctcttccagcctccgaccgccctccggattgtcctctccggctgtgcttgcctccgggtaccactctattctcgtgccagtctcactgcttcgtgggacgctggcagacaccagttgttggtggctgtgggctcctgtctgtgcgcaagccaatcgccatgagctcccaggattctgtcatgacgttattcgcacgcgacgattggagtgtcnggcctgtctagatcatgcctgtgtcgaatgttgtagccgtgcagggcctctcctactacactagcgctctctcgtgggcgttttagtttcggaccggcggatgaatgtggcgtctgggataggccgtgagccatctttccttcccgcgagcttggccgtcggagcaaaacaagcggaggggcttaccgaagacagtctcccctggtaggaattgccataaccgcagcgtgtggggctgggcccgcagccatacttctttccaatggatcattccaaataaataggcccacggctgaaagaattgaaggttgggggttgaaaacccccaaggaacggcccattgtaaaatgcttgggcaatggtcccttggatgaacag

SEQ ID NO: 507747 - DNA, 632 bp, Homo sapiens
  misc_feature (185)..(185): n is a, c, g, or t
  misc_feature (281)..(281): n is a, c, g, or t
  misc_feature (309)..(309): n is a, c, g, or t
ggaagccggccctttgcacctctacattgggttcccattcagacccaaataatagatgtggattttcttacagacaaagagtgggactgggtcaacaattcccacctgccctgcagggatgtgattgggaaggaattgcaaaaacagggccgccaggaagctcttgagtgggtcatcagagagangcaacccatttcccaacagcattaataaaaccctccccgggtttgtttttgttaaatggtttggggggagggaagaaagggggcagatcccggaantttttcccctttcctttcctttttcccnaccccccctttttactttaggctttaagaagaacagaaaatttttttatcctctttgatattttattgcaaacccccagttttttatgattttttaattgttgagaacaagcccagaataaaattgctgccccagaaggagggtccctccaaagttgaacccttggggaaaggaaaatgcccccacttttttggccagtgatggggaatcagtgagggctccatgatggtcatgttccaagggggtaggacatcattcatgatccccttaatggtcatgagactaaatttatgatcagggaataaaaatgtcagaactgtgga

SEQ ID NO: 507748 - DNA, 797 bp, Homo sapiens
tcggagattggtgtgtaccctggcttgacgtgcgctcctcagaacgtcatgccaacctatgaaagggtcgtgaagatggctgagaaagaaacaccaactccttacttacctgcctgaagaaattctgcctttgataataaatgctataccagcaattaggttggtgaatgtcacggaatgctgcagttcaggggtcttcaaagtgtgttcggatataaaatatgtagtcttattgttgtaaggcattgatttgggcaaatgagctaaggagcttttagacatctgttaaacgtcttttcgtggtaatcgtagaagtcttttacatgttaatagtgtttgaagagaatctaggttaagcaaggagcaaagtgcgcattgttgtgcctttaagtaggggggtgggaagggaaagagggtacttgcacacatagtttgctttttaactgcagctttactttatataatcgttggcattagttacttgctagccctgagatactttcaggaagagtgacttaaatattcggggtgagtaagtagattgggtataagatctgaacttgtcatctgcagaggcaagaaacatatttgacatgtgtgacgttgactgtggaagatgatggtggcatgtacctagtttgtatagtgtctacagtcttcgtgataacgatgatgtagtaaatctctttaagtactttataaaggaacaaaagagacgggggggaggcaaaaatatgcccggaggggccaaagttacgggtcgcagtttttggtaagggggccaatgaaggggggaa

SEQ ID NO: 507749 - DNA, 1141 bp, Homo sapiens
ggacataacctgactgtgatggatgctgtgatggtccaaggacaaggaacaactgagaacttgagggtggcaggtcaagcttccaggtccaggaagctccttacgctttaaaatcacgcgaagcatcgttaagagattgtacatgatagtttaggaagctaatgagaacctaagatttcagattgaaaagaacatttacggtagagcaactacaggacaacttcaaattctcatagaaaccattgaaactcagtggactactcactgtgagaggatatggctttaacagttgttcattgtcaagagtattactcataatgtgccaaatgctgtctagagagtataagtcatagttgtatgtactccttgcatgtttacaggcttctagcacgtgtacttctggtgaagctgacagtatataacaatccagctggcttctggagttagtatttatatttgaatgcatcccgttccttaccatatgttagcaacctgtgcagaagacctacccagacctaactgggaactggctctgtatatcatcatctcaggaataatgagtgcactgttgcttacggtcacttggaacagcctatttggaaggtcacggaatatgggagccatttcgaaggcggctatcctttgaggctcgaaccgaccttcgatgttgggcaaggcccattgatctcaggagaatcgccgggatacaatctgaaggaaagttgcacgacactcagcttgtgaccgcggtcacagaggaggacctggtgagcaaggtaactcatccggaccgaagtggtcggggagctcataaggcggtgtggcccaatgggatccccccatctcgcagctcccgtcgcaaggactatcgtatgtgaaaaatgtactgcccaacaaggtggtcaaggatcactctgatgagaatttggtcgaatatcttccttcacggcgttgacgataaacagcccctgtgttcagttccgcgagccagggtcactaccgggacaacactcacggggaaaggacctagtgtatcacatacatcacgtaagaaccacacatagtcagcagagatagccaatgtcaatgtggtctcccgacatctacattggtagagtaggtccaatagagcacacttaat

SEQ ID NO: 507750 - DNA, 259 bp, Homo sapiens
  misc_feature (14)..(14): n is a, c, g, or t
  misc_feature (29)..(29): n is a, c, g, or t
  misc_feature (32)..(32): n is a, c, g, or t
  misc_feature (44)..(44): n is a, c, g, or t
  misc_feature (51)..(51): n is a, c, g, or t
  misc_feature (229)..(229): n is a, c, g, or t
  misc_feature (232)..(232): n is a, c, g, or t
aatcgtatttattncgcagaagttttttngtncgcaggattttngtgagcnttttccactccagccgtagccctaccccccaattaggagggcactggcccaacaggcatcaccccgctaaatccctagaagtccactcctaaacacatccgtattctcgcatcaggagtatcaatcacctgagtcaccatagtctaatagaaacaaccgaaaccaaataattcaagantgntcattacaattttactgggctctattt

SEQ ID NO: 507751 - DNA, 197 bp, Homo sapiens
  misc_feature (69)..(69): n is a, c, g, or t
tgggtgggagtcggaatgggtgcagctgattggttgggaatgcatcacatcactggaagactgtcctgntgcagtgaggccacctgtgggcagagccacagggaccagctgatgtcatgagtccagaatggactcagtctgaataaacatctaataaaaataaaaactccccagctcttaggtttctacaaccagtg

SEQ ID NO: 507752 - DNA, 176 bp, Homo sapiens
  misc_feature (169)..(169): n is a, c, g, or t
ggtacttgttactgcgtatatccagacaaaactttccttaaaaagacggatgcacctgcttgttcattgcagctctattcacaatagccaagtcatggaaacaacccaaatgtccacggcagatgattggattaggaagatgtggtatatacatgtaacagcgttaccntttccgt

SEQ ID NO: 507753 - DNA, 186 bp, Homo sapiens
ttttaccgttggatacgcatgtcttgcgttcgttgggatcaacgacgcctaaggacaggataagttcgctctcccacagccgggcccagtaccgttagccttcctcccatggaagtctgcgcttctggtccctatcgtaaaatgaactccgttctgccttgaaataaattttgttcctaaaaaaaa

SEQ ID NO: 507754 - DNA, 323 bp, Homo sapiens
ttttgctcttgaggcccagacaggaggagctcaatggcacagtctcggctccctgcggcctctgctcccgccatcaagcgattctcctacctcagcctcccgagcagctgggactacaggcgcatgccaacactcccagctaatccttgtattttcagtaaagatggggtttcaccacgttggcaggatggtctcgatctcccgacctggcgatccgcccgcctcggcctcccaaagtgctgggattacaggcgtgagccaccccgcccggccctattcctttactttcttaataaacttgctttcagattactccgtgcgat

SEQ ID NO: 507755 - DNA, 624 bp, Homo sapiens
  misc_feature (23)..(23): n is a, c, g, or t
  misc_feature (28)..(28): n is a, c, g, or t
  misc_feature (224)..(224): n is a, c, g, or t
cagttctgcgacgtgtatccaanaggangaggtactgttgataggataaagtcaacagacagaagctactatttctttttaagggaaacaagatggcaaacgaagggtgggtcaagaggcatggctttctcttcaattctacctccccttgctcacacgaccaacatcaaccccaaagaggccagtggcatttaagggcagaagaagtaaacttcaggccgggngtggtggctcacacctgtaatcccagcactttgggaggctgaggtgggcggatcacctgaggtcaggagtttgagaccagactggccaacatggtgaaaccctgtctctgctaaaaatacaaaaattaggccgggcacggtggctcatgcctgtgatcccagtactttgggaggccgaggagggcagatcatgaggtcaggagatcgagaccatcctggctaacacggggaagccacatctctactaaaaataaaaaaattagctgggtgtactggtgcatgcctgtagtcctagctacttgggaggctgaggcaggaaaatcgcttgaatcccggaggcgaaggttgcagtgagccgagatcacgccactgtactccaatctgggcaacagagtgagac

SEQ ID NO: 507756 - DNA, 309 bp, Homo sapiens
tgatgagaagggactttgcaataaggaaatgtaagaagtgctggcttaggccgggtgcagtggctcatgcctctaatcccagcattttgggaggccagggcaggtggatcatgaggtcaggagttcaagaccagcctggccaacatggtaaaaccctgtctctactaaaaatacaaaaattatctggatgcggtggcggcaggccccggtaatcccggctacttgggaggctgaggcgggaggattgcttgaaacttttagtgagccactgtactccaggctgggtgacagagcaagactccgtctcaa

SEQ ID NO: 507757 - DNA, 625 bp, Homo sapiens
  misc_feature (80)..(80): n is a, c, g, or t
  misc_feature (261)..(262): n is a, c, g, or t
  misc_feature (328)..(329): n is a, c, g, or t
  misc_feature (341)..(342): n is a, c, g, or t
  misc_feature (349)..(349): n is a, c, g, or t
  misc_feature (390)..(391): n is a, c, g, or t
aactaaggctagtcaggcccgtgttaatcggccgagggtcctcgccatcacatgactcttctcactacatgtgtcgccgnctctgcctgcgtagccccggccatggctctgtagcctcgacccctttgtgcccccggcccgtctccgcgctcaccacgcctgcgctctccgctcccaccttctttcttcagccgaggccgccgccgcctctccttgctgcagccatggatgtcttccactttcgccttggtgcctgtcttnngcccacctgagcatcctccagagcctcgtgccagctgctggtgcagcctctcctgtttgccatcanntgcccagcaccnngtgctancagccatgtcactcctgtgctgaccctgtgggctggagctnngacatgtggccctgctcccagctagtggtgctggtgatggctcgtagactatgggaaactccccccgtgcccctgcccccctggctccctatgaggtccttgtgtgggatgccctggatgggctgggcttccagtgggtgtggtgagcccctggcaggtgatggcttctctgactggatgacttgagcgagttgatttcacatgcttctacctccctctggaggcctccctacc

SEQ ID NO: 507758 - DNA, 376 bp, Homo sapiens
  misc_feature (23)..(23): n is a, c, g, or t
  misc_feature (28)..(28): n is a, c, g, or t
  misc_feature (224)..(224): n is a, c, g, or t
cagttctgcgacgtgtatccaanaggangaggtactgttgataggataaagtcaacagacagaagctactatttctttttaagggaaacaagatggcaaacgaagggtgggtcaagaggcatggctttctcttcaattctacctccccttgctcacacgaccaacatcaaccccaaagaggccagtggcatttaagggcagaagaagtaaacttcaggccgggngtggtggctcacacctgtaatcccagcactttgggaggctgatggctgggagaatggctgtgagccctgggaggtggatggttgcagtgctgctgggaccgtgccactgcgctccaaacctgggttgacagagcaagactccgtctcaaaaa

SEQ ID NO: 507759 - DNA, 131 bp, Homo sapiens
tcactccagactggtgtattgtaaaatcttgtcgtttcaactgtcactctgtgcccctcgcagaatgtgtcttcagtgaagagtgttccctgaaggctttcccacactggctgcattcaaagggcttctct

SEQ ID NO: 507760 - DNA, 229 bp, Homo sapiens
cacgagggcagagctggttttgctggggacgactctccccgggccgtgtttccttccatcgtcgggcgccccatacagcatggcgtcatgttgggcatgggccatttggactcctacctgggcgacgatgcccatggcaagcgtggcatcctgaccctgaagtaccccattggtcatggcatcgtcaccaactgggacgacatggcaactatctggcaccacaccttca

SEQ ID NO: 507761 - DNA, 235 bp, Homo sapiens
  misc_feature (45)..(45): n is a, c, g, or t
  misc_feature (90)..(90): n is a, c, g, or t
  misc_feature (135)..(135): n is a, c, g, or t
  misc_feature (142)..(142): n is a, c, g, or t
aaaaaagaggtcgggcgccttggctcaagcctataatcctaacanttggtgacttggaggtgggaggaggtttccttgagctcaggagtnagaaactagcttgggcaacagggagacctggtctctacaaaaaantaaaaanttagctgggtgtggtggcattcacctgtggtccaagctacttgggaggctgagacaaaaggatcctatgagcctgggaggtcaagactgcagt

SEQ ID NO: 507762 - DNA, 304 bp, Homo sapiens
tcccacggcagggttgtactgttccatgggtgaaggctctaacacggcctgtaaaaactgggtaaggagatgtaagagacatgggccaagtgctaaatggaggaagagggtaatggcagggcctaggaagggcagtagccagtgtgcccagagagttacgaacatcacctgtggccgtggaatcgtgaaagggcgcgtgccgtgactttcagccatgctgtttttctttttcttttgggaagatgggatgtctgggcctctggtcggcccagggctgggatgtggcaggggcgattcatcctct

SEQ ID NO: 507763 - DNA, 119 bp, Homo sapiens
ccgacttgatggctggttagtcccacaatcctaggccgtacccgctcgcagatactgatcattctatttccccctctataaatccgcgcagcctccaaatatctcatcaacaaccgatg

SEQ ID NO: 507764 - DNA, 323 bp, Homo sapiens
  misc_feature (11)..(11): n is a, c, g, or t
  misc_feature (302)..(302): n is a, c, g, or t
tgatacgcccntgtgcccgagagctgcattagtctatatggttctcccagaaactgaatggaatccattggagaagcggtgggataactagccagacgacaatttggcagaataccatcacacccaacgccgattccacgggacccataccagaggatgccttttctgtgattgggtgggatttttccctttttatgtgggatatagtagttacttgtcgaccaagaataattttggaataatttcttattaaataatcaactcttgaactaattttaactaatctgagattgtgtttgttncataataaaagtgaagtgaat

SEQ ID NO: 507765 - DNA, 286 bp, Homo sapiens
cgctcctcagcctcccagaggtagatatctgctgaaaaggtatgtagaaacaggtgggtaaatgggaaaaaggaccagatattgtatgatatcaagaaatgctcttaggagtaatcagttatttggatgatgtagaaaaatattataaatgcacatggtacaataccgggaaagtattgtattaaaaaactacaatacttttaaaatacgtcagtataaaaaatatttgagggccaggagcggtggctcatgcctgaaatcccagcacttggggaggctgaggagg

SEQ ID NO: 507766 - DNA, 233 bp, Homo sapiens
  misc_feature (93)..(93): n is a, c, g, or t
gaggtcgcatcggactctatgtcatagctgtgcctgtgtaaaatctagggcccgctgaaagaatgggtaatccactgaggaatcgcacttgtngaggtcctcacaactctcgatatcctcggcgccaacaccgtttctcaacgtcttgggcgagagcatgcggaagatagtgagagaatggagctcccatgtgtggaaatcgatatcttcttggcagtcgctcgtcatttgat

SEQ ID NO: 507767 - DNA, 353 bp, Homo sapiens
  misc_feature (213)..(213): n is a, c, g, or t
agctcggcccatcttgggcaggagcatccgactgagagtccaaggcggatgacacttgttgatgcatgtgttcaagaatgagacgaataggagataggaatctctctccggaccatcaggtgcccaatcaaacgtggtctttgcgaggagggaggtggcttgatctagggcccgctgaaagaatgggtaatccactgaggaatcgcacttgtngaggtcctcacaactctcgatatcctcggcgccaacaccgtttctcaacgtcttgggcgagagcatgcggaagatagtgagagaatggagctcccatgtgtggaaatcgatatcttcttggcagtcgctcgtcatttgat

SEQ ID NO: 507768 - DNA, 356 bp, Homo sapiens
tcccatccttctggccacgctgtgtcgcccagcgctgatctgcaaaggtgtgatcatagctcactgtagcctcgtacctccagggctcagccttcccaagtagctaggactacaggtgcgcaccaccacgcctggctagtttttaaatttcttgtctagatggatcctgccgtgtagcccaggctggtctttaacgtctaggctcaagctcaagctcttgccttgccctcccaaagtgctgggattacagacgtgagtcaccacgcctggccggtaatttctcattgtgaattgattgggtccctgtaagtcacagagcctgtcctgagtcccttcatctggcgtggccagaagga

SEQ ID NO: 507769 - DNA, 538 bp, Homo sapiens
tcctgcagcagaatgtaagtgtcatgaggtcagggactctgtctgtcctgttcacagatgtgtcctcagcataaggaatagtacctgacacttagcagatcctggataataacaagaataattccaaactaccacttgtacataaataattacatgaaaggcacaaggcagctatcattttctgaccatttaagtgttctatatatacttttttgcattgaattctcaagacaaagtaagatatacaacactaaccgcctttttttttcatagataagaggcatttaaggcttagagaagttaagtgacttgcccaaagccacacagctgatacttggctgaaggaataaaagtgattgggttacatatttaaattccccagggggcaaaaatcaactcaaagtggatcaaaaacttaaatcaaagacctgaaatcattaaaatcctacaagaaaacctggtagaaactctttcagacactgacctaggcaaagaatttacgactaagacctcaaaagcaaatgcaacaaaacaaaaa

SEQ ID NO: 507770 - DNA, 781 bp, Homo sapiens
  misc_feature (222)..(222): n is a, c, g, or t
acagacgatatctacttcgacggcgatatggcggtcgtgctatatcttgacgaggcctggtggcgaagactctgcatggatgatgatgtggacgatagcattcacaaactgaaagagaaagctactactcggaatggtccaggatttgcctccgatgagttgtcccaagcgcagatgcgttaggattatcacagcatcgtagcactatggcgatgaacccangccacaacgctctgtagaaggctggactatgtctgtactggagtccatgaggaagccaccgtagaatacatacacgacccattctcactgtatggggaagttaaaaacattcatgtcaacctccacaggcgaacgtgatatatgaaggggtatactctagctcgatctgaatcatacaatgaagcccaggctgctatagagggactctatggacaggatttgatgggacaacccatctactgtgactggccttttgtccggcgtccacccaaaggctaaatgacacggtggccaaaacgcagcacaagtccacatcggagacgtaattatccggactgtcgtggacaagtagtcttttaaaaatccatttgacctgcagccttggaacataagacttgtgaggaaactgctcgggcatattaaagcgttaccgaaaaacggggaattctagtcgcattaaaagtttcccctttttttttaaaaggaagagggcctttttttttcccctttggcggggcggccacacaatttttacttccaagtttttaaattccccatt

SEQ ID NO: 507771 - DNA, 761 bp, Homo sapiens
  misc_feature (8)..(8): n is a, c, g, or t
  misc_feature (138)..(138): n is a, c, g, or t
  misc_feature (210)..(210): n is a, c, g, or t
  misc_feature (234)..(234): n is a, c, g, or t
  misc_feature (244)..(244): n is a, c, g, or t
  misc_feature (252)..(252): n is a, c, g, or t
  misc_feature (258)..(258): n is a, c, g, or t
  misc_feature (269)..(269): n is a, c, g, or t
  misc_feature (272)..(272): n is a, c, g, or t
  misc_feature (274)..(274): n is a, c, g, or t
  misc_feature (282)..(282): n is a, c, g, or t
  misc_feature (295)..(295): n is a, c, g, or t
  misc_feature (298)..(298): n is a, c, g, or t
  misc_feature (310)..(310): n is a, c, g, or t
  misc_feature (315)..(315): n is a, c, g, or t
  misc_feature (354)..(354): n is a, c, g, or t
  misc_feature (373)..(373): n is a, c, g, or t
  misc_feature (451)..(451): n is a, c, g, or t
  misc_feature (645)..(645): n is a, c, g, or t
  misc_feature (679)..(679): n is a, c, g, or t
  misc_feature (717)..(717): n is a, c, g, or t
ccactggnagtcttctttaaactgtgtatttctgggtctactccagatctacctaatcagaatctctgagggtggtgtctacaactgatttttaaaaaacgctcccaggaattgtttttatactaaaatttgagagcnactggtttaaggtacaaaatatgaccttctgtggtttcactgtgggtctaaaagtgtatatcaaaattattngggaagtctagtcaaatgccatantggtctgtcnggcaatcnatgacncccgacgtccnccncncaccattnaataccccccccnccngcctcgacgtcnccccncccatcatgtacattaaatgttgatggaaacacatgtcnggcgtcccgagtccaaganccatgtcaacccagtcccagacgcattccagtggggtttcctcatatccagcaaacatggccgggtttgctaagagtnctcttgcaaccatcacaccatctgtcccagtcatccgccacacattttctgcttcctttaagcttctcatgtctccattagcaattacaggtatagacatattttccttaattattttaatggaattatagtgcactggctgatgtctttcttcagcagttcttccatggactgttatccatgaaactcctgtngcttcagcctttttgacaaagatctacagttctnttaaggtcatcatggatccttattttaatagaaactgnaaatccaggggtttccacttgattacttacttgtttcaccatgt

SEQ ID NO: 507772 - DNA, 130 bp, Homo sapiens
  misc_feature (5)..(5): n is a, c, g, or t
tgtantgatcgccatcatcatcactatcaccatcatcaccatcaccctccttaaattctacttctacctacgcctaatctactccacctcatcatcatgatcaccatcatcaccattatcaccatcaggt

SEQ ID NO: 507773 - DNA, 183 bp, Homo sapiens
  misc_feature (182)..(182): n is a, c, g, or t
caaacaaggctaagtcacgaacgcacacaaaattcgacaaatctgcgttcacttgacttagcagagcacccgagatgtggccacaggctaaaaagtgcttaagcaaagctgacgataggctggcaacttcagtaccgccaacccgcttcccaaagggcccggtcggctaacttttccggggnt

SEQ ID NO: 507774 - DNA, 621 bp, Homo sapiens
cctcttcatcacccccgctccaggacaggctcagcgattaagccgagcccttgcgtcctagtgaaggggccttgccaacctcagccctcctgccccacatctcctactgctggctcagaccaagggctcccgcctccctcccttcctcctcctgccctatggaacagccgggtgctcatgagtggggcgcgtgggaagagcatgcccgttgcgcctcccgaatagggggtagggagcccagagtcgcgacctcaaggcctaggtgcggctctccttccacacagtttattgcccctcgtccatccccctaatgctctgccatctttgaggtatatcgtcccattctgagtatcacaaccaccgtagagttagatcccatgaatactcgctgttggcggaatgttccgtggacctacagtgaacgtctcttaccgagacgcttgctgtaccgtgacctgtgaccccttccaactacatactggcccgctgtaggggtccatctgcccccctgcctgcacgcatccacgatgtaatccgcacaccctacacgcgcggccacctgtttgcgcgcaactgcgacacgaacatcagccatgcgcactgcagctccgctgccaatca

SEQ ID NO: 507775 - DNA, 114 bp, Homo sapiens
  misc_feature (5)..(5): n is a, c, g, or t
cgtanatgaaacagggcctttccaagtaggctctgggtgtactaagccagcgtgtgcctctggtttagtgagtgtaatagagtccctggcacctttcttatgcaaatagaggct

SEQ ID NO: 507776 - DNA, 1149 bp, Homo sapiens
  misc_feature (347)..(347): n is a, c, g, or t
  misc_feature (397)..(397): n is a, c, g, or t
gccactccacacttagtaccagacaagcttagccaacgcatttaccgcgacagatacggtataggcgatagaaattagtaaacctggcgctgaagtagatatagttcaccgccaagggaaacggactgagatgacagttagtaacactaagctataatactcagcgaagagactaactccgctaataccgtattctgcagtaatgtagatttaacctatcatagaatagaactttgcaatggagaagaccgaacacgacgtaaaggaaccgccacggataaccactacgaaacgcatggcctagcgcatagaaggagaacgaaggcataaccacagggacggcaagncacaccgttacttgatttgctcatgcaagagatactacgatggcgtaagngattctaagtgaaggatagaaatggcgagctaagaaccctatcgcgaagccatgggtgaattaggcttgggatgtcgttccagaggaacttagcagagtctgtacgttgttccaccacttcttatacaattgttgcccgcttacagcacatcacgcatgcgttagagagtacccgcctttgtcaaaaatttttgaacactggtgtgaggtccctagaagaggggaaatcagtggctcctgttgggcaaccccctgtatggtcaaacataatatcccatgtgatcaggtccgtaggaagataaacacaacgactttttaaacaacccccagtaaggtaagggcgcttacagacacggccaggacccatccaagtttaaacgaaaaagccggttcaaagacttccaaatcaagccccagcttaacgcgtaagaagaaatcccgccaaaaccataataaacttgaaacctccccttcaacaaccccaaaattgggacccaaaattctaattcaacgccctattaggacacgcaaactacatggttctagctaattaaaaggtaaagccattgcagaaacacaatttccttcgcttctcgagcggtaaaagcgctgcggtccagcaatctaaagaaagcacttggaaccctgtagcgaactgtaagcgaggcccgaaataattctaacaaatccgaaagccaacaaagggccatttattacccctccaactggtcaagccccaatcaacacgggca

SEQ ID NO: 507777 - DNA, 398 bp, Homo sapiens
ccgaagtggtgtaaggtgtgcactgggcaatatatgagatcatcactgttgaggacgttattgaagctacccccttctatacggacacacgcggtcagctgactgaactgatacttattgcaagagcgctcgaggtgagcatggggttagaccctggcagtgctactgacgtccggtctgcctattaagccactaatgctgatgctgacggtctgtaagacaggtagttcattacaggaaatgggctgtcgattaaagaccagtggggagtcgggctcggagactcacgcctgtgatcctagcactttgttatgccgaggcgggctcacgtggccaggtgatccagactccgcagaagactggcctgtctcctattgcagccatagctgagccctggg

SEQ ID NO: 507778 - DNA, 163 bp, Homo sapiens
  misc_feature (63)..(63): n is a, c, g, or t
  misc_feature (65)..(65): n is a, c, g, or t
  misc_feature (71)..(71): n is a, c, g, or t
  misc_feature (80)..(80): n is a, c, g, or t
  misc_feature (93)..(93): n is a, c, g, or t
  misc_feature (96)..(97): n is a, c, g, or t
  misc_feature (116)..(116): n is a, c, g, or t
  misc_feature (138)..(138): n is a, c, g, or t
  misc_feature (148)..(148): n is a, c, g, or t
ggaaaagactcatatcaacattgtcgtcattgggacacggtagagttgcgggcaaggtccacnangtacgncccacgctnatctatataatgnggnntgcattcgacagaaagaangacttgatatttttgatgaagnaggatgattnagattggttaaaggg

SEQ ID NO: 507779 - DNA, 441 bp, Homo sapiens
tttttttttaaaaaataacctagactatgcaaaacatcaaagtgaattttccatgaatgtttttaatattctcatctcaacattgtgatatatgggcctaacacccttttcatattcatctttccctcatttcaagtgaattattttaatctttttctctctttccaaaaatttaggaatgtttagtgtaattggatttcgctatccgttcccatccttaagttttgatattcaatatctgatagatacactgcatctttggtcatgtaagatttgttttcaaatgtccaaattatttagagcataggctttataagcatttaaaaaaactaatggaggttaaccctaaatccgatgtcccatcattttacgtgttgattcctgtatgtgtatttttattctaattaacttttgtgttccagaataaacaaaaaaaaaaaa

SEQ ID NO: 507780 - DNA, 156 bp, Homo sapiens
cacacacacttcacagcatatggggtgaagaaaaaatgccagagtctgcggtgtaacatggtgtttccactccgccgctgacacaagtgtgcagcagggatgaccttttgcacaaggactgcacagttcctgatcctagagaaagaggggatcctc

SEQ ID NO: 507781 - DNA, 296 bp, Homo sapiens
aaatatagaaatgaacaattactggtatctttccattcttatttaagctacagtagagtctctttagaaaagagcacatggaatagacacatatatatgctaaaaggttgagtgcagagttctcacaggggaagattctttcatatttttaaattttcttgaatctggtttgtggcatgggaaaatagattgtttcttctttgctttctgatttaacagttagctttctggtaacaataattaaagaataactatcaaatttcttttctttttttttttttttttgaggtcgacgc

SEQ ID NO: 507782 - DNA, 400 bp, Homo sapiens
  misc_feature (48)..(48): n is a, c, g, or t
ctagaggatccgcagttagggctacctccctctggtggtgggggatgngtctgcacacagttagacgacgaggtacaggaagaatcaaactcagtcaacattcttcaaccaactgggagtactgtgaggctggacacaggtgctcaataaacaattggggcattgaagaaagtgaaggaaccgatcttgttcatctctgtgccccagcactcggcatgtagcccatgatcgaaaatgcagactgaacaactgtcacactcttttgtatcactagtgcccggcacacagtcagtgctcttcaggtgtgtgggaaagaagccaatgagtgagaagttcccacaccgtctagcagtgaggaaaaaaagaaaaaagtgaaaagtaccttgtttactcccattcc

SEQ ID NO: 507783 - DNA, 710 bp, Homo sapiens
  misc_feature (481)..(481): n is a, c, g, or t
acttgttccttcacacgcctccacgaacgaataggtttccccaggtgcgcccccctgggttccccgccccgacattcctttttggggggccccaccacagagaagcctgtttgcgcgcagggaaccacacttcgggggggtatattttgccggccgagtcccgttctttggaggttggcttcgacggcgctacttagttgcgtgccgaggccagcgctatatctctctttgggtggggacacggcgcgttggatgatatactgggcgcggttcccctcgcccccaccggcgtcttattcgcgcagagaataaagaaagcagggcatagagtagcgagcgacagcgtgagtggtcgtagatagggcagagattcacattcgaggagcactcccacgcgctcgacgccccgggacagacgcttgggtttccccaatgcgccctgtaaggacccattccagccgggccgcacgctcgactcccntcctgtgcaggaccacgcactggcacctgcgaacaagggggctggctacgcccccctccatggaatgcacccaggacaaggcaggccccaccgcaccatcgatatgccccacgatcgcagacgcatgcgtgactgcgggagtaggcccccccgggcggacgggctcctaacagaggaacttaacaccagcattgcgccacacgtgtctcgacataagacagacaatcac

SEQ ID NO: 507784 - DNA, 117 bp, Homo sapiens
caggcagtctagcttcagagtccatcctctccatcatgctacaacctatactacagtcttccatttatattaccttctttttttccctatttttgttcttgtgaaaaagcatttcga

SEQ ID NO: 507785 - DNA, 356 bp, Homo sapiens
atctttctgagtttaacacttgtctctagaggtttgccaggcagcagctctcagaagtttccaatatgctttgcagacatctatagatctgggaattaaagaattcaagcccgaattggtgagaaccagattttactcaacagaaagctctttctaaggaatctgagctgttcatgggtggacagtggtggggcttgagtgctccttgtgaataggatgggccatgcaccctctctgtatatccaccagggcctcttcagaatagggttggtcctggctagaagcgtggtctagaagatggctaagctcttggccagctctcatggggagatatatgatggcacaaaatcgggtac

SEQ ID NO: 507786 - DNA, 566 bp, Homo sapiens
caggcagcccctcgcctgtgtgtgacgtggtcatttgtcaccctgacagtattgatagggctgctgctggcctgggatggaatccactctgctcagggcagtgcctgagagatcttgtccagaaggatgtgggacagtgagctgctcggggacagagttgccctttttttgggtatagaccatgctaccccctgcggtaatgttggctgttgacagaggactgctgtgagcccagcccgggccggagccccgcttgctgagtgtccactccgtgcctccctcctcctctgcacatctcccaccctggggcaggcaccattgtcattcttgaggttcttaggacccctctcaactccccagcgtaccccttcatccactcaccccctgtagccagagccattggtctaacctatgaatctgatcctgtccctctctgcctgttaaagcgccttgggggctccctggggaataacacccagcccgtcctgtcactcttctgtcccctctgagggtatcatgccctcatttcaaataaacaggcagaattgcaggtgcaaagcagctca

SEQ ID NO: 507787 - DNA, 607 bp, Homo sapiens
  misc_feature (585)..(585): n is a, c, g, or t
aagaactagagagaagagcagagatgattcatacggctagcagacggcgacgagaataactaagatcagaggggaaatgaaggacatatagacacaaaagacccttcataacaatcacggagtccaggagcaggttgatggaaaggatcaacagaatggatagactcgttatccagactaatgaagaagaaaagagaggagaatcgaatagaggcaataaacgatgagaaaggtgatatcaccaccgatcccacagaaatacaaactaccatcagagaatactataaacacctctatgcaaataaactagaaaatctagaagaaatggataaattcctcgacacatacagtctcccaagactaaatcaggaagaagttgaatctctgaatagaccaataacaggctctgaaattggggcaataattaagagcttactaaccaaaaacagtccaggaccagatggattcacagccaaattctaccagaggtacaaggaggagctggtaccattccttctgaaactattccaatcaatagaaaaagagggaatcttccctaactcattttatgacggcagcatcatnctgataccaaagccaggcagag

SEQ ID NO: 507788 - DNA, 701 bp, Homo sapiens
  misc_feature (60)..(60): n is a, c, g, or t
  misc_feature (120)..(120): n is a, c, g, or t
cgtcagccccgcaggccttcatggagatggggtccggcgcgcagcagggccagaaaaatnctggaattcagagatcccccccagaaccccgccggccaggagcccagcagcagggctcanaccccagcgagcgtgacccacccctgtgtacccagcaggcccgtagccctctgcccggtaaaaatcagactcggaaccgatgtgtgctttaaggaattttaagttgcatgcctttcagagcctttaagtcagttggtttttattagctgcttggtatccagtaacttgggtggaggcccacccctaattaaagggctaaaaaggaaaatgaggcttttcttctatattcttcctctggcccaataaagaagttgcttgttgtttgagaagtttaaccccgttgcttgttttgcagccctgtttacttgggccccccccccccctgttagctggggttgggccctgtcttttgtagctttgggctggaggggtagatggggggtccattacccctcccataaatatggaccctttttcagaaatggtgcccttttaatgagatggtttttttcctctcataattaaaaaccctggctttagagagggtaaaatgggcccggggccctaggaatttttgtttgttgggtgcctttaatgctccctttttaaaaaagaaaataaagttattattttactccgga

SEQ ID NO: 507789 - DNA, 218 bp, Homo sapiens
gttcacaatgtggcagattgtggtctgagaggattagctggggatctcaggtgcaggaggttatgtttggattgggaattgtaattatttgtttattttgtatcattgtcccactcatttccacataggacccttttctaaaaaaaaaaatacaagaatcttatggttgtaagtgaacatgtagggtacttcccgctccctcatggatgctggaggag

SEQ ID NO: 507790 - DNA, 302 bp, Homo sapiens
cagttgtgtagtctactggacagcactggacatctccttcctatgaactcccaaggcctgtgacctgaatttctttactgtcttttacctgtaggaaatgagggagatgcacagggctttatcccagtgattacaggactccactctcagcgttcagttttaccatccctgttccctcacattttggaacgtcatcgtggttatgaatatttctggttctctcaatgctgcaacccacggccatgcaccgtcgtctgcacaagcttgtcagaggggtaccgacgctcgacattcactcggcc

SEQ ID NO: 507791 - DNA, 277 bp, Homo sapiens
  misc_feature (260)..(260): n is a, c, g, or t
  misc_feature (264)..(264): n is a, c, g, or t
acacaactaagtgactgatgctttcactttcttcacactgcctcgtgggatttacattctggtgtggttgcagagaacagacgatgtgcgaaggatcaagggtaccagatgttgagggctgagaagcagatgggagaggttgtgtttatttttagggagtcacagtgtgttgatatgggggtggccagggaaagcctgtaagcaaaagcctgaagtgggcagtagagccagagggtgcgtcatcgaagaaccaattaggngtancgagctcgttgtc

SEQ ID NO: 507792 - DNA, 408 bp, Homo sapiens
catggctgagtgaagcagaggcttgtgtgtcccgggctctgggattggtcagtggccaggaagctggccctgacagggtggctggcctacagatgaccctggctgagctacgggattttctgggccagatgaacaacctgccctgtgccatgcaccagattggggatgtcaagggtattctggaacaggtggaagcctaccagactgaggcccgtgaggccctggtctcacagccttccagtccagggctgctgcagtccttgttggagagaggacaacagctgggtgttggaggtacctgaagcccagcagctccaaaggcaggttggaacaggcgccggtggctgcatgaggtaaaacgcacgcttggtccctctgcccaaggggtacccctggccatcaacggga

SEQ ID NO: 507793 - DNA, 332 bp, Homo sapiens
  misc_feature (144)..(144): n is a, c, g, or t
cacgaggtggagaccgggtcttgcaatgttttccagaccagtctcgaacttcaaggctccaataatccactcgccatggcctcccaaagccgggtgagccatgcgccaggactgcttttttttttttttaaagcaatcttacgnagctcactggtattaaacttccaaagcttgttaatcacgattttgcctcgtacccaccctgctttttttttttttttccttttgagacagggtctccttctgccacccagactggagtacagtggcacgatccgtgcaacctccatctcccgggttcgagcgattttcctgcctcagcctcccaagta

SEQ ID NO: 507794 - DNA, 969 bp, Homo sapiens
ccacgcgtccgaagctttgttatataggcatgactctcctctttgtgagcctgcagggacattccctttaatgtccatatttctaccagcagtctcttcaaggcagtctaggtttttcctaacatacacctcaaaattcttgcagctttggccaggcacagtgcctcacatctgtaatcctaacactttgagaggccaacatggacagattgcttgagctcaggagttcaagaccagcccgggcaacatagtgaaaccctgcctctacaaaaaatacaaaaattagcccagcatgctggcgcaggcctatagttccagctacccaggaggctgaggtgtgaggatcgcttgtgcctaggagattgaggctgcagtgagctgagattgggccactgcactccagcctgggagacagcaagaccctatctgaaaaaaaaaaaacaactaaagaaaaaaatttattcccagccctgatccatttcaaagccacctgttactttgaaccattttttttccagcagacccccacttttgttttttgggctgtggtaccaacggtcccacagtggggtggttaaaacacataatttatctctcatggtcccgaagggtaaaagtctgaaatcaggtgttgccaccagtgttcctgacactttgggggaaagaaacacctccggatttttctttcgtttggaacaaccacacagaagccgggcccatccttgtgggctccgctgtatccccgcttgggaggctaggggcgattccgaggcggggtcagacccctgtcccgtgggaccttctcttttaatacaaatatcgggtgggttgcgcttgcacgttcgggtgggaaaaacttacggggggtgtggacacaccgcaccgggagactacttcaaagaggggatctgcggcccctaggcgtattattgtcccggctctttctttctttttcttttctgctctctg

SEQ ID NO: 507795 - DNA, 808 bp, Homo sapiens
ccatggacaatactctgatttgctgcgactttttgagtacggtggtttcccaccagaaagcaactaccatgtatcttggggactatgtggacaggggacacagcagtccattggagacgatctgcctcttcactggcctacacaaatcaaaatatcctgcagacttttcttacttctccagagggacaccatgaatgtgcccagcatcacacagccacatttcatggcattttcatgcatgcacatgctcacacacagcacagcatcaccaacattcacaactcatggcacaaactcttcgacagcactgctcctgcacacgtgtttcaccagcatcagccagcacatccgtggcatgcagcacgcatcattctagctagtccatggcagtgtcctcatccaccccagcatcttccacatcatcatgcgcagccagcatatccggcgcaatctgatcgcgcacccaacatgcatgtcacccagcatccaaggtcctcctaccgctcgcactccaacaaagacgcgccctgcacaccccgccatcacacagcatgctccatccaggcctcggcggctgcaacacatgcaccagcaggcagtgacacctctcaacaatatgggatgccagcaaaagtgggatagccaacaaataaaatcccaataaaagccactcgacctccacgggcccctccacaccagtacctgctacgaaggcccccacgtcaaagggctgcgctcaggaccagcactgggaactcctcgaccatatcgcacaggcaccagacgaacgagcaccggtcggggaccc

SEQ ID NO: 507796 - DNA, 1154 bp, Homo sapiens
agccatctataaacagctgcaaggtctagcccttttttttgagtcaaaactgttctgtttaagttcatgaattgtatagttaagcattacctttctacattccagaagagcctttatttctctctctctctctctctctctctctctctctctctctctctctctctactgagtctgtaacaaagcctctttagtatcggtgtactccttggagaagcagtcctttctcatatagagatgtactgtgattcactgaggttatcatcacaagaagggagtgtctcttgtgccatctaaccatgatagtgtgctcaccatcactatgtgcttggaacagttacacatgcaccacaaccacaggctctatcaaacaggtacacgtctcgaagcgaagcgagcaaccgatcatctctcattgtgtgccgtgtggctcaaaaccggaaaacagatgaagcgtcggctctttcagcgggactcacagtcatctcttagagtatcccctctcaagcactttatggaccaatgtgaccgggtctcatgcacaatcctcctcatcctctaaaaactactactcatgatatacaacgtgctggtcgacgcattcatctacacctaacaagtgcccgaccgcgcgagaccagcaacagcaagacagagcaaggtactacctgcactcaggagcaactctggcgtatacaacagccgcggtgtcacacaacgagcgcggcaccgaccgcacacaccaggcgggacaactcgaccaatggcccaccaccacctctacagtcgtccaacgcaactacatcgtcacggtgggcgctgcaccacctaggagcaaccccacacagtgtgttacctccccatcacccttggccgccgctgagcgcgggccctagcatctcgcagctctccaacacagagcgcagatcggagacaagctcgtgcactgcttagctcagtctgactcacggcgcctgcgcaccccactccactcacaaacactaacggacaccacccgacatcgcatcagcgcaccgccgcacacatcgccgtgccccacgccatcaaccaaggcgggcggctcgccccaccagcgccagccgcccccggccccgcggccacaccacacacccgccacccccacgacgacccca

SEQ ID NO: 507797 - DNA, 441 bp, Homo sapiens
tagtcttgttgtagtaataatagtgtccacctaatgatcaccatatgagccacgacctccctgtattgcgaataatcagtatccggagccaccctgtgatccataagccatctgccattctgatgagcaccatgtatctattgcaaagtcccaagttatcatcagcacagaaacccatccatgccgtcttaacggtctccaggtctccctcttctgtcataggccatgaggctctccccctctaggtggtgctgttcggaggaagaggaagattcctgagctctgctatcaccccggccgtctcgtctgggatgcgggggagtctgtgtcctcgattagtgactcattatatcactatctctactagatggatgcatgtgacgcccaactccgagcagtaggcataccgtcaaaagcacctcttccccgcattggaacatc

SEQ ID NO: 507798 - DNA, 137 bp, Homo sapiens
tgtaactactcctaaaaaggttttgattcagatattatagggatgttcacttttgtttttttaagaaaaagaaaatgaaatggaacaaacaataaaagataccagtgtcttatcttaacaaaacaaacacacaaaag

SEQ ID NO: 507799 - DNA, 169 bp, Homo sapiens
tgtatggcaagcatctcaatgtgcagtctcctcctcctcaaattccaaaagacacacggtggcacttgagctcagcctgagagcctctgatgactgtcctggtggaggttctcaaccacagtcttggcagctggtggaggcagtgtggtggtcccaatctactaccaac

SEQ ID NO: 507800 - DNA, 1137 bp, Homo sapiens
gattgagagggatctatccccataaagcgcagctccatatgtacaggcatcaagagtcgctagctgtgctgcgctgcctgttgtgcaccgtactctagaaggactctacgtgatagcgcttgccgggagacctatctggtaaacatgctgcgcagatggtccacaagcgatggttctggccgtcagagcgtcgagcatcgtgttggtttacaagcatccgtacgatgtgatcaactaggtccagcagtaataatagagactttccagatctgttggcaacacctatcaatcagcatcatcatcagagcaagtgatcacacctttccgatcggaggaaaacgcaatcggaggcaaccgtgagattggattgtccctctaccctatttctagcttcgctctggtctgtacaccgtcatctcccggcccgtagtggcgtgaaagttggcctcattgtgctcgcacccaatctctaggtcgcttttcatggctgacatcaccttggtaagtggcattgcactggcccaactgatctatttaattaccgacatagccccgcaggttccctcctggacagcaagatgagcacatatgccacttgggttgcgcaattacaagcaaagggccaattgttaagcatcatcgcgaggttccacagaaggcgttaattttgggagggctaattactcgggtccgatggattggtatcaagcgtctctattattgccttgcctctccccatgacccacccgggacattgagctcgttgggaacgtacaaagtgggtgcgagtcgtggcagcgctatcaacgccagagtgtcgtagcgacctagccgcattcgttgggaggccttttgtcacagcgtttccgggctttttaacctcagtttgctcaaaacacgttccaacttaatttccccgcccgcaacagacgtctgaagtgaggtccaagtggccccagagtcccaggaatgccaaaacgtggccctgtgttgacagtgtgcaacccttatcggccggttttggaacttctcggaagaaggtttgggactttggaggacaaaccttggcgatgcccctccgagttgccagtccttgtggccccgcggttgtggtggttggcctgaccacagcactga

SEQ ID NO: 507801 - DNA, 115 bp, Homo sapiens
tcccttattgagttgtcatgtgactccctgaagcatcactgaaggctttcctacagctactgattacctgggcagctccccagtagatatttttttttttggtagggggaaagtt

SEQ ID NO: 507802 - DNA, 336 bp, Homo sapiens
aggttagagcctgactgagcaacagagagagagagagagagcgagagagagagagcgctgtaactcagggagaaccattagaagctggagggaagcagaaagaatagccaggctggatatcaggaggcagcttctggtacctctgcaccccattgcccacccccagtaggcagcatgaaatatgccagcaggctcaacaatttatcttcttggtatttttcacacgggagtcttcactcgtgtcacccaggcaggagtgcaggggctgcaaacacctaggcctcactgcagccctcgtgcctccggggcccatgccatttcctccggctcgccctc

SEQ ID NO: 507803 - DNA, 136 bp, Homo sapiens
tgtgtgtactggacatattgcactgtttcaggtgtgtctgatgagggaggcagtggtggtggaggaggtggcaaggtccgtgaggaagcgtgccccattggtgggtcccacatgagttacctggctaccacttctt

SEQ ID NO: 507804 - DNA, 291 bp, Homo sapiens
tcagagtttcactcttattgcccaggctggagtgcagtggcacaatctcggctcactgcaacctctgccttccggattcaagcgattctcctgccccggcctccagaggagctgggactacctgccaccacatctagctaactttctgcatttagttggtcgggctggtcttgaactcccgacctcaggtgatccacccatgtcagcctcccaaagtgctgggattacgtgtgtgaaacactgcacccggccttttgttaacttttagtttaagttcagcagtacctgccc

SEQ ID NO: 507805 - DNA, 278 bp, Homo sapiens
  misc_feature (19)..(19): n is a, c, g, or t
tttttatcggatgccaccntctatagtctaataacagaccggcctttactattcaaatcacccaagcagtttctcaggctcttgatattcaatgaaaccttcataccccttactgtcctcaatcttcaaaaaaggtagaacagacaaatggtcttttaaaaacacacctcaccaagctcagccacaaacttaaaaaggactggacaatacttttaccactttcccttctcagaattcgggcctgtcctctttaagtttgtggcatcgataaacaccgg

SEQ ID NO: 507806 - DNA, 1352 bp, Homo sapiens
cttaatcgtgttatcctgatggtggccctctggtggttgtgcccgatatatttcttcgcggccttccgcatgtaaggggtggcctgcccctgcgttgtaagatggaggtttctgcctgtggcggttgtgtccgtcccccactaattgggggggcgcattcgctcccctgccgcgctccccccggcccaccgcgttgtggggtgttgatcctccgcgcgtgttatttgttttggttgtatattaggtggtaccatgctaaggtcctgcgtcggtgagtcctcgcgctccaaacggggttgttttcgcggcctgtttcgtttcgtcccccgcggaagaggttggttgcccccccgctgggaattagcctccccatcaaggaaatattcgtcgccccaactatattgtgttggcaaccacctactggaggtgctgcccggcggagtataagtaaaaggacgcccgacacataatattgctggtaatattgaagatgtttgtctccccgccgctttttttggttggggccccccacaaacaattagggttctgtcctccacgacagtgaataataatataggtacgccccaacgcctggtgctccttgctcgagatacgcccccctgttgagagggtcgttgtccccgcgagatattttttggtgtgccccccatatatatagggacacacatgtgggtgagataaaattgttgttgtgcgcccacaaagagtttgggcttttcccacataatccccggggggttcacggcgttcccaaaccgccccctgtcacacccggtcaatctcgcacttctacacacacagagattttttgttctcctggtgtcttgtggggcctgatacacaggcttctccaacacacaggcacatttccagagggtgtccctgtgtgtgtaatagcgccccacaggggcacacctgttgggccacagggtgtcaccacgttggccacaagtgtatatcacatgtgccacatcccgcacccacatagctcgcacagaacacacacaggagagacacatggttagatttgagaggccccctgcggcacagggcgcacaagttcacacagtttctctggcccgccctagaaggatcccaccatttctcaaagaaagatggggcttctcacccaagattccaatagctgatgtaatttgtaagaacacatggtggctgaaaagcggcgttatccccagatggctgttggggtcaagtacaatctccccagttcctggccctttggacaaatggcgggccctgcactccatgagggcttcccatagtgctgcccccctcttaatactccaccccattaattttacttcccggtc

SEQ ID NO: 507807 - DNA, 790 bp, Homo sapiens
tccaataatcaagggtcttttggaatcctgtatggatttggcccccccatttcacggggaaccctattctggagctttctttcttgctggaattttatggaccagttaagaagctgctcttgtgttaggataaactgtatacccataatgggtgacaacccgtgatggagtggttgcatttaacctcttgtatcttttcccgtcctacctgatggccgtaatctataagggatctttatagtttgaaagtatttggataacttccgtatactttagggtctacttttttatttgactcaccacccttcttaggttctccagtattcccactgtgttttaaaagcctgaagtccgtgagatgaaattcacatccagaatttgaagtaaacttgtaagggaaaataatataaagatacccttggggccgtggctcacacctgtaatctcagcactttgggaggctgaggtggaaggatcgcttgaagcccgagtttgagacccgcctgtgccacacagccagaccccgtctctaccaaaactttaaaaattagctggctgtggtgttgctcaccccatagttccagctactcggggagctgaggccgtaagatcacttgagccccggaggccgatgctgcagtgaactgtgattgttcccctacagtccagcctgggtgacagagaaaagaaaaagaaacattacattatttggctagagcataattatttgattttctggtttttgaaaatttgagttgccataaaaggatatttcagtgtgcgatttcca

SEQ ID NO: 507808 - DNA, 1574 bp, Homo sapiens
ggacgcgtgggtcgacccacgcgtcaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaaaaaaaaaaaaaaaaaaaaaaaaaaaaaaaaaaaaacaatgagagcaggagcgagagcgaggtagacaatgtagaggagtgaagagacaaggacagcagcagacgcaggagatacaagaggaggaggagacagagaacgaggaggggacgcgcaaatgacaccaacaaaggaggggaggacgcaacaaaacaaagaaagacgagaaaaggagaacacgagaggaggcggagaaagaaacaagaaagaagcaaaaacaagaaaagcagcagtgaaaaagagaaaaggaggagaaagggagacaaaaggcgggaaagcaagaacaaaagcaaaaaaagagagaaaaaaaagcacaggcgaaagacaaaaaaagaaaagaaaggcaaggacaaagagcgaaaaagaaaaggagaggaacacaaaaaggagcagaaaagacaaaggagcagcacaaaaggtgggagggagcgacgaacgcgacacgagtacgcgggggaggagagcagaggaaggaggaggaggaggagagacagaacacaagaaagaaagagagagaggggagggggaagacgggagggagcgagggacagaggggaagggaggagaagaagggagaaagaagaggagaaagagagagggccgggacgccaaggagggaggaaggagcgcgggaagggaggggagggagagaagagggagaggggagaagaagcaaagagaaaagagagagagaggcgaaagagagaagaggagaggagcgcagggagagaaaaagagaagaggacgaggggagagaagaaagagaagcaaagacggacgcggaggagagaggaggggagagggagaaacggagcagggaaggagcggagaacacgaagaacgaagcaggagcagaagaaaggagggagagaggaagggcggggagagggggcgagagggaagagaggaggaagggggagagaggggaagagaagagaaagagagaagaggggagaagaaaaggcggagcagggaaagtgagcgaggggaagaagagagaggaaggaagaagcgaagagagagaggacgacggaaagaacacagaagaggcaagagaaagaggaggagaagagggaggagggaagagagagagggggcgaggatagaagagggaggaagcgaggatagaaagggaaggaggagggaaggggggagagagagaaggaagaaagaaaggagaaaggggaagcaggagggacgaggagggcgaggaaggaatgaagagaaggaagagaggaggagggagagagagagaaaggagggacagaggagcagcaaggcggcgggagaaggagagagcaagacaagaggggaggcggagaggagagcagccagagaggggagagagcggcgagatgaggaggggagaggggaggagagaagcggagagaggagggggagaggcagagggaggcgaaga

SEQ ID NO: 507809 - DNA, 698 bp, Homo sapiens
aacccgtcatctactctaccatctttgcaggcacactcatcacagcgctaagctcgcactgattttttacctgagtaggccgtagaaataaacagtgcgtagcttattattcgcagttctaaccaagaaaaataaagcctacgcttccacagaagctgccatcgaagtatttcctcacagcaagcgaaccgcagtccgataatccgttcgtaataggctatcctcttcaacaatatactctccggatcaatgagagccataaccaatactagccaatcaatagctcatcatgtaagtaatcataagtggctatagcacataatacactaggaatagccccctttcacttcgtgagtccgcagaggttacccaaggcgacccctctgacagtccggccctgccgttgcttgctcacgatgacaaaagactagcccccgaatctgcaatcatatagccaaatctctccctcactaaatcgtaagtccgttctcctgcagctctgctgcaatcttagttccatcatagcaggcagttgaggtggattaaaccaaacccagctacggcaaaatcttaggcatagctcctcaagttacccacataggactgaataatagcagttctaccgtacaggcctaacataaccattcttaatttaactatttatattgtcctaactactagcgcattcctactactca

SEQ ID NO: 507810 - DNA, 338 bp, Homo sapiens
ctccgcttcaggttacgctttctcctgctcagctccgagtagtggactacaggcgccgccacacgcccagctaattttttgtatttttagtagagacgggttttcaccgtggtctcgatctcctgacctcaggatccgcccgtctgggtctcccagagtgctgggattacaggcgtgagccaccgcgcccggccctcgcccgactaattttttgtattttttagtagagacggggttcaccgtgttagccaggatggtctggatctcctgacctcgtgatccacccgcctcggcctcccaaaatgctgggactacagacgtgagccattgcactccgg

SEQ ID NO: 507811 - DNA, 244 bp, Homo sapiens
  misc_feature (6)..(6): n is a, c, g, or t
  misc_feature (24)..(24): n is a, c, g, or t
  misc_feature (53)..(53): n is a, c, g, or t
  misc_feature (66)..(66): n is a, c, g, or t
aacttnagccgctcctcctctganagtgccactggctcacccacacggagagnaggcgggggcccnaaatttggtgggtgggcccataggaaagccaagccaaggccctggtggaggtggtgggggtggcggaggaggcctgcagaggggggagtcccaaaggtggtggtggccatgggaattcccagggaagctgtgcccgaacatgggaaggtggagcggctttgtccccatcttcccctct

SEQ ID NO: 507812 - DNA, 439 bp, Homo sapiens
cagcacccccactctactggtaccaatttattgtattagtctgttctcacgctgctgatgaagaccatacccaaaactgggcaatttacaaaagaaagaggtttaatggacttacagttccacatggctggggatgcctcacaatcatgacggaaggcaaggaggaacaagtcacgtcttacatgggtggcagcaggcaaagcaagagaacttgtgcaggggaactccccttttcaaaaccatcaaatctcttgagacttattcactatcacaagaacagcattggaaagacttggccccatgactcaattacctcccaccagtccctcccacaacacatgggaattcaagatgagatttggctggggacacagccaaaccatatcacttgccaacagaaatacaatgcaagccacattagcaaaaagcaaaaaaaaaa

SEQ ID NO: 507813 - DNA, 112 bp, Homo sapiens
aaggtgactggcttgtttaatcgtgtgcatagaacgagccacctcgcttgcgctgaagtcacaacagagtgcagcgcacaagagctactgtggcggacttgtccggccctgc

SEQ ID NO: 507814 - DNA, 161 bp, Homo sapiens
ggtaggtggctttgctctaaacagaatcgtctcagtaatgtgacactgcacatgtataggtaggctcgctcatgggcataaccctctaaaacacaccttttatggagtgaaattcacttaacagccatcttgaagcatatacttcggcggcatttgctgga

SEQ ID NO: 507815 - DNA, 158 bp, Homo sapiens
gtgagcacggatcgggaggagtataggagcaggcgtcttgtgcagagtgtccgccatacttcgtagctacaaaacggctaaaatccggaagccaactttggatcagccctctccggagacgttgtgaagtctgcaattaaaacagtcggcctgcaatc

SEQ ID NO: 507816 - DNA, 671 bp, Homo sapiens
aacacgacggtgacaaggcttctcaacatcaaccccatggcctccatgactttttcaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagaaggggcgggggcgccgcgccgtcgacagtgacacatcagcagaaggcagcgcagcgcaggggggcggagaagaacctactccctgcggagggcaccccacacgggagtggtctgtaacactacactacctgcgcaacatcactaggcagaggggggctgaagtcgacgagaacacaactatacacccccaacgcgaatgacagcctagaacccaacacagaatgacggtgggggagaagcacaacctcccaaccggcgaggacgcacacccacccaacctcagagaggaggagaaaacacagcaacagcgacgacaagcgcaggaaaaaacacaatacgagagcagcgaacaaaagcgaacgggacgcaacaaagaaggacagccacacacaacgaggtgatggggaacaacagcacagcaccacacgagcgcatcttgacgagcgggacgaacccaaaccaggagcaccaagccaaacacaaacaagggagggaagg

SEQ ID NO: 507817 - DNA, 809 bp, Homo sapiens
cacgtctagggaggtcgagttttcgtcgcgcacagtcggttccctgcatactaggcgttggcgggcacaaagaactatccgcggttacaataatagctacttttctattatccgctctacacccatctcccttcttagcccgataatgtgcctgtttcccactactattgtcttttccgtccattcgtaagctagccgaattggcctagccctactacgtcatcaatctccaacacataatgtgcctagactacgtacaattacctctacctactccacatgctaatagctaagtcgatcccaacgatgatactactaccactgacatgactgtccattaaacacatgaatcgtgaatctacacaaccacccacggcctaattattagcatgcatccctgctactattttttaaccaaatcacaacaacctatttagctgttccccaaccttttcctccgaccccctgaacaacccccctcctaatactaagctacctgagctcctacccctgcacaatcactggtcaagccaatcgccacttatccagtgaaccactatcacgaaacaaactctacctctctatactaatctcccctacaaatctccttaatgtataacattcacagccacagaactatatcatatcttcttatatcttcttcgtaaccacacttatccccatccttggctatcatcacccgatcaggcaaccagccagaacgcctgaaccggcaggcacatacttcctattctacaccctagtaggctcccttcccctactcatcgcacaaattttaccctcacgac

SEQ ID NO: 507818 - DNA, 499 bp, Homo sapiens
tgggcccgggtgagaaattttttttttatttccaaaaaggtttaaccccccccgggggggaaaggggggccccggccccccccaaaaaacaaaaagggggccgaggggggaccccgggcggggggtaacgtcactataacaaaacaacaaatctcctcagaagagaaaaaaaacaaaaacaacaaacaacaaaaaaaaacaaacaggagggggcggcgcgcccccaaaggaatacacacccactgcggggggcgcgccacacagtcgtataggcagacacaccacccgacttcttttgtttagcacgaaagggtcgccccataatagtagagggcgctacttctaatacgagcgaacaacaggcccgacggcgcgctagcatacaaccacagcgccgtgcgggcgggacgaaaacacgggtccgagttgagaggctatcttgagagacaagacgcacacaactgtggggggagcgcgcacatcatggtgcccactaacg

SEQ ID NO: 507819 - DNA, 282 bp, Homo sapiens
acagtatacgaattgagctggtacggggatttgtacaggtgagtgtgtaggtgtctgtgttggtgctggcgggtgttacatatagcgtcatgattgtgtatatggttagtgtgttgtttatgtagtggttagtatgagtgagcgttatgtattggaattgatatcagatggttaggcgggaggtcattatgagggcttaaagggtccctgtgagggttcatgagctgcgatcactatatgataggcatgtgattggtgggtcatggccaaagacatccttcg

SEQ ID NO: 507820 - DNA, 359 bp, Homo sapiens
gagacagagtctcactctgtcgcccaggctggagtgcaacggcgcggtctccactcactgcagcctccagctcctgggctcaagtgatcctcccacctcagcacccccaagtagctgggattatgggtgcatgccaccatgccgggctaatttttgtatttttagtagagctggggtttcaccctgttggccaggctggtcttgaactcctgacctcagccgatgcacctgcctcagcctcccaaagtgctgggactataggtgtgagccactgtgcccggccagagcttgcatttttcttatcttcctttgctgtcttctcttctatctctttcttctttcccttctgtcgtcttctc

SEQ ID NO: 507821 - DNA, 521 bp, Homo sapiens
gtcatccagcactgctcgagcttaaatccagacttgacattggcctgaagaataatcttggtcaggttattcagcctctctgtgcctcaatttcctcatgcataaaatgaagattgtcatggcgcctactttgtatggtaaaaaatttagacaagttcctggcacttcataaagattatatcagagttgcttattataatttcttgattgtttgataaaaggtacatcccaagacatatgagtactctggaatgcttccttgtatgtggagtttaagaactaatgtaatatgatgctggatgactttttaagaaatgcctctaaattcagacaggaatacgctaacacatacccttatctatgcacaaaaggaaaaataaatccaggagtaagtggggaacttggcaggaaaattattttatgataaaataatctttccagtcagtttccctccctgactccttccctgcctccaacccctcctatccccacccagccccccttgctttgagaactttggg

SEQ ID NO: 507822 - DNA, 172 bp, Homo sapiens
  misc_feature (39)..(39): n is a, c, g, or t
  misc_feature (129)..(129): n is a, c, g, or t
cttgactacagcggctggaggtagggcacgagtcgcggnggatgaggacgcaggagcggctctccagtggcactggctcaggcttctcttgcactgcatagctgccggaggccttgatgtacatctggncgtactgctcctccaccatggtcagccgctgtagtcagcatcg

SEQ ID NO: 507823 - DNA, 920 bp, Homo sapiens
gtggtcgaagcgcggggggatatgacaggcggtcagtgcgacggtgcgggtggcgggggccctgggtgtgagtggtggtgagagcggaacactggcccagtcgttgcccgttgcggacatccctgtggcgccgagccggtggcgtctgtgcgctgctccgtggccaacacgtctaagtgagtggtccgcgcaacgttggccaggcctgcagaaggtggcaattcaggtcaatctcttggggggcaagggtacgcttggaaaatgggcagcgcgtggcaatcccggccgcccgtcgcggtcagcgtcggccctgctgcgttattgcgttccttaaaaatcgctcctcagaagacagcgaagaggtttccacctgggcactgtcggttgcacggggctttttctggagctttgttggtgagaggcgtctaatcgttcatctcctttcgtgagtttctccgacaaagttgtcagggaacccaacctctcctgccggtgatctgtccctcgcagcagccttccatccgccttccgtgatgttggtgatgatgtcacccacgctgatcgtcagctcatcatcgtgctgggcctggtagtcaaactccactatggcctccaccattggcgtcgagccgggccgggccgccgaggcagcgtgaaagttggcggaggcgggcgtgggggttggggcgccgggatcggggcgctgggatccaggcgcgagggtccggacgcggcggcggctgggccggcttcttcctcagtggcggcggcggcggctcagcgccgcccgctgctgcctctgctgctgctgccgctgctgccccggggcgactcctgctgctgctgttgcatcgcggcccaatgcgcccggctgcgccgggtttcctgctccccgcgagtggaaattgcgaaaaaaaaaa

SEQ ID NO: 507824 - DNA, 115 bp, Homo sapiens
agcggggaacagtcactttggctagcactagcaaaagtgaacaaataggattacatgaagtgaaaaagcttatgtacagcaaaggaaacaatcaacaaagtgattgttccccgct

SEQ ID NO: 507825 - DNA, 150 bp, Homo sapiens
ctgtttgtgcaattactgacaaccgcagttaccagagttttcaattccttacctgcaatctgaaacccaaaaagaaatctgaaaatgggggggggcggggggactgctggagcatgaaacctgacctgtggcaaaactcaacctgaattg

SEQ ID NO: 507826 - DNA, 166 bp, Homo sapiens
tgctccaggctcagccagaatggagacggcaggctctgcttctgagagactaccgagcgttgaagaagcagaggtgcccaagccactgccccagcctccaaagataggggacgaggacatccagagcatactcagaacacggcaggagcggaggcagaggcggcag

SEQ ID NO: 507827 - DNA, 221 bp, Homo sapiens
gagtcagactcataagagtgagtcccccttattcctgacacaaccaatctgcaggcgtagttgttcacacagttgtggacaagaagtaatgatgtgatgcattgatgcgcatgaaatcatgccgtccctgcgggattcgtgagtcaaaaaatctgaacagcctgctgaacaaatctctagactctgaattcccgcggggagagtatcatcgcctggcaacg

SEQ ID NO: 507828 - DNA, 257 bp, Homo sapiens
gggaccttacaaaccaaccgccttttagactcctggtgcgcagcatcatgcatatcttgctagtaagtcggaggtgtcaggcacgttgagaaccgctcccgagaacttgctcttgaagtagatcaagcgtggaggctcgcagttaaggaggttgagggtgccttcagagttcaggagccttatcctccgcaggccgatggtctgcacccactccatggtgcgcacatcaaagacgtccacgccaaaccctgcgtacg

SEQ ID NO: 507829 - DNA, 354 bp, Homo sapiens
  misc_feature (30)..(30): n is a, c, g, or t
  misc_feature (44)..(44): n is a, c, g, or t
  misc_feature (50)..(50): n is a, c, g, or t
  misc_feature (56)..(56): n is a, c, g, or t
  misc_feature (94)..(94): n is a, c, g, or t
  misc_feature (99)..(99): n is a, c, g, or t
  misc_feature (143)..(143): n is a, c, g, or t
  misc_feature (159)..(159): n is a, c, g, or t
  misc_feature (188)..(188): n is a, c, g, or t
  misc_feature (194)..(194): n is a, c, g, or t
  misc_feature (251)..(251): n is a, c, g, or t
  misc_feature (262)..(263): n is a, c, g, or t
  misc_feature (265)..(265): n is a, c, g, or t
  misc_feature (280)..(280): n is a, c, g, or t
  misc_feature (303)..(303): n is a, c, g, or t
  misc_feature (307)..(308): n is a, c, g, or t
  misc_feature (318)..(318): n is a, c, g, or t
  misc_feature (330)..(330): n is a, c, g, or t
  misc_feature (339)..(339): n is a, c, g, or t
taacaacaaagcatgctcagtattgagacnctgtcacgattcangttatnccatcnataagtgcattattgtcgactttttttctgtcaagatntaganacttctatatcatattcgtccttttcttcaaaaaagaatttcanaaaagatggatttganacactcaccatttaatcatttccagtcanaatatntatttggctgaaattatgtcaaatggactgtattatacggtttgtttgctgcttttngatggctacgnntncggagagagcaatcntgctgtgaaacagtgtggatgtntatnntattcggctnactcttactaancatcatttnccccttttttaattt

SEQ ID NO: 507830 - DNA, 288 bp, Homo sapiens
ctagttttagaagtttcaataggcaatccctcttctggggtatatccccgaaggggaatgagattatctctgcagctcccaagtttattgcagcacaattcacaatagtcaagatacagacacaacctaggtgttcatcaatgggcaaatggataaagaaactgtgatatagagagatcaatagatagataattagaatattatttagcctttaaaaagaaggcagtcctgtcattggccaaaacatggatagacctagaagacattatgctatggaaacttctaaaa

SEQ ID NO: 507831 - DNA, 299 bp, Homo sapiens
tgtatcgatgccaccactgaaaaatcaagagacaggagaaaatgctcagaatccagtataatccttcttgacttacacaaaatgagacaggaaaaagaatagaaaccctttgacttttgcttttagtctgcgccaggttgacaaagaataatcttagggcgtgcttaatcttggcttgggtgttagatgaagctttgaaaatgttttgaccctaatccatggctaagataccgatttgctattctgtaacaatgatcctgaaaagagccactctaccaagagaattctgcttccttcct

SEQ ID NO: 507832 - DNA, 293 bp, Homo sapiens
agataaaggtagaatttaccattgaatccccagaatgcagcatagggcctggctcaaagaagactcaaaaattatctagcgaaaagataagtggatgaacctgctgttgacgagagcacacaggctcctatgagggagctgcctccaggaggactgctgggatgaggggacagggagtgtggaatgacagatgtaaggaattcaagaggaccacacacattcagtgatgacgggactcagagttaaagaaacctaagtcacaataaccatgaggtgctgtgttttaacaggat

SEQ ID NO: 507833 - DNA, 265 bp, Homo sapiens
tgtcggtcacggtgttgcgctcccgccggtgttgcgctccgcgcgtgttgcgctcaggatagctggtctctcgcagacctgagccccccgcacgccagtttctccggtaaagcgaatgattagaggtcttggggccgaaacgatctcaacctattctcaaactttacctgggtaagaagcccggctcgctggcgttgagccggggtgtggcaatgtgagtgcctaggtgggccactttttggtaagcagaactggcgctggggga

SEQ ID NO: 507834 - DNA, 233 bp, Homo sapiens
gggaaaaaaaaaaaaggggcccttcctggggggttccttttttttcccccattggcccccccgcccggacttttggcccggcccccagggcccaatttggttttccctcgttccccttaaaaggtcccaaaccgggtttttaaaaaatttttttttgtttccttaactgaatttcccaatggcccccttcctttttaattttttttgggtaaaaaaaaggggcgtttttttta

SEQ ID NO: 507835 - DNA, 527 bp, Homo sapiens
  misc_feature (430)..(430): n is a, c, g, or t
  misc_feature (432)..(432): n is a, c, g, or t
  misc_feature (454)..(454): n is a, c, g, or t
agcacctgtccaggagccgcctccatggttcatcgaaatgtgatctcccctcactgtagaagcgccgtagaagcccacgatgtaccgcgagttgatctcgtgcatgacctgcagctcgctgatgatctggttcgcgatggccggcttgatctcaaggtggatcagcttcctgtccatgatgaggcgcgagggtctgtgctggactttggtgaccacccgcgccgttgcccgcgcccagctctgagatcctttcgaagtcatcgtctttgagttcgccgaccttggctttctgggtgagaatagttccagccgcttcttctgctgctcgtcaagttccagctcctccagcttcttctgcaggtccaccaggtttcctcggagggccctcgctggtaggggatggccctcggcgatggtagggttgatgggnangcggcagcacggcttctccggnagcatcgggctcgcgggcgggcgggcgcctctagccggggccatagggggcgggccgggagcggtacggccta

SEQ ID NO: 507836 - DNA, 602 bp, Homo sapiens
aactaccaccccatgcaatgtacatcgaagaggatatgggttatccaagtctacactctgaaactacagtgatatgtcattccaaaatgctagggtaaggggtggggggtatgagaggggggcgggtgcggggaggttaattttctcctaatacagaatatggaaatatttagatgagaagcagaatgactaaaatatcagggatccatttaatttttctctccaagaatagaaaacgtgtattataggcttccaaaataaaagaagtggatcaaaaatcgaaacacagaagagaagaaacaaatcctaagtgcgagtggtgctatggttacaatggattcagcacttcagacgcactggcatccaagggtcactggcttatttaagatgagctaagaagataaaaagccagacacagccttaactattggcattccaatgcagggctatatgtgctggtaaggcattaggaatggtcctatcactctactggaagcaccgggattttcttttctattattgaataagggggaaattcatataaatgacgtcaaggtatagcaaccactcccaagtgactactagttgccaatagaaatact

SEQ ID NO: 507837 - DNA, 145 bp, Homo sapiens
ctgagagaggagcaagaagttcttctgccagatggatcctggacttgctcctggacattcctgtcatcttagagatgctctggcacttgtgatgatggaattcacatcctttagaactgtgagaattaaattcccgttcagtata

SEQ ID NO: 507838 - DNA, 119 bp, Homo sapiens
aagccatgacatcccaaaaaaggccagtgaattactcctaggtcggcttttaaagaggggccaaagtgttttgtcaaaacacttgcttccattttcagagataaaaatcattcattcca

SEQ ID NO: 507839 - DNA, 592 bp, Homo sapiens
ggttttttttttccttaagagcgatatatttaatacattcacaagattcgaaatgaaaaacaaacattattcatgctacaggtttttaattttccttggacaacaccaaaaacacagtactcaaacggcatgtttttttttggttttttgggtttctttttgagatggaatcccactcctgtcgcccaggctggagcgcaatgggcgcgatcccggctcaccgcaacctccgcctcccgggttcaagagattcgcctgcctcacaggcgcccaccgccacacctggataattttggcttttggttttttttttggaaacgggtgtctcactctgtgttcgcccaggtttaaagttgcaggggcaccatctcagttcacgtgcaagctccgccttccaggttcatgccattctcctgggctcaggctctcgagtagctgggggactacaggggctcaccaccaggcccgcctaatttttctatttttcatagagaccgggggttccaccccgtggtacccggatggtctcgattccctgacctcgcgctcaaccgccatggcccccaaagtgctggcacccgggcatgacccg

SEQ ID NO: 507840 - DNA, 374 bp, Homo sapiens
tctgcgcttactgctattctatggtatacagcacatcagctagagaggcagaggatgacagcttacaatatgacgcaagagatcttcgagaatatgtggggtacctgcgagtaacccagtccttgtctatgaaaattcattatgagcaaatctcacctcacattaaactcctacatgatctaatttcactatattttctggccatcatttagggagtagtcgtcccttaagtacccttcggtatttcgaagttgccacgctcggtatcaaacaggggctgcttcactgtctgctctctgtcgggttagtgttctatcaagcctgtcagttgcaacttgtttgtttatttcttttttgttagaaatcgaattttg

SEQ ID NO: 507841 - DNA, 204 bp, Homo sapiens
gcctggagggatcgtaaatgaaggcgccactattcttccaccctttcaatgttatagctttaattggcaactgcgcagccttctaatctaggcttgtgctgtggtcttgtgcttctgttaagaaggttctggaagaagctcctctgacactttctaaccaagtgtagagccaattgctatttcgccgggttagagagaggtgag

SEQ ID NO: 507842 - DNA, 953 bp, Homo sapiens
  misc_feature (1)..(1): n is a, c, g, or t
  misc_feature (214)..(214): n is a, c, g, or t
  misc_feature (831)..(831): n is a, c, g, or t
ncccggcgtgggtgttggctttgagccccctggcccgtgcggtgccagccccgtttttatgtgggggatgtcttcccctgggccgcccgtgttgggagcgcccccttggcggtgtgccgagggtatcccccaaggtgtggatgttatctgaacgcggccctgtatttatagaccgttggttcgtggcacgccttgtcgcgtcttgtgcgaacancgcacacagtgctgcacggtctcgtccccgcaaccccccggttgggtgtgccttgtgctgccccgcggcgattagggtaccacgacgcctggcgcaccacgaaataggagggcgtggccccccgaaccccccggagttagcccacttggggccccgcccccgggtggttaccctcgtggtgaaaagaaaagatgtgtgcccgaaacatcgtgaataggcccgtttatgatgtttcccacgtgaggacaccccgggagccgggaagcccaatacccccccccggcgcccacctaggagagccaccagagtgattccagatgcgcccaccactgctgtgagcgccacccagagacctggcgccaggtgggttgggcgtgtgagtaatattggtgtgatattgttgaaaaaataacaccacgatcaccgggtggtacccccgggttgtttccagcttccattgacccctgaaagatagtgggatttcccatgaacccccagaggggggtcttgaggctgtgtgaaatcccactggcccatggaattctgatggagcgccgaccctccgcagggggtgtggacctgctttgggggaggtctttaaatctattgtgttaacntgtaccctcccgagcccccccgaagctatggatccattaaaattatgagaatttccaaaaaaaaggaaaaaaaactcgagcatcaacgtcggtccgaaagggtattgcccgcgtggtgggtg

SEQ ID NO: 507843 - DNA, 308 bp, Homo sapiens
cactattacttctttttctttcctcacaacagtgagtgcgcggtccacaaccatcagtggccctctccagattgacatgatctaggtgtgaccggcctctccctgctcttcagcaggttatcactctctccattcaatcctcgcaaagcagtcatttcaaaccttttccattcctcttaagtcttcaatgcattgggacttcagaaattacctatttactgataagactgagggcaggcgcttgtacgaagtgtctcctatttctgaaactttgtgttgttactccttcctgaatgcccctctgtctc

SEQ ID NO: 507844 - DNA, 521 bp, Homo sapiens
ccgcccccagcccacacaagatgtcagaggatttagcacagcagctggcaagctacaaagctcagctccagcacggtgaagctgcattatctggaaacggagaaaatgaagatttgctaaaattgaagaaagatttacaagaggttattgaactaaccaaagaccttctgtcaactcaaccttttgagacgcttgcaaggtcagacaggtttgcttctactcaacctactcattcatggaaagtacgagacaagtgtatggcagtctggagtgaagatggacagtgttatgaagcgcggattgaggccatagatgaagaacaaggcaccgctgcaatcacctttgctggatatggcaatgctgaagtgactccactggtgaacctcaagcctgtacaacaaggaacgaaggcaaaggaggacagtggctaccaacccatgtgagagacatgattggccagccagcgtgatatataaagacgaaagctttgaaactgctctaagaatagaagccttgtgccg

SEQ ID NO: 507845 - DNA, 674 bp, Homo sapiens
tgggccgtgcgcggcttgtcgggttgtcggcttggcggggtggcggctaccggggtgggggtgggccgggtgtgcttgttcgcgctcgtgtgtgtgtccgtgtccccctgcgggggtttaccccgggggggggcgacgcggtggtagccgttgggtggaggacgttggtgcgtggtgtgctgttggcgctgtgatggtgtgcgtcttttggcgtgccggcgagtggggctgtgttctgcccccctcggcaccgtgtgcaggctttcgctcgccagtgtgagggggccacggtgtttcgcggtaggaggtcaggggccgccttggatgcatggtgtgtgtctccctatggggctctctgctgctgtttctgcccgtgagtagggttcgtcttctcttgctccctctctttgctcatccctcgcccgcgtccagcctggtgtgtggcaggcgcggtacgttgcgccgccgaggtacgccgtgtgttcgcgggtatttgcacgagtggcgtcaagagttcggtcgcgtgggtggggatcacacgtggtcgcccccccgtgtgtctgcccccctcttgtttgcccccgctcgcgggtagtgccgccgcagtgccccccgtattggatggactgttggctgtttgtttaagaaaaaaagccacacgaaccaacataaca

SEQ ID NO: 507846 - DNA, 926 bp, Homo sapiens
gtgacctggatgtgagacatggagtcaaaggagaccattttggagctttaagatttaactgccctgctggatttcagacttgcatggggcctttaccacttcgttttggccaacttctcccacttgaaatgggtgtatttagccaatgcctgtacctccgttgtatctaggaagtaactaactagcctttgattttacaggctcataggtggaagggacttgccttgtttcagatgagactttggagtatggacttttgagttaatgctgaaatgagttaagactttgggggactgttgggaaggcatgattgatttttaaatgagaggacatgagatttgggaggggccaggagagaatgatatggtttggctgtgtccccatccaaatatcaccttaaattgtagctcccataattgtgggagggacctggtgggagataattgaatcataggggcagtttctcccatactgttctggtggtagtgaataagtctcacgagatctgatggtttaataaggggtttccccttttgcttggtctcattctctcttgtctgctgccatgtaagatgtgccttttgccttccaccatgattgtgaggcctcccagcacatggaactgtgagttcatttaaacctctttttctttcaaaaattacccagtctccgggtatggtctttatcagccagtgtggaaaaccagactaatataaccaatccttctaccttcttttattttctccagtgtggaaaaatgcctgatgaaaaggttgggggcctcaaaagattccaatcaagtgctggattcatactatttaccgcgctgtgaccctgaaaagcgttaacttgtaagccctgtttctccagtcaaagcggaaaaagccccccccggttgtaataatcccctttttggcggccaaacg

SEQ ID NO: 507847 - DNA, 246 bp, Homo sapiens
ctgactcagtctattagaccctgaaggcaggatactcttcagatatcgacgatatgcctttgattaatcattctaccctcttgccattccaagcattaccaactatgtggcacctcctgaaagagagaggccttcgaattctaggcagccacacttactaaaatccccaggtgctcatgaacggttcgcagctcgccccgctgagacgaacccacgttgtgagcggggatggtggggggtggtcca

SEQ ID NO: 507848 - DNA, 243 bp, Homo sapiens
cagatacgacgacactctgaacatgatcatattcaagatattttatgctgcagcttatgtggagacccgctctaactacccgaattctgcttcaaatgccaaactgatcatagaatggtcaacattgagtttttcagcaacttcttttatggtagataagaggatcagcttctgtgattgatctcccgaactggttcggttgtcaactgctgtatggccggtcatagcttatccttcatcttc

SEQ ID NO: 507849 - DNA, 227 bp, Homo sapiens
gaaaaagggccaaaaaaaatctatcccccctgaaggggggttaaaatttttggggaaaaaagaaaattggtttgtttttaggatttaggggaaagggccccacttcccgcaaatggatttgcaattatggggttgatgctttgggaaaaaaatggactttttcaagggaaactttcccttttaaaaagcctgttttggggtttccaataaatgatatgaacccccca

SEQ ID NO: 507850 - DNA, 282 bp, Homo sapiens
cacgagggctactgacacacacacagtagccattagttaaacacttcttactgaatatcaggaacatcccaactgtgcttaaccagaatccaacaagtcagcacacacgtgattttattgttattttgttgtaattacgtgcacttgtggtaattactttcacctgcagcatttggagtttataaataatgttaagggttctactacaaatagtgtcataaggccaattacctaccacacgaacaatcagcagatataattctggacgttagattccttata

SEQ ID NO: 507851 - DNA, 332 bp, Homo sapiens
  misc_feature (229)..(229): n is a, c, g, or t
  misc_feature (267)..(267): n is a, c, g, or t
  misc_feature (316)..(316): n is a, c, g, or t
aaagtcgctctgttacacaggctggagtgcagtggcatgatcttggctcactgcacctccgcttcccagattcaagtagttctcgtgcctcagcctcctgagtagctgggattacaggtatgtgccaccatgtctggctgatttttgtatttttagtagaggtggggtttcaccatgttggccaggctggtctcgaactcctgatctcaagtgatctgcctgccttggnctcccaaagtgctgggattacaggtgtgaccaccacgnccttgccttaagaattgttccaagaggaatctgggtgccacttgcaggngcccatttgaagtgca

SEQ ID NO: 507852 - DNA, 353 bp, Homo sapiens
ctcgatcttcattcctctgcgtcccagagggttaatgtagatcgagtatgtcacctctggctcctaaaggtctctgaagggccaggtgcggtggctcaagcctatcatcctagcactttgggaggccgaggtgggtggatcacctgaggtaaggagttcgagaccagcctggccaacaaggtgaaaccccatctctactaaaaacacaaaaattagccagacttggtggtgggcgcctgtaatcccagctactcaggaggctgaggtaggagaattgcttgaacccgggattgcagtgagccaagatcgcaccactacacttcagcctgggtgacagaatgagactccgtctt

SEQ ID NO: 507853 - DNA, 907 bp, Homo sapiens
ccgctggtacggccaggatttaggatgtatggaccctacgagcaggtcaaacgggacccggaagctgaaaggcgtcgcagagctgggagtgaccaagcgtgtgagcgcccgagggcccgcgggattccgctcttcatcccccttagaccttttctcgggacccctggccctgatcctccgtacccgccgccctcctcatgatctttttcccaggaagaagatacagcagcaaggacaatagacaaagctgaaactcctggcaagcaatgggaacgtagcataaaatgaagcgcaggaggcagaacgcggcgcggcctggacgaagtcggacccctggcccaggcggtccttctgacgaaaatgcatggagtaagcggctacaatggacaacggatccttaaacgatagtgccatcacaaaacccaaccaagctagcagagtgtgatggactctcaacccatgacttacctgcgacacacgtcacgtgcaccattcacgacgattctccaaagtcagcctggcacgaagttagccgcctgcccccatgtatcggagcacgctactcgacgggtgtcgcaacagaggccacgactggggcttgtgctgtgctgtccctttggtgatactgctgggaatacgtggctactcacacccttgcatcttgctgctacaagactgctttaccgaacctgtgtaccctcattctggaacttgattagacgtccgatcgtccttgtactcagtttaggctgccttgcgccgaccatacacgaaccactacccccttgtccgctccgtgcatgcgacacttccgtacgctttttccccgaggctgcgccccattgtggtgcctgtgtcgtggtgactcgtttcacccgacgtcgcttgtcctctctgcgcccccccc

SEQ ID NO: 507854 - DNA, 144 bp, Homo sapiens
agattatgttgtgcgacctatcccttcgcctctatcttgcaaactctctggatcctgctgctgctgcaggctggggatagagcctcctcaaatccaaatgctaccagctccagctcccaggatccagagagtttgcaagacaga

SEQ ID NO: 507855 - DNA, 690 bp, Homo sapiens
  misc_feature (29)..(29): n is a, c, g, or t
  misc_feature (35)..(35): n is a, c, g, or t
  misc_feature (61)..(61): n is a, c, g, or t
  misc_feature (64)..(64): n is a, c, g, or t
  misc_feature (68)..(68): n is a, c, g, or t
  misc_feature (84)..(85): n is a, c, g, or t
  misc_feature (98)..(99): n is a, c, g, or t
  misc_feature (108)..(108): n is a, c, g, or t
  misc_feature (115)..(115): n is a, c, g, or t
  misc_feature (137)..(137): n is a, c, g, or t
  misc_feature (143)..(143): n is a, c, g, or t
  misc_feature (152)..(152): n is a, c, g, or t
  misc_feature (163)..(163): n is a, c, g, or t
  misc_feature (211)..(211): n is a, c, g, or t
  misc_feature (216)..(216): n is a, c, g, or t
  misc_feature (222)..(222): n is a, c, g, or t
  misc_feature (224)..(224): n is a, c, g, or t
  misc_feature (228)..(229): n is a, c, g, or t
ctcataaagaaaaatagatatggttaggntaatgnccaggaaaatattttataaaagtctncanagtnacacgataggttcatnntgattgtgcaacnntgagctaanagctccnctttttggttgtggttggtgtngtggtngttttcagncagggtgtctntctcccaccccacccttgccccacctgcaatctctctctctctgtctngctcncaccangncagnngtacagtatgcagtcatggctcactgtagccttgacctcccgggctgaagtgatcctcctgcctcggcctcccaggtagctgagactgcagatgtgggccaccatgccctgctgattttttgtatggagttagatggagtttcaccattttgcccatgttcaccatgttgctcatgttgctggtcttgaactcttggctcaagcgagctgcccacctcacgcctgtaatcccaacactttgagaggccgaggcgggtggatcacctgaggtcaggagttcgagaccagcctggccaacatggcgaaaccccatctctactaaaaataaataaattagctgggagtggtggcgggcacctgtagtcccagctacttgggaggctgaggcgggagaattgcttgacccgggaggtggaggttgcagtgagctgagattgcaccattgcactccagcctgggtg

SEQ ID NO: 507856 - DNA, 165 bp, Homo sapiens
  misc_feature (72)..(72): n is a, c, g, or t
cgtggacgaatgtgtctggtgatgggattgtcactagcatgtgctctattcaatacgttactggctccacanctctatgctgctctgggggccatttgtttcaccctgttcctggctcacgacaactgcgctgcagtgagctacgatagtgccacggcactccaa

SEQ ID NO: 507857 - DNA, 110 bp, Homo sapiens
gagtctaagatccctgctgctcctcttaattctgctgctctctctccagcgtgaatctgctctgtagggcagagttctagagacatgcatgttactgatggtttttatgt

SEQ ID NO: 507858 - DNA, 325 bp, Homo sapiens
cacaccacctgagtccgtttataagcatttgcggtggacgatggaggggcccgactcgtcgtactcctgcttgctaatccacatgagcataacagattgcagtaaggcctggagggagccaccgatccacaccaagtacttggactctagggtggcgatgatcctgatcttcatggtgctgggcgtgcaatcccagcaccattggaggccactgtgggcaatgcacctatagttggtggtcacagaccacaccggccaatacggggaaaggtctttgcggctgtacacgctacacttaatgatggatttgagggtggtctcgtgg

SEQ ID NO: 507859 - DNA, 150 bp, Homo sapiens
  misc_feature (13)..(13): n is a, c, g, or t
  misc_feature (68)..(68): n is a, c, g, or t
gattttaaatgtnctcatcataaaaaagggtaagtaaggtgacagatatgttaattagcttgattttnatcatgtcatgatgcaaatatatttaaaaaacacaatataccccataaatatataccattatttctcaatttaaaataaaaa

SEQ ID NO: 507860 - DNA, 253 bp, Homo sapiens
  misc_feature (9)..(9): n is a, c, g, or t
ctataccanggcttgttcgtgggccctgcatcaccactgacctgtgtccaatcctgtgctgccatcacactaatttaatcaccacaactctgtgctatactttactatctaagtaaggttagcacccatcatcttttaaaacaattttagaattcttgcctactattctttcaagtgaactttatgaccatgttgacaaatctcaaaataaaactattctaaaagaaaaaagaaaactattttaatatgttgg

SEQ ID NO: 507861 - DNA, 224 bp, Homo sapiens
ggccggcccgctagaggtggcatatatattgtacgtatatatgtcaagaaatgagtggtagtactataccaactaaaagatgacatgtaagaaatataacaagaagaaacataacatagttctactaggggctcagcacaacacaccccgtcatataaaactaagcacactagaaattaaactaagcaactaatccggtagacactgcattagaaccaccatga

SEQ ID NO: 507862 - DNA, 167 bp, Homo sapiens
cacgagggacatttcagaacctactctgaattttcattcagctctcatattaataccagaactcattgtgatggcgaaagtggggatcaattttagaaacttgagtcatttgaacatctgtctcgcgtggctaaatgattctgccaactcagcgtgcctgatgccta

SEQ ID NO: 507863 - DNA, 273 bp, Homo sapiens
ggcctacagagacccaagggatgcccagaatagggccaacgagtagactgtcctgcagctaagagtcagttcctcgaggcagagtgctgtagagcagcacagacatagttggtcaccagatgacgcaagtagatacagggcgcgcattgtgggtagcgagtgagagagagtctgaaccacaccgcaggctatggtggggctatagctgctctcactgatgatgatgggacagctcagcatccgtaatcacaggagcatatgccttaaactctc

SEQ ID NO: 507864 - DNA, 249 bp, Homo sapiens
gaaaataacgggtgggtttcggttccaaataaggcccctatggatagtaaaccttgagaagcttttggggtcagatttctggaccatcatgtgatgaagctgccatttttaaaaatcaaatgatcctttatcttttcagaaattagtcaattttataaagaaaccaatattgaaattttgctctattttctgatcaggaaactgattgtaaagctttttgccaactaataaatgtcttggtaattgcta

SEQ ID NO: 507865 - DNA, 836 bp, Homo sapiens
ggccacggcatggagaatggctccgcttctgttgcagctggcggtgctcggcgcggcgctggcggccgcagccctcgtactgatttccatcgttgcatttacaactgctacaaaaatgccagcactccatcgacatgaacgaagagaaattcttcttaaatgccaaaggccagaaagaaactttacccagcatatgggactcacctaccaaacaactttctgtcgttgtgccttcatacaatgaagaaaaacggttgcctgtgatgatcggatgaagctctgagctatctagagaagagacagaaccgagatcctgcgtccacttactgaccgctgatcagtacgtcgatgatggcagtaccagatcagacctcaaagggtagcttcacactattgccagacactattggcacacgtgaccacagtacgctgtgataacccctggttgaagaatcgtggacaaaggtgcgacgcgattagcactgggtatatgcaggttctccgacggcagaccaagatccttatggcacactgctgaatggaggccacaaacgtttccagatgttcggagaacacttagacaaaggggctaccctgattctaacagcccttgggcctaactcaacatggctatagcattgtggatctcgaagctccattccagcagcacagaatcacttgctcagcgttctttacttccggtactcttctcatgtatgggttcccattttcctgctgtggtcctaagtgtcaaggcaactcagggacacacagtgctggtccacaacttatttactcgcaaagcagcttcacggcaccttcaacactctagacgt

SEQ ID NO: 507866 - DNA, 366 bp, Homo sapiens
tgcaggaagggtgaaaacccacgaagctgaagccctacacgctgtcgaggaaaacgcaacaccatggcgggtgcctcacgacaagagacacttacaatagaatcaaaactgattcaagtcatacactgaaaggacaaacggaaaaaggaaagagatcacatatgatccgaaacaatcgcaataagagtaagatgctgaccttctgctggccctccaccccgagatacctgagggtgagctggtgctcctgcacagggacgtcctcaacattaagcgcaccccgcctgttgcacacttctaatcctgaggtccaccaccaaactctggcttagcattgagcctgggaagtgcccagatggtgacagg

SEQ ID NO: 507867 - DNA, 142 bp, Homo sapiens
aatggggtcacacatcctcacggtagtccaatagagcaaccatgcatctggatacatgttttcaccaataaagaactggtagtattgaaattagcaaggatgtgctatgatttagttctgcagcccctgtcactaaaaggtt

SEQ ID NO: 507868 - DNA, 871 bp, Homo sapiens
catgcagaaagcttcaaattgatagaaacaataatgttctatacgagtgaccggattatggcgtttggttgggccgtacacttcgtttattctgcggtgaagtggaggcttataaggttaaaacggaaggaatctaacttagtgtccaccagtttatacagaactcacagtacctatgacttcttttaaactaggatctgttagcaaaagaatgtctgtttcaggagagatgaccgtgtacaataccgtgttggtgaaaaaggaattcagacttatgtaaattgatgaagcttgtttaatgcgtgtgctcagatgtctatttatcagcacaatattacacgaggatgaactgttgatggcagtattgaatagatttatcctgtaactatacacttgggtctggaacaagatgaaaaagcgaaggataagaataaaactaattagtgtgggggtgggcaagaggacgcttgatgaaaaggttggaaatagagtgacggagagtggagagggcggtacctttagtaggtaactgcattaactggaggcagataactggttgggccatagcgagagagacggtggggcaagaaaagagcgggcgcgaggtttttgggagcatgctgataaagaacgagtcgggggggtgaacttcacgtaagtttttctggaggaataattgccctggtgaggtgaatcgctgggcggagtcatctgtggggtaacatttcacggtgggggtgcatactgagtgatagacgaaatgaagaaaaagcccgggggtgtcccgggtaaaacaaccgttggacaagtgctggacagcatgagtatctatgacgatattgatgtggagttgtggcaaataaggaaggat

SEQ ID NO: 507869 - DNA, 367 bp, Homo sapiens
atcagcagataaagcaagaatagctgagtcactgactgccacagacaccttataaattatcttccctccctttcattgtttgtttcctttcctcacacctctccagcccctgtggcaccccccagcagtcaggacacatcccttgactaattacgttaatcttattatacattaaagccgagtctcagccctcaacaacctccgtagctgccagtgtaagacttaactcctaggctctcttgggtctcttcttctcctcgttccttctgtcactccaggtagaagctagatcctctgcaattctgctttcaacagccatggttcagaccggtgtttctcaagttttttttaatgccctttctggtgt

SEQ ID NO: 507870 - DNA, 719 bp, Homo sapiens
gtcgcccaggctgaactcctaccaggtcccggcccgccccgggccgcgaggacaccggaggcacccccgggggtggggagcggagccgcgggtcagctctgcgagcgccccgcgctggcctgtccggccgacagcgccgccacgtcggacccattctatctctatcaccaagctcatgcaacgcgcgaatccatcaccgctaccccgtccactctcagttcgaccgaatgcgtgcgcaacgatacccacaccccaagcctccgcctcaacccttcccctcccacacacactccatatcctctcctcagtcatccctctcctcccgccccaccatcctactcccctcgtccccccccacacacctccagcctatccacccattatccctatccaaacacctccagccccttactatcacgccacccacatctcttccaccacacaacatctttcctacaataaccgacgtctgctccctatcctatcacattcttttttaatctgttgctcaactcttctattaccttccaccccacaacactaaccacctcaccacacacgacacaccccacaaatccatccacgcaaccacacaaaccttcgccaacacttccatatcttttactcctccgcactcactaccctcctctcattaattccttataacccttatcccagctctatctcattatatacacctacctttatacacacactta

SEQ ID NO: 507871 - DNA, 1413 bp, Homo sapiens
acccacgtcgttcgcaagctctgactgagcagggacatgcgcactgtgtgggtgggacccagactgtctgacctggagggtttgcctggggacctctcccacccgtatgcccctaccagagcttgcgtagccatcatgagcgcctggcttctccggcctcccctcaccgcagagtttctggtcctgatgctcccgctcctgtgctggcacttctgtgcgtacagcaagagccagggcgacacatggactcgagccacccatcaaccggttggcatgcctaaacgtgttttgctgtgctccctgttcatgccgagccgttcgcgctagcccaacggctctggcttgacgacaccagattggcgactaggctactctagacgcgacgcattgccgagtttagcccgctcgctacttatgggcgcgctagcgctagtctttttcgttccgttgctctaggctcttctaggcttgtcctttgcttttctcgctcaggcatcgcgtatcgcccgcttaggggatgcggacactggggtggcgagttgcgccaccgtggcgacactatttgccaagtctacctatcgttcttatagcttcactttcggctaatcccctccaaccctctgtaccccggtcccagtcttccctcctttgtgccacctctctactgtttgccccatcttatcttggcttgggacccttttgagccgccttagtagaccgtagcgaggttgcgtgcggggcggagctacacagacgcacatgagccgagaaggtctcgtgggggacggaagtcttgggttggtccgaggccctgcatgcattgggtgccccactttccttgttaggcccccattaaccccgtctctttccatttcgggcttttttcaattatgaccccctcgatcgtaagagaccactaatggcagaagactttagaaccggcatgtcccagccaaccgaaacagcgggttcgcttattttacacggacatagtctcgcaaaccgtgcttgcgcgcccaacacgcgcactcggcggacaccattggtgcacccgggcttcccggtgcacttaagacacccaggcggtcaagagcggtcaaaacaaacaagaaaacagcaagaaccagaacaaccacaccagccacccgccagcaaccacaaccaacacaacgaagcgacagacacgcagcacaccaacagacgcgacgagaacacagaacaacaacacgcagaggacaggtgaacacacaccgcgcgaccgacacgactccgctacgagcatcacgacagatcaaggcggcggcgacacggggcacacgccagtcaggaaagggccacaaacccgctagcgaggccgtgaggcagtaaaatatgcccagagatgcaagatgacagaaatgacaaggggggaac

SEQ ID NO: 507872 - DNA, 362 bp, Homo sapiens
cctcctagctcccgagtagctgggaccacaggtgcacacgccaccacgccggggtcattcttgggtattttttgggggagatggggttttgggcacattcacccaaacttacactgcagaaggtaagtaaccggcttgaggtcacccagcaggctgggtgacagagtgaggttggggcagctcggggtgactcccagcggccaggccacctctgatgagatcacagcggctccccaggcacggggcttttcgttttctctcggcctctactaaccctactccatcctctggctctgaacagaagcaacgactccctcggtgctcccttggacctctgtggccccaggctcaggggtaccgag

SEQ ID NO: 507873 - DNA, 329 bp, Homo sapiens
tgtcccgaatgcggcaagggatttagtcgtagagcagatcttaaaattcactgtaggatccacacaggcgagaagccatacaaatgtgatgagtgtgggaagatcttcaggcaggcctcaaatcttttggcccatcagagagtccgcagtggagaaaaaccattcaaatgtgaagaatgtgggaagagtttcggtcggagtgcacatcttcaagcccatcaaaaagtccatacaggcgaaaagccatacaaatgtccggaatgtgggaaggcctttggtgatagctcttccttaattcaacatatgaggattcacaccggtgaaaagcc

SEQ ID NO: 507874 - DNA, 309 bp, Homo sapiens
ggggatgattgtgttgttgtgctgtgttcgttgtgtgttggcctgggtggttgtgggtggcgtgtggtggtttcgggtgtgggggtgcgtggttctgtgcgggcgttgcgtggccggttgtggtcgccgggggtcgtgtgtcgcgtgtcgcggggtgcttgcgttttgtgtttgcagcttggggctgtatcgcagtcggctgtggtggttttgggttcgcgctgtgtgcgtccttgtcgtcagggggccggggcgtccccatggtccccgtggactccccgttgcttggtgtggctaagggggggtact

SEQ ID NO: 507875 - DNA, 807 bp, Homo sapiens
  misc_feature (95)..(95): n is a, c, g, or t
gagtaaaatgctctcctagccaggagggtaaatgagatgatctaaagtccagttgcggtggtagtattggtatcatgttatgagtaaggaatccntagctcatataatggttctatttcaaagaggagttgtagctctccagagagataatgtgcgtagtacccagctctacaggtcctttaaccggtggagtgggaccgtctgtccttcttcctaggtagtgtcgacattagtagagccacgttctagaatttaagatcaggaagattgtgaaagtaatattattgggtggtcttctcatgtgagggtactgtattgaatcgagatcttgctaagcaaataagtgttgatatcgttgtgtctgattatgtacctccttaggaggagaagctaactcaaactataaggataaaactcactagttttgctcaactgctgtattcagcgagtagacagcaccgatgtacacatataacacggacattttacaaaatgagtctagcaaatctcattaggcaacatctccttaggaatactccagtgctgagtgccagtttaaatggtatagaacaagtacatctaatgagatgggacgcagttttctttgagtccgtcagtatcgtagagtgacaaactgtactaataagaagatgaatacgaaaagacatggacctatcgattagagagtatgaatcttgggaaaagataagaagattagaataaggagggaggaaggaagaagtagtcggtggtcaggtaatgtcccactatgcaaggttacagattcctggatatatgaggtgtaag

SEQ ID NO: 507876 - DNA, 169 bp, Homo sapiens
aggtcaccggttgaggcctggctggaaaagagccaggacagtgtagccgtgatgtggtcattgtcctgatgccagccttgaagatgcaaaaaaagagggaccatatgatgtggtggttctaccagagaggtaatctgaggcgcacatgaatttatcgtgagtcgtgctg

SEQ ID NO: 507877 - DNA, 111 bp, Homo sapiens
cactttgcacaacttgtactttgcctcttccactgtgatgcggtgaacagcaaaacggcccttggtgtcatagaccaggcggaaatgttcacctgtcttcttgatgctgga

SEQ ID NO: 507878 - DNA, 130 bp, Homo sapiens
tagtcggcggtcccttcataccattcattccatgcagtccatctttcctttccattccattcctttccaatcccattccattcccattccattccattccattccattccattccattccactctggttt

SEQ ID NO: 507879 - DNA, 424 bp, Homo sapiens
aatgaattgaaaacccaaatcgtagaatctgaatatgctctagagtattcctaagcattcactattacatccgatgggtaccttggcgtgccactgctgtcccatcaccctgacgctgacatcagtcccagactcccaatacctagtccatgctcatagactgtacatttcctgaactctgccagcaatgggcagttctgggcactggcctagagattaaacctcttgcttcttaagagcaatcattgccttgctccaacactgccatgaataacctgctgggttagattctctttcacactctgttgggcgacatgaatacacatcagcagcaaaaaattaacacaaactttcaaaatttaacagaatttgccatttatcaaggcatggaagggtgagaaccactggcctaggcacaccagtg

SEQ ID NO: 507880 - DNA, 304 bp, Homo sapiens
atattggtgacgaaagtgaatcagagagatgaaacaggaaatctctgtgttagtaacacatgagtgtcagtaggaagtaggaagagatcaagctagaaatatgacttgtgactattacatcagacatttgaggctcaaggggaagaggagtgtgtatgtaattcaccaggccatggggctcactggaaagttctgagtgaaagaggctttaggaagattaatctggtagtagtgtgtagtggaagcaggccaagtcactaaaagtcaattccctgcaagccagcttgatctcgtccaaccatat

SEQ ID NO: 507881 - DNA, 128 bp, Homo sapiens
ggccagtagcagcgtccagtatcacgcgtacgtccgtccagcgttgcgacctgccaagtgggccgttttaggttaaaccgggctaagtaaacgcatagtcgggttttaacccggttggccccacaatg

SEQ ID NO: 507882 - DNA, 679 bp, Homo sapiens
ggacggcggcgcgtgtgcccgggtagcacccccgccctgcaccagcccccgtccgaacccagcgggccctcacccatcacccggccggcgagcatcccgggtcccggtccgtcccgcgtgtctggcttgcctcgtccggcttttcccgagcgccgtcctgcagaaacatcaccagaagaccaagcaaactatacatcttggagacacatataagcattaaacaagacaacaataacaagtcagcatcgacaacacttaaagacaccatagatcaacacatcacatcacatacaatagaatggaactacaaccgaagtacataaaaacatatcacacgatgaattaatatatatataacacgttaacacaaaaaacaaacagaacataaaatgagtagccaagacagtgcaaatgcgataccattagaagaggaacatgaaaacccacgagcagagacacactcatcccatcacatggacttggacacagatagatatcccataagaaaaccaccaagacaaggataacgtgagtgagacacaaaaggagccaccaaaatcaaaaggatgagaaacatcagatgaaaaaaggaaaaaaacatacaaagaaagatgatagatagtagtaggccaaccagaaaaaaaaaaacaagaacacaaactaataaacagagatcaac

SEQ ID NO: 507883 - DNA, 1380 bp, Homo sapiens
ctgaagatccgggaaaactccgtagtgacgctggtttggaatcagacaccgcaactgaaaaaaggggcagacactgcgaaagcaaaccgaggagcaacagagaaaaaaagcagaagcctaaaatctgatcaagactgaagagatagcagcaagaggaccgaaactgttttccccaaagctaaacaagttaaaaagaaagcagtagccttctgcaagttgcacatgcaattcgtcctcaaatccgaaaaaggcaacagaagagaaagaggagccatcatcgaaacatgcacatttctcctcaaaacccaaaagtttgagaaagaaacaaggagcccatatgaaacaggaaagtacgtttctatcgtcacaacacccaaaacacagtgcacaaacaaatgcaggcagccgttctgcagcgcacagacaatcagcatgcgtcctcaagccccaaaagcaagcattgacagcaagagcaaacaggcacaatgaagtggcagcaacaatcagcagcagcaaaagccccgaaactagcacagcaatggcatttatcctcatcctgtaaccgggcactagtaaaccaccaaggtggacagcgtgccgaatggccacgaaacagtaaaacaagttagcagcattcagcagccagtgcacacatcaacctgggtgcgcacacgaagacaaacagcacagggcggcgtataaccgtacgtaaaatgtttagcccgcattaattccttggcacagccacagaactaatataaaacacttttctcatcccaacaacgggcccctgagggccaggatagacaccctattcccatgaattgatacccttagttaaccaacgagcaaaatggacccactcccccaataccaatggatatataaacaaggccgcgggcaaagggacacttttcacgtaggccaagaagggcagtagtgacacaggggaaaactaggggcacaggaacacttccatacacaataatggccaacaataccccaatatgggaaatcggacggcacaaacggaacacctcgcgggcgacgaacgcatggccaaacgacaccagtggcacgacctccacagagcacccgagtgaaccccccatcaaacgagaaaccatagggggacacataagcaccccccatagaacaagaaaacacacacataggagacaagaccaaaaggacaaaggaaaacgaaaacgaatcacagaagagaagacaacaacacaagaaacaaggaagtggacaaacagagagacctatggacacaaacaaaggacggagaccacacgacataaaaaacaaggcaccaaaatacagacacaacgaaccacaaagcagaatcaggagcgcaaacacccagacgcacgg

SEQ ID NO: 507884 - DNA, 310 bp, Homo sapiens
  misc_feature (51)..(51): n is a, c, g, or t
  misc_feature (69)..(70): n is a, c, g, or t
  misc_feature (109)..(109): n is a, c, g, or t
  misc_feature (161)..(161): n is a, c, g, or t
  misc_feature (186)..(186): n is a, c, g, or t
  misc_feature (191)..(191): n is a, c, g, or t
ctgtcgtccatcagtgaatgttattgaaggacaaggacagacaacaaatcnggaaaatgggttctctcnnaacacattgcaaagccacagaggctagtgcaggatgggngggcatcaggtcatcagatgtgggtccaatgccagaatattctgtgctcccnaaggccacttggtcagagtgtgtgnttgcngaggtggctctaaaagctcagcagtggaggcagtggttcgccatactcagggtgaactcacatcctctgtgtctgaagtatacagcagaggcttgaagggctgatgggagaagactgcg

SEQ ID NO: 507885 - DNA, 1233 bp, Homo sapiens
  misc_feature (1233)..(1233): n is a, c, g, or t
gcccccggctcgtctccatttgaagccccgtgactcttcactgctggtcaatcagagacccgtgctctccctagtgccggccaatgggaggtgcgctcgggctgcttccggctccgctgctccgcctcgcacccctcccaaggtctccccgcgactggcgggacgcatggggcgggcgtcgtgccgcggtgactgcgcagcgggcctggagtccaataatggggcgggctcggtgctgatggacgtgtgctggtggccagtggtagaggctgctggatcgcacattcccgctcaggtggagagaagtgataactatggcgaacgaccataggatatacctgattcaagctgactgcgtgatcggagggagcgtcgggggtgagggacagacactggtgtacatgttacccgatctactccagaggatcgctatgcaagttcagctcttgtcatcattgcgcacatcaacgacatgcgtacttctcagcacttatggagccagtaagagcatcgaatgcgccatggaagcacatacaaagcatgcgcgagtgatggggaacaacaaaggccgcgtcctagagaaactagttcacacgcatcggattcatcagacaggagcgtaggttacacgagcgcgttgccactaggcgctaatcgaatgcctggggtcatgacggaaccatccaccgatacatgaccacaaggcgctttctgagagagaagataccgggaaacttgggagtccacgccaacctttgtggacgtcagatcccgtcatcccttgtcaggaccggttcgtaaatacgcagttgaatactccagggcggaccaaaagttgttgacattgccagagaagtcgacgtatgccttcatccaaggtttgacacacaggcctaacttgggcgcaacaaccagaagggcatggcttacctgtgcgacactgcttgggaagcgttcgccatagattgcggttccgagacaagaacccacagcgtcagtagggggccaaggcaaggtccatccgcgaagtgaaagatatatgcgcagtatacccccaagaaaccttgggggacccccataaagaaggctccacaaggcgtccccaagggtctggagcagtaaaggccaatccgagaaaccgcgccaagaggaaccgcggcaacggggagagaagttccaagtgcgggagtcaaaggaaaccaccccccgggaacaccagttggcgttggatgn

SEQ ID NO: 507886 - DNA, 304 bp, Homo sapiens
gtaggagaatcacctgaacccaggaagtcaaggctgcagcagtgagctgtgactgcatcactgcactccagcctgggcaacagagcgagaccctgtctccaaaaaaaaaaaaagggagaaaggaaggaaaaaaggttcccttttaaattaacaaaactggccggcctgggggcctaaggtttgaaacccaagcttttgggaaggttgggaagggggatccccttgagatagggggttaaaaacaaccttgccaaattggggaaaccccattttccattaaaaaaaaaaattttacccggctttg

SEQ ID NO: 507887 - DNA, 651 bp, Homo sapiens
ggtgttgggccggaggaaatgcgggaagactcatctggagcgtgtggatttgagccgccgcgaagtcgattaaccctagatctctgaaatgcatcgcgatatcctgtccattggactgtaaggtttatgtaggcaatcttggaaacaatggctaatccagatcggcagattggtaacgtggctttaggctactgatgtgaccactctcgaagatgtgtgggtttgctcagaaaccgcgatcccggcttatgcttctttgtatgaattttgaagatcccccgcagatgactagctgatgcacgtccgagagctatgatggaacgaacactatgtggctgccgtgtaagagtgtgaaactgtcgaactggtgactgacaagaacgtagaacatcgtggcccatgctccctcttggggtcgtcggcctcgatgatgattactcgtaggaggagtcctcgcacgctcgtcgcagatctccaagaaggggaagcttctctcgcaagcccggatgcaggtcccctttctagagataggagaacgagagagatcggctgtcgtctgggagatgcaatcgccattgccgtcccgatccttctctattgtctcgaagtcgatctaggtccaaatgtaaacggagctttaacacaggttgc

SEQ ID NO: 507888 - DNA, 309 bp, Homo sapiens
tgctctagaggatcggacagatccctaaccagccctcaaagtcgcaagtcaagcatcacgcttccgtaaggggtcaggataaaattcaaatgatttggctgaatacacaagtctcttaatgaaagaggtgctgtcggccgggcgcagtggctcaggcctgtaaccccagcacttggggaggccgaggcaggcagatcacgaggctcaggagaatcgagaccagtccgggactaacagcggtgaaaccccggtctctactaaaaacaatacaaacaaatgtagccggggcgtggtggcggggtgcctgta

SEQ ID NO: 507889 - DNA, 121 bp, Homo sapiens
aacttttttaaaattcataatcttcaattttgtttgccacgacgtggttgacagagtgtcgcgaaaaaaaaaactaataaagtggcacctgcatgctgtggaggcccttaccgttcagaca

SEQ ID NO: 507890 - DNA, 2300 bp, Homo sapiens
  misc_feature (19)..(21): n is a, c, g, or t
  misc_feature (23)..(23): n is a, c, g, or t
  misc_feature (27)..(28): n is a, c, g, or t
  misc_feature (31)..(32): n is a, c, g, or t
  misc_feature (39)..(40): n is a, c, g, or t
  misc_feature (44)..(44): n is a, c, g, or t
  misc_feature (55)..(55): n is a, c, g, or t
  misc_feature (142)..(142): n is a, c, g, or t
  misc_feature (148)..(148): n is a, c, g, or t
  misc_feature (183)..(183): n is a, c, g, or t
  misc_feature (286)..(286): n is a, c, g, or t
  misc_feature (296)..(296): n is a, c, g, or t
  misc_feature (311)..(311): n is a, c, g, or t
  misc_feature (323)..(323): n is a, c, g, or t
agcgggccaccctggtgcnnntnctgnnccnngaatcgnntggntgacaaccagngcttttcccagccccagctaagagagggggctttagggcaagagcacctcagccctgcaatggggggatcttttttttttttttttnttgganacaggctggagtgcagtggtgcgatctcggttcgntgcaacctctgcttcccaggttcaagtgattctcctgcctcagcctcccaagtagctgggattacaggcacccaccaccacgctcggctaattttggtatttnagtagagacngggtttcactatgtnggccaggctgtncttgaactcctgacctcaggtgatccgcccaccttggcctcccaaagtgctgggattacaggcatgagataccccgccgggccaaggggattttgacgccacttcctgagtgaagcgcttgcatggggatgggaagaagcacccccaaccttctagtccgctccgagcagggcctggagcattggagacattggttagtgtaataggcagagcctgagtgaggccggggggcttctccaacagagaaaagacattggctttgggtaccatgctgagggagggggttaggcctggtgggggcccattcaaaggaggccgggctcggtggcttaggcctgtcatcccagcactttgggagaccaaggtgggaggatagcttgaggccaagatagcaagaccaccctggtcaacatagcaagaccctgcctctacaagaaaataacgaaagaggccccagggaaggaagccagccaggagcagcctggagcagaggcaggagcctgaggcctgagccatggcatccagggacagcctggtggccgagagagcttgtggctgtcactataagggaagaggagctatggaaattggaagtgcagggtggcctgtgtgctaggagtgggggtgcaggcctaggtgtgtttatgcacacgtttgtgcatgtacgtgtgagcgtggatgtgttcctatgcattagagtgtgtgcgtgcacgtgtgcagagcccacacctgagatatgggactggctcttggagtattttgagttctcagtagcagtcttgttgtcaggccttgagtgcagaaatgattaggtgagtgagggcaggactcgaatgcagaccctggctccaggggagagggtggggcgtctctggtaggacggcctcaccccacttgtcagaactactctggaggggggcaaaggtgtcaggaacagtttgagcagttctggctcagggtcactcatgaggttgctgttgtctgaaatcttagctaaggattggaggatgcacttctaagtgaggcctggctgtaggcaggaggcctcagtccttccccaggtgggccaacccacagggctgcttgagtgtcttcacaatatggcgctcggcttccccccagagcaagagattcaagggcccagggtaaaagccaacgtgttatttttatccctagcctcagaattcacacgccgttgcctccaccatgctctggtttgatacagcccagctctgattggaaggggctggggctgcccgtgctgactcttcaaaggcatcccatcctgcagatggtgttcacagggagagtttgtgggggccggcactccctcatctactggggctcattctggaagaaggtccagaagaattggagacccctgcccctcacccaaactttggaggtggcagggtgaacagcaggccaagttcaggtcccaagacaggccaaggccagtgcggtttcccttccactgcctcagtttacctgtattcagaagacagtctaggaagagttgagcagagttccctctaaaagagtagggagctgataacagtcccaagccctcctctttctctatgccaaaatcatttccgttatcctgagatgggggtgagtggatggatggtgtactgaggggcctctgccctgcccagagcccccaccatcgtagtgggggcaggggacttcctgcccacaaccccctccaaccctcacctggcgtgcccgggtcaccagcagcagcagcggcgttccatcgctcccaagatctgggtgaaggggagaacctgccatcttatccctacccccccggggccctcaagcttattttcttgttgaagaaacacaaaaccctcgagattcatgtactgtatgttggagaaaaaaaattacctaatgttcccccaaaaaagacagtatattttgtactttgtaaagtgttaattaaaatgaaaaaaaaaaaacaatgaaaaa

SEQ ID NO: 507891 - DNA, 1989 bp, Homo sapiens
  misc_feature (19)..(21): n is a, c, g, or t
  misc_feature (23)..(23): n is a, c, g, or t
  misc_feature (27)..(28): n is a, c, g, or t
  misc_feature (31)..(32): n is a, c, g, or t
  misc_feature (39)..(40): n is a, c, g, or t
  misc_feature (44)..(44): n is a, c, g, or t
  misc_feature (55)..(55): n is a, c, g, or t
  misc_feature (142)..(142): n is a, c, g, or t
  misc_feature (148)..(148): n is a, c, g, or t
  misc_feature (183)..(183): n is a, c, g, or t
  misc_feature (286)..(286): n is a, c, g, or t
  misc_feature (296)..(296): n is a, c, g, or t
  misc_feature (311)..(311): n is a, c, g, or t
  misc_feature (323)..(323): n is a, c, g, or t
agcgggccaccctggtgcnnntnctgnnccnngaatcgnntggntgacaaccagngcttttcccagccccagctaagagagggggctttagggcaagagcacctcagccctgcaatggggggatcttttttttttttttttnttgganacaggctggagtgcagtggtgcgatctcggttcgntgcaacctctgcttcccaggttcaagtgattctcctgcctcagcctcccaagtagctgggattacaggcacccaccaccacgctcggctaattttggtatttnagtagagacngggtttcactatgtnggccaggctgtncttgaactcctgacctcaggtgatccgcccacccagcactttgggagaccaaggtgggaggatagcttgaggccaagatagcaagaccaccctggtcaacatagcaagaccctgcctctacaagaaaataacgaaagaggccccagggaaggaagccagccaggagcagcctggagcagaggcaggagcctgaggcctgagccatggcatccagggacagcctggtggccgagagagcttgtggctgtcactataagggaagaggagctatggaaattggaagtgcagggtggcctgtgtgctaggagtgggggtgcaggcctaggtgtgtttatgcacacgtttgtgcatgtacgtgtgagcgtggatgtgttcctatgcattagagtgtgtgcgtgcacgtgtgcagagcccacacctgagatatgggactggctcttggagtattttgagttctcagtagcagtcttgttgtcaggccttgagtgcagaaatgattaggtgagtgagggcaggactcgaatgcagaccctggctccaggggagagggtggggcgtctctggtaggacggcctcaccccacttgtcagaactactctggaggggggcaaaggtgtcaggaacagtttgagcagttctggctcagggtcactcatgaggttgctgttgtctgaaatcttagctaaggattggaggatgcacttctaagtgaggcctggctgtaggcaggaggcctcagtccttccccaggtgggccaacccacagggctgcttgagtgtcttcacaatatggcgctcggcttccccccagagcaagagattcaagggcccagggtaaaagccaacgtgttatttttatccctagcctcagaattcacacgccgttgcctccaccatgctctggtttgatacagcccagctctgattggaaggggctggggctgcccgtgctgactcttcaaaggcatcccatcctgcagatggtgttcacagggagagtttgtgggggccggcactccctcatctactggggctcattctggaagaaggtccagaagaattggagacccctgcccctcacccaaactttggaggtggcagggtgaacagcaggccaagttcaggtcccaagacaggccaaggccagtgcggtttcccttccactgcctcagtttacctgtattcagaagacagtctaggaagagttgagcagagttccctctaaaagagtagggagctgataacagtcccaagccctcctctttctctatgccaaaatcatttccgttatcctgagatgggggtgagtggatggatggtgtactgaggggcctctgccctgcccagagcccccaccatcgtagtgggggcaggggacttcctgcccacaaccccctccaaccctcacctggcgtgcccgggtcaccagcagcagcagcggcgttccatcgctcccaagatctgggtgaaggggagaacctgccatcttatccctacccccccggggccctcaagcttattttcttgttgaagaaacacaaaaccctcgagattcatgtactgtatgttggagaaaaaaaattacctaatgttcccccaaaaaagacagtatattttgtactttgtaaagtgttaattaaaatgaaaaaaaaaaaacaatgaaaaa

SEQ ID NO: 507892 - DNA, 2106 bp, Homo sapiens
  misc_feature (19)..(21): n is a, c, g, or t
  misc_feature (23)..(23): n is a, c, g, or t
  misc_feature (27)..(28): n is a, c, g, or t
  misc_feature (31)..(32): n is a, c, g, or t
  misc_feature (39)..(40): n is a, c, g, or t
  misc_feature (44)..(44): n is a, c, g, or t
  misc_feature (55)..(55): n is a, c, g, or t
  misc_feature (142)..(142): n is a, c, g, or t
  misc_feature (148)..(148): n is a, c, g, or t
  misc_feature (183)..(183): n is a, c, g, or t
  misc_feature (286)..(286): n is a, c, g, or t
  misc_feature (296)..(296): n is a, c, g, or t
  misc_feature (311)..(311): n is a, c, g, or t
  misc_feature (323)..(323): n is a, c, g, or t
agcgggccaccctggtgcnnntnctgnnccnngaatcgnntggntgacaaccagngcttttcccagccccagctaagagagggggctttagggcaagagcacctcagccctgcaatggggggatcttttttttttttttttnttgganacaggctggagtgcagtggtgcgatctcggttcgntgcaacctctgcttcccaggttcaagtgattctcctgcctcagcctcccaagtagctgggattacaggcacccaccaccacgctcggctaattttggtatttnagtagagacngggtttcactatgtnggccaggctgtncttgaactcctgacctcaggtgatccgcccaccttggcctcccaaagtgctgggattacaggcatgagataccccgccgggccaaggggattttgacgccacttcctgagtgaagcgcttgcatggggatgggaagaagcacccccaaccttctagtccgctccgagcagggcctggagcattggagacattggttagtgtaataggcagagcctgagtgaggccggggggcttctccaacagagaaaagacattggctttgggtaccatgctgagggagggggttaggcctggtgggggcccattcaaaggaggccgggctcggtggcttaggcctgtcatcccagcactttgggagaccaaggtgggaggatagcttgaggccaagatagcaagaccaccctggtcaacatagcaagaccctgcctctacaagaaaataacgaaagaggccccagggaaggaagccagccaggagcagcctggagcagaggcaggagcctgaggcctgagccatggcatccagggacagcctggtggccgagagagcttgtggctgtcactataagggaagaggagctatggaaattggaagtgcagggtggcctgtgtgctaggagtgggggtgcaggcctaggtgtgtttatgcacacgtttgtgcatgtacgtgtgagcgtggatgtgttcctatgcattagagtgtgtgcgtgcacgtgtgcagagcccacacctgagatatgggactggctcttggagtattttgagttctcagtagcagtcttgttgtcaggccttgagtgcagaaatgattaggtgagtgagggcaggactcgaatgcagaccctggctccaggggagagggtggggcgtctctggtaggacggcctcaccccacttgtcagaactactctggaggggggcaaaggtgtcaggaacagtttgagcagttctggctcagggtcactcatgaggttgctgttgtctgaaatcttagctaaggattggaggatgcacttctaagtgaggcctggctgtaggcaggaggcctcagtccttccccaggtgggccaacccacagggctgcttgagtgtcttcacaatatggcgctcggcttccccccagagcaagagattcaagggcccagggtaaaagccaacgtgttatttttatccctagcctcagaattcacacgccgttgcctccaccatgctctggtttgatacagcccagctctgattggaaggggctggggctgcccgtgctgactcttcaaaggcatcccatcctgcagatggtgttcacagggagagtttgtgggggccggcactccctcatctactggggctcattctggaagaaggtccagaagaattggagacccctgcccctcacccaaactttggaggtggcagggtgaacagcaggccaagttcaggtcccaagacaggccaaggccagtgcggtttcccttccactgcctcagtttacctgtattcagaagacagtctaggaagagttgagcagagttccctctaaaagagtagggagctgataacagtcccaagccctcctctttctctatgccaaaatcatttccgttatccttatccctacccccccggggccctcaagcttattttcttgttgaagaaacacaaaaccctcgagattcatgtactgtatgttggagaaaaaaaattacctaatgttcccccaaaaaagacagtatattttgtactttgtaaagtgttaattaaaatgaaaaaaaaaaaacaatgaaaaa

SEQ ID NO: 507893 - DNA, 2118 bp, Homo sapiens
  misc_feature (19)..(21): n is a, c, g, or t
  misc_feature (23)..(23): n is a, c, g, or t
  misc_feature (27)..(28): n is a, c, g, or t
  misc_feature (31)..(32): n is a, c, g, or t
  misc_feature (39)..(40): n is a, c, g, or t
  misc_feature (44)..(44): n is a, c, g, or t
  misc_feature (55)..(55): n is a, c, g, or t
  misc_feature (142)..(142): n is a, c, g, or t
  misc_feature (148)..(148): n is a, c, g, or t
  misc_feature (183)..(183): n is a, c, g, or t
  misc_feature (286)..(286): n is a, c, g, or t
  misc_feature (296)..(296): n is a, c, g, or t
  misc_feature (311)..(311): n is a, c, g, or t
  misc_feature (323)..(323): n is a, c, g, or t
agcgggccaccctggtgcnnntnctgnnccnngaatcgnntggntgacaaccagngcttttcccagccccagctaagagagggggctttagggcaagagcacctcagccctgcaatggggggatcttttttttttttttttnttgganacaggctggagtgcagtggtgcgatctcggttcgntgcaacctctgcttcccaggttcaagtgattctcctgcctcagcctcccaagtagctgggattacaggcacccaccaccacgctcggctaattttggtatttnagtagagacngggtttcactatgtnggccaggctgtncttgaactcctgacctcaggtgatccgcccaccttggcctcccaaagtgctgggattacaggcatgagataccccgccgggccaaggggattttgacgccacttcctgagtgaagcgcttgcatggggatgggaagaagcacccccaaccttctagtccgctccgagcagggcctggagcattggagacattggttagtgtaataggcagagcctgagtgaggccggggggcttctccaacagagaaaagacattggctttgggtaccatgctgagggagggggttaggcctggtgggggcccattcaaaggaggccgggctcggtggcttaggcctgtcatcccagcactttgggagaccaaggtgggaggatagcttgaggccaagatagcaagaccaccctggtcaacatagcaagaccctgcctctacaagaaaataacgaaagaggccccagggaaggaagccagccaggagcagcctggagcagaggcaggagcctgaggcctgagccatggcatccagggacagcctggtggccgagagagcttgtggctgtcactataagggaagaggagctatggaaattggaagtgcagggtggcctgtgtgctaggagtgggggtgcaggcctaggtgtgtttatgcacacgtttgtgcatgtacgtgtgagcgtggatgtgttcctatgcattagagtgtgtgcgtgcacgtgtgcagagcccacacctgagatatgggactggctcttggagtattttgagttctcagtagcagtcttgttgtcaggccttgagtgcagaaatgattaggtgagtgagggcaggactcgaatgcagaccctggctccaggggagagggtggggcgtctctggtaggacggcctcaccccacttgtcagaactactctggaggggggcaaaggtgtcaggaacagtttgagcagttctggctcagggtcactcatgaggttgctgttgtctgaaatcttagctaaggattggaggatgcacttctaagtgaggcctggctgtaggcaggaggcctcagtccttccccaggtgggccaacccacagggctgcttgagtgtcttcacaatatggcgctcggcttccccccagagcaagagattcaagggcccagggtaaaagccaacgtgttatttttatccctagcctcagaattcacacgccgttgcctccaccatgctctggtttgatacagcccagctctgattggaaggggctggggctgcccgtgctgactcttcaaaggcatcccatcctgcagatggtgttcacagggagagtttgtgggggccggcactccctcatctactggggctcattctggaagaaggtccagaagaattggagacccctgcccctcacccaaactttggaggtggcagggtgaacagcaggccaagttcaggtcccaagacaggccaaggccagtgcggtttcccttccactgcctcagtttacctgtattcagaagacagtctaggaagagttgagcagagttccctctaaaagagtagggagctgataacagtcccaagccctcctctttctctatgccaagatctgggtgaaggggagaacctgccatcttatccctacccccccggggccctcaagcttattttcttgttgaagaaacacaaaaccctcgagattcatgtactgtatgttggagaaaaaaaattacctaatgttcccccaaaaaagacagtatattttgtactttgtaaagtgttaattaaaatgaaaaaaaaaaaacaatgaaaaa

SEQ ID NO: 507894 - DNA, 247 bp, Homo sapiens
ataaccggatcagctggattatacacagaccagactatgattagtctaaacattaagatattgcagtgtattgagccagctgtggctccagagtctgtgcccttcaccaccgtgccctactttttcacatgctgtgtttggtagtttttcctcgtgctctccttaataatggtggtgttaagcaaattgtattacataaatcaatattccattacatggattgagttatgttgcctttcggagaaga

SEQ ID NO: 507895 - DNA, 85 bp, Homo sapiens
  misc_feature (50)..(50): n is a, c, g, or t
  misc_feature (79)..(79): n is a, c, g, or t
gaccacggccatctggtaaaggacaagctacaagctctgtgtttctgtantgatgtgtcacttattaaatacttttgtnccatgt

SEQ ID NO: 507896 - DNA, 811 bp, Homo sapiens
  misc_feature (19)..(21): n is a, c, g, or t
  misc_feature (23)..(23): n is a, c, g, or t
  misc_feature (27)..(28): n is a, c, g, or t
  misc_feature (31)..(32): n is a, c, g, or t
  misc_feature (39)..(40): n is a, c, g, or t
  misc_feature (44)..(44): n is a, c, g, or t
  misc_feature (55)..(55): n is a, c, g, or t
  misc_feature (142)..(142): n is a, c, g, or t
  misc_feature (148)..(148): n is a, c, g, or t
  misc_feature (183)..(183): n is a, c, g, or t
  misc_feature (286)..(286): n is a, c, g, or t
  misc_feature (296)..(296): n is a, c, g, or t
  misc_feature (311)..(311): n is a, c, g, or t
  misc_feature (323)..(323): n is a, c, g, or t
agcgggccaccctggtgcnnntnctgnnccnngaatcgnntggntgacaaccagngcttttcccagccccagctaagagagggggctttagggcaagagcacctcagccctgcaatggggggatcttttttttttttttttnttgganacaggctggagtgcagtggtgcgatctcggttcgntgcaacctctgcttcccaggttcaagtgattctcctgcctcagcctcccaagtagctgggattacaggcacccaccaccacgctcggctaattttggtatttnagtagagacngggtttcactatgtnggccaggctgtncttgaactcctgacctcaggtgatccgcccaccttggcctcccaaagtgctgggattacaggcatgagataccccgccgggccaaggggattttgacgccacttcctgagtgaagcgcttgcatggggatgggaagaagcacccccaaccttctagtccgctccgagcagggcctggagcattggagacattggttagtgtaataggcagagcctgagtgaggccggggggcttctccaacagagaaaagacattggctttgggtaccatgctgagggagggggttaggcctggtgggggcccattcaaagtgctgggattacaggcatgagataccccgcctggccaatgggatttttgacgccacttcctgagtgaagcgctttgcatggggatgggaagaagcacccccaaccttctagtccgctccgagcagggcctggagcattggagacattggttagtgtaataggcagagcctgagtgag

SEQ ID NO: 507897 - DNA, 126 bp, Homo sapiens
gttactgacagacagaaaaaacagtcgcatcctgatcaccggagaatccggagacagagaagacagacaacaccaagagggatcatccagatactttgctgttcttgctggccaattggggaccgc

SEQ ID NO: 507898 - DNA, 314 bp, Homo sapiens
  misc_feature (21)..(21): n is a, c, g, or t
  misc_feature (45)..(45): n is a, c, g, or t
  misc_feature (110)..(110): n is a, c, g, or t
  misc_feature (202)..(202): n is a, c, g, or t
  misc_feature (274)..(274): n is a, c, g, or t
agctgctcttacactgtatanctgtgtctgagtactcagttcatncaccagtcagggtctgtgggacagactaggcaggtggtgccccgtgtgaggagcagcgcagtggnatcatgatggaaccctcgaaaatgaacgtgaagtgactgcgcagtcctctttggattccagtgcaatgcatcaaaccataccatggcatggntgggacccaatgcagtactggaaatgaagaatgtgagcctgtaggacccgcagccccggacaatgcagcttnctcggacaacacaggtcccggatggggaatgtggaattag

SEQ ID NO: 507899 - DNA, 259 bp, Homo sapiens
cttcactgcagggaacaccaaccacccgaggcaatcgtataaacctggccataattacccccataggcattacactatccctcatcacccaactaaaaatattaaacacaaactaccacctacctccctcaccagagcccataaaaataaaaaattataacaaaccctgagaaccaaaatgaacgaaaatctgttcgcttcattcattgcccccacaatcctaggcctacccgccgcagtactgatcattctatggttg

SEQ ID NO: 507900 - DNA, 107 bp, Homo sapiens
ccatgactcgttgtaaagattgcagactgcagagataatgtctggatcgctgagtcaccagtgtgtgaggaaactcccattgacatgcatcacactccacatatgaa

SEQ ID NO: 507901 - DNA, 249 bp, Homo sapiens
agaagcgcttgaatccggggggcgacttccaatgagccaagattgcactatttcaccccagcctggacaaaagaggaaaactacgtctcaaaaaaaaaaaaaaaaattctaggttggggcccccattccctgggaaggcctctttcctccggagggacctgtctaaaggtgctaaattgtcctaacccttaggctctgtccaatatgggtaagtttatcgattaaatttccaaataaaatattaacaat

SEQ ID NO: 507902 - DNA, 255 bp, Homo sapiens
tatctatgatactcttatagcctgccttcaattttgatcctttatatctttctatttgtcaggtgcacaagattaccttcctgttctagccttctgtcattgtcaccaaccatatcttactatggtggccatgtactatggaacaaaggccgcatgatctatatctggctccactacagtgtactaagagacaccctgacttccttatgtatgctaccccacagggagatccatctagacgtcgacctgacaggc

SEQ ID NO: 507903 - DNA, 441 bp, Homo sapiens
  misc_feature (11)..(11): n is a, c, g, or t
  misc_feature (20)..(20): n is a, c, g, or t
  misc_feature (22)..(23): n is a, c, g, or t
  misc_feature (25)..(25): n is a, c, g, or t
  misc_feature (328)..(328): n is a, c, g, or t
  misc_feature (360)..(360): n is a, c, g, or t
  misc_feature (383)..(383): n is a, c, g, or t
  misc_feature (392)..(392): n is a, c, g, or t
ctcgtgcaatntcggcagangnncnacgaggtcaatttttccagcttctttggaaaattgggaaaaaatgtcaacacagggcttccattccctcatggcagcaatagtctggagtggacagcagctactcccttaagatggggcatgagctctttaattagatacagttcttacctattcccttttttttttcattcctaagcaattttttaaaaaattactgtgcttacttacagactagtgcttttcaaacttttatctgtagatgaagcacctgaggaatcctattaaaatgccaactctgatccagtagatctgggtggggtcngaaattctgcaattcctgaccacatcaaaggngcccatggttcttggtccaaggnccacatttnaaataggcaaaggcagtatataatttcaggtttcaacctttccaggttt

SEQ ID NO: 507904 - DNA, 272 bp, Homo sapiens
ctgcgggctggtggtgcatgcctgtattcccagctactcaggagttgagtgggaggatcacttgagcccagaagttcaaggctgcaatgagccatgattacaccacggcactacaaccttggtggcacagtgagaacctgactcttaaaaaaaaaaaaaaaaaaaaaaagataactaaaacttctaaaacctcttgtaacacgttacccagaaactatccaagtggttaaccatgctttatcttacccaatccatccaaaagtctaatggcg

SEQ ID NO: 507905 - DNA, 124 bp, Homo sapiens
tgctgagaatgatggcttccagtttcatccatgtccctgcaaaggacatgaactcattcttttttatggctgcgtattttccatttctataacgatccatcagtaggactgcttatgacaaatt

SEQ ID NO: 507906 - DNA, 941 bp, Homo sapiens
  misc_feature (643)..(643): n is a, c, g, or t
gaagtccgagtgagacagcgagctgagtggtggtgtggtcgcgtctcggaaaccggtacgcttgcagcatggtgaccactctgactgaatgagcagtattgtcagaattcataagaagcttattcactattgtgtacaaagatgtgtgagtggaactataacatacaaaggaattgtggaactgtgctgagatctcttgggcagaatctgcacagaagcagagttacaggagcatgattaatgaagtagatgctgatggtaatgggcacgaaattgaggttcccgtgaatttctgactaatgatggcaacgtaatatatgaaagacacatgacgtgaagaaggaaattagagacgcatatccgtgtgttgatagaggatgggcaaatggctatactaagggcttgcggaacttcgccatgtgatgacaaacttggccgagaagcttaacagatgaagtcaccgttgctcaaacctgctcagggcaagcaggatatcgatggtgatggtcaggtccactatgacgagttcgtaccaaatgatgcctgcaaagtgaagaacgttgtacagaattgtgttaacgtttcttgtacaaaattgtttatttggcctgtgctatggtgcgtaacttatctgtaaaaaggnttccttcgctactggtcaatgcactatgctgtattagttaatgagcgacttcaattcctccagggttcttcccctttatcttactggcattgtctaaaaaccttattgaagaaaagtggcccagtacatgtgcgcggtgggtaaatgggaatatttaagcttcgggattaactacagggtgggcatccgggcacgcgttgctttacgcgtttcgaaacgcatgtgttcagacagccgggtggagacaattaatgctgtcagggtagtccccgggggggcacaatttatgaacgtaaca

SEQ ID NO: 507907 - DNA, 390 bp, Homo sapiens
cttatactgaaccatctgggacaagatagcgtctccctaccccggctctgagaagctccgctccctggtgctggccggcatccacattgcatgaggccacaggtaatgtggccacagggacccacaggatgttgagagggtcctgtgcccggtcatcagagtatcacgattcaagactgagtgcccttgtggctccacttccctcagctgttgtatgctggctctctggtgctctgcacaagaagaggaactctgagtctgtcctaccgctgaggacttactaagaacagctccaatgatgagatcatcgctggccagcagcgtaggccggtggcactgtgcaggaggagctggaggctgtgtgttggtcagaacatgtcgggtaccgag

SEQ ID NO: 507908 - DNA, 251 bp, Homo sapiens
ataacttccgtctgacactatttttttcctttattaccaaaattcccagaaggctcacaaatcatggttggcagtgcagcctttttcaattacttggacacattcccatgctaaggccctctgcacagatttttgtttactatcactggcgatcagcccaaactttctcaccccattttttcaacccaccccgattttgtacaccaggttactatgtgacccaccttactactggcttattgattgcaact

SEQ ID NO: 507909 - DNA, 340 bp, Homo sapiens
tcaccggtcctcccttcacctgacggggagtcaggccatgatcgacaccatgggcatgggaaaaacacaacagattaaagcgtgtgacgaacatcttccgacaaaacaattacaagcatgcctggcaccgaaccggcgcgttgtcattgaagttaaagggctgcaaaaataacagctacacaaaagactcaaactggtatgagatatgattaagctgctttaaatgcttttcttttaagaaaaatctacaactcccttccaccagctcaacattgtgccataaatcacaattgtgccagatgcattgccaatttactcaatactctgttctccaataatg

SEQ ID NO: 507910 - DNA, 251 bp, Homo sapiens
tcgtgcctgttctgctgccgcagcgtgccacccaggtaggccttgaggccatcggcaaccggctgcagcacatcgagattgagcacgcgcgagccgaactgcgctcgctcgaaaccgagggtgaactgatcggattgtgcgctgacggaaggctcgtagtcgacaatcccggtcggcgcgggaaagggatagccttgcgccgagatgcccacccgcactttgcttccgcgaataagccggttcgggaggcg

SEQ ID NO: 507911 - DNA, 963 bp, Homo sapiens
  misc_feature (472)..(472): n is a, c, g, or t
tgggggcggggtcttcctcttttttttaacaccctccccccccccacaaaatatttcccccgggggggggggcgcagagagacgccccacgagaggaggagaagcaaaagaggagcacccggggagaagaacaataatccaccccacacaacaagaccatcttcttcacaacaagagagaggtgaccacaatagattgagatatcacagcgagagcagaacagccaagcgatgaggcgcccgctccacactaatgcggtgcatgcacaccgcgatggagtaagaagagagccccccgagagttcccccgccgcgctcgctctgtgccacccctcgcgtggaaaagatatatatctctggttgggactcgttcgcgccgcgcgtgagagaacaaaaacggcggtgtgccctctcgtcgcggcgagcgcgctggtgcctcctctatatatcgctcccgcctctgtgttatttcnccccgcggggtgtgcgccctctctcgcgtcgcgagcccactcgtgcgaacttatatctgtcgagcgtcgccacagccccccgcctcgagagagagtgtttctctccagaacaacacccccgagtgtagatctctgctgcttgtgtgaggagataacacaccccggccaccacaaagatagattagttcctgtgttgcgccttaggtagttgtgcagcccccccacctaatcgatctgcgccggtcgaacaagaacaacacatatcttctcttcttcgctacaccaaccagcgccgcgaggcccacgaagagcatccttcacacaccagagacgttgtcgcgccagcaagcgagaggagaggggggccacacccaatcaacgacacaagggggcgcggccagcaaagggccccacccaacgagagggccgccccagaaaaaaacaaggaggggctacgcggctggccgcccccccgccaaaaaaaagccagg

SEQ ID NO: 507912 - DNA, 656 bp, Homo sapiens
cgacctttcggtgagatgacgggaaatgctgttagataaaatcaatttagcgattttctgagttcaaaataggttataaagcagcagagacaacacacaacatcaacaatgcattcggcccaggaactgctaatgaacatacagtgccgtgatggctcaagaagttttgcaaaggagactggagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcagatagaaaaggtgaaaaagctcaataaatgggtgcctcatgagctgagtgaaaaataaaaaaattcgtggtatggaagtgtcattctctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcatagtgtggtggtttgctgccagtctgatccactaaagctttctgcatccaggtgaaccattaatctgatag

SEQ ID NO: 507913 - DNA, 1144 bp, Homo sapiens
gaggatttaagtggcacgagaattgacaattgattccataatgaacaacagggagagacattaacaaactaagctttaaacaactgaacgaccttactgactgaactaagcttgcaactaacaactttcctgctgcatactacagaactgcaggctacatgcactgcgcacgggcttttctgtctgcttcatactccacagcaactttgcaatggctgtctggcacactgcactacacatcggcgaaactgctctaacccaaactctactgcactgactgcgcagaacaaacccagcaggcacctggcttgaggctctctgcctcctgccctcaacaacctagcacgcaacacaacacgctgcttccggcctacagcctgactgcctcctgtcttaacactaacagttgacttggctcgctctacacgctcacagacaactctgcaacggccgcttccccacagcattacaactatgcgccaacacatgaggagctcatttgcgcgtagcaactttccaaagctgagcactttttgccctcgacacctctcacacaacgcctactttcaccggaagccccacgcactgcagtgccaccggctgcaccttaactttctccaacactgcgcccaccaacgccaaaacctgcacacccacacactttctgcctcttctggctcccactattacttcgtctctctgccaccaaactctctgcacaccgtggttcaacaaaacgcgcttcaaactgcccacgacacacacacgtaacaaccaacctttccgttcaacaacacacggcctgctaagcaaaccgctgcgcaaggccaaggtcaaccaccactaacacacactggcctgtgcacacactttcgccccctgccgcgcacactcttcaacaaccccctcccgcaaccacacacacacgcaagcgcttggcctcgcttccaagcaagggcaagcggaaacacggcaaaacgacacttttcactaccagcgccagttccctaaccgggccaatttcaacccttggcccccaacgaaatcccatttctcccccgggatttcatctctgcgggctcgattatccccgcgacacctaggcgacacagcacagctggcggagattctccgcgacagggca

SEQ ID NO: 507914 - DNA, 764 bp, Homo sapiens
  misc_feature (434)..(435): n is a, c, g, or t
  misc_feature (677)..(677): n is a, c, g, or t
  misc_feature (706)..(706): n is a, c, g, or t
agcggagaattgcttgaccccgggaggcagaggttgcagtgagctgagatcgcgccattgtactccagcctgggcaacaagagcaaaactctgtctcaaaaaaaaaaaaaaaaaggaaaagaaaaaaagaaaaaagaatttctcaaaatgggcaacattaaggagcatttagagacccaaggctttgtgggcccgttcttggacagcagtgcccttgtttgcccacgtgtttgtgcacccctgtgattgtgccccaaagtggttccccaccgttagaggaagggggatagaactgtgagccgtcaaacgggggaaaacctagagcctagaggggcaacgaaaactaccggaccataaatgtggaggccagaaactcttggttacacaaggcccaatcattaggaagccaacctgggggccacacttagggttcnncccaaagttgtgtttcagagccagaaagggtgtgggcagcccacctttattagcagcactcttagtgggacttacattgggtgtaactgtgagtaagtttgcatctcttcagaaacacaagcgtctacactctgtttgccccaggcctggagagtaccaagggtggtcatcacacgagctcaacggcgacgcctttgaccctcctgggacaaagagagagcggatccctctttgcgctcaangcctcccggaagtagctggggcactatanggcgacattggccaccaagatcctgtggcgtaaatttttaaaatctctttctgagaga

SEQ ID NO: 507915 - DNA, 730 bp, Homo sapiens
gaagtgaatcctgacgctggggggcttgctcgtggcggcagcgcatgttgtgcggatgggagtggggcctggctcggcgcgcccatggagcgccacggcagggcttccttgcagacctaccgtctcgatcggatggggagcaggcgggccggggagccccgaaggggcggcggacagtgagaccacttgctggcgcacgggtcgagacagcgccgtcgggtggcccgcggaacgggggccctcggaatgaggtgcacgacggggggatccgacttgggctctatacaggaggacacccagcgttccgtgttcaaccccagaacaggcgccgatcggagaggggccttggaggtgaaaaaacaacgcggccgcgcgtttatgcgccgtgggatatgggcacctggcagttactacggatggaaaactacgtggatccgacagcctggccacgtacattatatggcagcccagagacggacatcgagtggacttgaaacgaacgaacaggagggaaggcaacaggcaggggacagcgtcctttagagaggccatatcgaggaaaatgttagcctaggaccgctccaaaagtgcgggcatgacatgggggcatagagagaggcgagataaccggggaaacggttgaagacgttggaacgctggagaaggggagccgtaggactcactgttgtgcgaccgcagcaaagaatagggtcgcgcgtccaagaatggg

SEQ ID NO: 507916 - DNA, 125 bp, Homo sapiens
tctagttccagaacatttatatcacccctaaaaagaaatcaattacccatcagcagtcacattcccataaccccaagcccaagacagccacaaatctgctttgtgtctacctagattcccctgtg

SEQ ID NO: 507917 - DNA, 623 bp, Homo sapiens
aaaattattttatttatgtatgcattttataagcaactgattaatttaaactgaaaaatgatgaagtaaaggcctacagctctaagaatcatttctaggctgggcgtggtggctcacacctgcaatcccagcactttgggaggctgaggcaggtggatcaactgaggtcaggagttcgagaccagcatattttcttccaaagccatcatatatatatatatatatatatatatatatatatatttaaacacattacacaaactacacgacataaaggatataaagaaagaaaataatcagaaataagttaattcagatgtacatattcagaaaacaatattgaagttaaagaatatgcgacttaaaaatcaatacagcgtccttttcgttcccaatctccatatcgggtaggttctgggcccctgggtccacctttttctttggtcactggattaacatcatctggaaatttttccagtggttctttctctaaatgggaatcctctggtgcatcaaaacgaccttctggtaacttcggtttcttaaggggaccgtttgacaagttcaaacttttcctccttgagaaagaacttgttttccttcagaaaattgacacaagaaga

SEQ ID NO: 507918 - DNA, 373 bp, Homo sapiens
  misc_feature (34)..(34): n is a, c, g, or t
  misc_feature (58)..(58): n is a, c, g, or t
  misc_feature (96)..(96): n is a, c, g, or t
  misc_feature (274)..(274): n is a, c, g, or t
aacaggggtaaaaggccgggaagacaattttttnatattgggaaaatttttgtatttnagttagagggcaaaataaaggcatttttaaatatgtgnaggattcaaagtttaccctttacccatcctgtatttatttttatttatatttttgatatatagtctcgctttgttgccccggggtggggtgcagtggtgcaatctctgctcactgcaacctctgctcccgggttcaggcaattctcgtgcctcagctactctagagcgtgaagtgggnggatctcttgatcccgggaacctgaggcagtagtgagccacgatcgtatccctgcagtccagcctgggagacagagtgagaccctgtctcaaaaaaaaa

SEQ ID NO: 507919 - DNA, 1485 bp, Homo sapiens
  misc_feature (1089)..(1089): n is a, c, g, or t
taggggtccggatcaatcttaaagggcgtaacgcagccttatttatgccccacgggcatgtcctttgcggacacaacaacacacatgccaggggcccctcacaacaacccggggtgggcctggcataagtctgccgcccggccgaaactggggtgggaaaaccgaacacacacgctcattaggtccacgctgtgacccttacttggagggtgtgacaacacacacaaagatagtgccccaccccccttcacatcgggcgaaccgttactacccccgttctggctgggcggtgacaaaagcacaaggcggcaaactattttcccaatgacaaaacggtccgttcgttcgccgcatctctgtcgtggcgatggccttaaatggcgaaaaaaaacggtcgggccgtactacacccggcgttcccaggtcattgtttggggccctcgcaaaagacaccaacctgtgtgatacttcaggtacatcggttttagtgcgcaacgcgtcgcgcttgggctcccacttaaaggagttgccggacagactcctgacatgacagaggcagacaagattggactcttgcgctgcgctgtgtgctccagacctcgggttctcaaatacttttcttgggccacaagacagatgagaaaggctctcatgagactttgtcacagacagagatgggtcagagttacgcaaatttcctgggagacacacggtcttagtgttctcgccagaaaagaccggagagatgtctttttacttacacagcgacagagttaggtagaaagaggaccgttggcacacgccactctgggcgagggaacacccaccacaacggcggggtttcaacgcgcaaggtaatattcggggtgctcccccacacgcgcgtagacaggatagtttagagaactttgtcaaattgccacagacgtaccccgaccgttaagacacacagggacatgtcacaagaacgccttctgtctcttctgggacacacacacaacacactgagagagacgttctctgtctggccgtctgcacaggctgttgtcttagcggtagttttgtgacacacttgctgtaaagacttanctacgactattacacccttactagagaaggtagtgcgatttgttgttaactctgtgatatttacagactaagaggttaacagattcaggttaagaataaagagaacagacaaaggaagtattctgtctatgggtgttgtgggagtccaaaacagataatactttggttgttatgcgacgcaagttgataggttgtatgtgaaatactgcatgttgtgtaggtgacctggatgtacaacagtgtcttcgttaaaagtcaaatgtaaatctaattacagattaacgaaaaagagcctgtatttaagctcatatgatctcccttcagcaacttattttgctttaatttgctgtaaatctaagcaatatttttttataaaccagtaggagaaattctgtc

SEQ ID NO: 507920 - DNA, 122 bp, Homo sapiens
ctctctctagagaggcactgacaaccatctcccagagctcactccgtcctgcccaatctgtattacatctctaactttgtacgcaagctctatccagtactactaacctcagtgcgatagac

SEQ ID NO: 507921 - DNA, 289 bp, Homo sapiens
  misc_feature (11)..(11): n is a, c, g, or t
  misc_feature (41)..(41): n is a, c, g, or t
acgggtcaacnagtctgccttgtctgtggagacggattacncctttcccctgctaaaaggtcaaggcctttttgggtgatccatctgcctttgtgggtgctgcccctgtgggtgctgcccccccaactgctcctgttgttgctgcagccccaggtaaggttgaacccaaggaaaagtcggaggagtcggtccaggatatgggatttggtctttttgactaatccccaaaaagcaacccacttagccagttttttttgcaaaacaaggaaataaaggggtacttttttta

SEQ ID NO: 507922 - DNA, 193 bp, Homo sapiens
gctttgttcaaggttaaaaagaaaaagtgggggtagggagatagtctctgtggtaggtaagtttgagaaatgctacatgccatattcctgtcttggaggcttataaggcacactaaaatattaaagactcttagaaacttaacctaatgtgtcctaaagatattgggacatgggattccttttttcatggcac

SEQ ID NO: 507923 - DNA, 341 bp, Homo sapiens
ttctaaacccatgtctcatcgttccctattagatgagtgaacgattccacacgctttggtgaattctgcttcacaagtgattggaagagccgacatcgaatgatcaataaagcgacgtcgctatcaacgcttggccgccataagccagttatccctctgttaaattttcttcccccaccagcttaaaacccaaaaggtcagaaggatcgtgaggccccgctttcacggtctgtattcgtactgaaaatcaagatcaagcgagcttttgcccttctgctccacgggaggtttctgtcctccctgagctcgccttaggacacctgcgttgctgatgtgccgat

SEQ ID NO: 507924 - DNA, 528 bp, Homo sapiens
gtgcacacagagaaagaagtgcatagaggtgttgtactcgcaagacgatccagtctattcaatctccatactacagctgtgaaccataggacaggggcccggcccagttaggactattggccaggcatgtcactttctgaacatcagttttattagctctaaaatacgactggtcgctcgtctattacaatagcagactacctttcatacagacctccatcctctgacacccatgcctgacacccatgacccgtcagtaacagcatgaggaggcaatgcgcaagtgtcgttgtacaaatggccccaccaggcagaaaatcaccagacaaggtgatttctcagcttcttttcagctctagttttatacatctcaagttggaaaggaactttcctcacattcatcatgttcccaaggtttctctttgagatgaatactgaagcttgaactctactaatgggttttcccagtttcactaaatttgaagagttgctctagcacaaattctctaatgtacaaattctctaacg

SEQ ID NO: 507925 - DNA, 582 bp, Homo sapiens
atgctccgtgatcactgaggtagctctccctcacggtcctatccccaactaactagagcgtccaaagtccatgactgcaggcagtctataaatgtcctctgtcttactggctcatctctcactagtatgcttgacacagaggtgaaacctcctgggtattctgttttaacccaggaggcggaggttgcagtggagccgagatggagccagtgcactctagtctgggcaacagagactctgatctcaacaaatgatatttagagaagaatcgataaaataaagtactgactttccaggctgagcaaggtgtctcatggcttgctggtcccagtcgacttggggaggccaaggccagggacacatcactcgaggccaggagatgcgagaccatccgggccagtgtggcaaaaacccatctctacaaaaaaaacgcacacatacttaggtgggtgtaatgccagcttgataggaggctgaggcctaagaatttgcgttgacccggaaggcagaggttgcagtgagctggatatgtctcactgcactccagcctgggcaacagagcaagactcatggtaggtgctc

SEQ ID NO: 507926 - DNA, 420 bp, Homo sapiens
acataatagacttattacacattaggagtacatctaaccgctactacctcaacccagacctaagccagactttattctagtaagaaggtcagatagtaaatatttcagccttgctgtccctgtggcagctctgccatagtagcaatgaaagcagtcatagaccatatgtaaatgaatgataatggctgtgccaataaaagtttatgaacactgcagatcgaatttcacatactttacaaattatcaattatatagtgtcgatcattagaaaaacaggtagtgtattggccagggtttgctgattcctggactagacaaagccaagttcacaaagatttgcctcttagatctagtagtggtcgtagttccacaccttcttttttcactgtttccttaaggtagagtgtacatatttataag

SEQ ID NO: 507927 - DNA, 822 bp, Homo sapiens
cagtctctacaagatctgtcctcgacacccatttccttgccgccaaatttcgtgagatctacaacggattcccccccccatttgctctccccggccatgttatgtgccccacccccgcaaaatcagcagctcgccagttcgcactagatactttccttacaccaaggctccaccgcttttttaccaaatctcccttaagtcggttactcacaccctctctcagtggtgggcccccatgtcgctgtcccctcgggagtgggccggtgtatcgcccccacaatgcgggctcttctccagatgtcgccccagtgttccgccggttcaacccttggcccgatcaattgcgcccgggccctggttctcctgtccatattgcctcgcggccgtaattttacttttggtctcacagccacgcaatcttgttggccgctatcccccggatagcgccccgccacgattccttgcggcggtaccccccgatggcgcattcacccgcccagtggaacacatccctcttctacctctcggggggcgccactaacacatcttgtcacaccgacgcgaatattgcataatatctttccccagttcggaccacccttttcgcttgtaaagccacaatgtactccctatggtttcagaacccctctccctcaaaccgcggcagtactaattgggagtacccccccccctctcacaccaccatcgcagaaaccccccttaacactgataattcgttaccccataatagggaggaggttcaatcaccccccaaatcgtgtttttacccccccccgggccccagattttccccaacataca

SEQ ID NO: 507928 - DNA, 190 bp, Homo sapiens
  misc_feature (7)..(7): n is a, c, g, or t
  misc_feature (130)..(130): n is a, c, g, or t
  misc_feature (145)..(145): n is a, c, g, or t
  misc_feature (163)..(163): n is a, c, g, or t
  misc_feature (173)..(173): n is a, c, g, or t
atgaatnataggcgatgcccattctttctctcaagctaatgaagtcctatggcattctaaccacaaccctcggacagactcctcctattcctccatggcattgtaaccacaaccctcggacagactcctnctattcctccatggnattgtaaccacaaccctngggcagactncttctactccttcatgg

SEQ ID NO: 507929 - DNA, 398 bp, Homo sapiens
tataatttgatcttcaagcactgataccctttcgtccactagatcgaatcggctactgaagcttgagcatgcgtcacgtagttctggcaccatggttttcagctccatcaggtcatctaaggtcttctctacactgctgattctagttagccattcgtctcatcttttttcaaggtttttagcttccttaccatggattcaaacatcttcctctagttcggagaagttggttattaccgactttctgaagcctacttctgtgcgaaacaggcagattgaaaaacttaagatgatcaaatccagcagggatcaagctttggctgaacattgtcttgctgcactaaccgaatgtgctgctagcggagatgggaaattcctggctcttgcagtggatgcat

SEQ ID NO: 507930 - DNA, 231 bp, Homo sapiens
atcccctcgcgaatcgtgtatccgtgattgttcgtataaatgttcagtacatatctgtaaagtccatttgttccaaggctatagttataatccattgtttctttgactttctatcttgataacctgtctagtactagtcagtgtattactgaaatcccccactattattgtgttgctgtctatctcatatcttaggtctattggttatatgttggatgacacgttcgcgag

SEQ ID NO: 507931 - DNA, 284 bp, Homo sapiens
ttttaaatcctgagtcaagccaaaaattttaaaaaaaacccaaaccaaaccaaaaagaccaattagggcctgcccaacctaatttggttttcggcccaggttggttttggcaaaaaaggggggaaccccaactaagcaatagcccgcctaaaacctttggcggggaacgagggggggcccgaactcgaaaaactctggttggcggacccaaatttgcgggagggggcccagcgagccaagaagggcccccccgacccacacggggtctttgccctaaggggggg

SEQ ID NO: 507932 - DNA, 301 bp, Homo sapiens
ggcaatggtcgtggaggccgagggcgaggagggacccatgggccgtgggaggcttccgagggggcccgggtggtggggacagaggtggcttttgccctgcaagatggattccagggtgagcacagacaggatcgcagggagaggccgtattaattagcctggctccccaggttctggacagctttttgtctgtaccagtgttacctcgttatttgtaaccttcaattctgatcaccaaggtttttttgtgctgctatgtattgtactatactctggtccattaaaggtaccattttagtaa

SEQ ID NO: 507933 - DNA, 451 bp, Homo sapiens
attttgtacttttcattctggatgggcttggccaaaacaggctcaggccaaagacctcccaagctgtatgtacttccagtatcctgaatcagtgtttggtgacataatgccaagggtaaacaagcctgatttaggcactgctttatccaggggcttcacccatgaaattaataaaacttatctgagtcccttgaaacttggttcccagaaaacccacttctggcttataatgtccttgtacggtcccccgacattgattatctgtccctcatgatgtgtttaaactgagtagcagaaaacagaggccacactttctgggaaattttaaaggaagaaaccatttttaacgcgatgccaaggttcaccttttccacgaacccaatgccaattgccaggaccggttcggcaagaaaaccgctatgtaatttaataaactgatttaatggatata

SEQ ID NO: 507934 - DNA, 114 bp, Homo sapiens
tgcggtgactctagaggactcccgacagggcccagcatgttgtgagcgaaccgacaggaccattgcgcaagggtcctgtcggttgctgccctccccacatgctgggcccgtggt

SEQ ID NO: 507935 - DNA, 359 bp, Homo sapiens
  misc_feature (82)..(82): n is a, c, g, or t
  misc_feature (87)..(87): n is a, c, g, or t
  misc_feature (159)..(160): n is a, c, g, or t
  misc_feature (184)..(184): n is a, c, g, or t
  misc_feature (190)..(190): n is a, c, g, or t
tccttcctgctcacatccacagtcagggcacggcgcccctcaagaactccagagtcacctgtttcatcggctcccagcaagngcctntttgtttatgatgtcccccttttttgaggcctggacccacccatttttgtccctggggcctgctcccagccnnttaggcccgctttggccagggganaaggantttccgtgggttttccctgtgccccgtctccctggttggttctcccctcccttccctggccggctgccatggccaggaggtaagtgcctttttgtgtgcaaccccttaccctttttttgaaaaacctgttttcaggaaggatttgataaactcatttactttcaggtga

SEQ ID NO: 507936 - DNA, 275 bp, Homo sapiens
cggaaagtgcgctcgcgaaattttggcagtctgggacatgaagcaccgaggtaatggtgttcaccgcgcccatgatctgtgtactgcatctacgtgcaacctttacagtttactgatcgtcgtttatactactgatatctggctgctgaagctatcttctaggtcaatggtgcgtcattgtcccccgctccatcctggccaccgctctccaagaatttcttaaaaccatctagtgtccgctcaccgttgtaatcaatgaccgttctgtctgcact

SEQ ID NO: 507937 - DNA, 196 bp, Homo sapiens
gttcattatcactaccaggctgtgcacagtggctcatgcatgttatcccagccagcactactgatgttttcggccacgttgattctttcttgtgggggctgtcctgtgccctataggatgttagcaacatccttagtctctctacctactagatggcagtagcaccccctctatgtgtgacacccaaaaatatctc

SEQ ID NO: 507938 - DNA, 212 bp, Homo sapiens
aaaaagacgaagaagaagaagagcaagggcttcgcagcagggaacaggaacctgataaagaatcaggagcctcagaggatgaaatcgtcattctaagtcaaagaaggcagacagacaagatcacacattatatgatcccatctaatgaaatgtccagaaatggcaaatccagagacagaatgcaggttcacagttgcccagggctaggggag

SEQ ID NO: 507939 - DNA, 401 bp, Homo sapiens
attcgcggccgcgtcgactgactaatacctgggcttagggccacaagtatgggcatgggtgcttacaaacatgattttagagtaaattgggcctctcatttatactggataaagcctttgagtagtatagtgtactaaccaggcgcagcggctcgcgcctgtaatcccagcactttgggaggccgaggtgggtgaaacgaggtcaggagttcaggaccagcctggccagcatgttgaaaccccgtgtctgctggaaaaaacaaaaaattggctgggcatgggggtgggcgcctgtgatcccagctacttgggagcctgaggcgggagggttgcttcaaccccggagggggaggtggcattgaattgaggacatgccactggactccagcctgggtgatagt

SEQ ID NO: 507940 - DNA, 581 bp, Homo sapiens
  misc_feature (140)..(141): n is a, c, g, or t
  misc_feature (154)..(155): n is a, c, g, or t
  misc_feature (164)..(165): n is a, c, g, or t
  misc_feature (185)..(185): n is a, c, g, or t
  misc_feature (203)..(203): n is a, c, g, or t
  misc_feature (218)..(220): n is a, c, g, or t
  misc_feature (262)..(262): n is a, c, g, or t
  misc_feature (326)..(327): n is a, c, g, or t
  misc_feature (380)..(380): n is a, c, g, or t
agcgggcggcgtcgccaggaggagcgcgcgggcacagggtgccgctgaccgaggcgtgcaaagactccagaattggaggcatgatgaacgactctggctgcatgtttgtggggctgctggctgaaacctgggagagtggnnggcaggtcctggnngggaccagnnacggtctcgagaccaatggnaagctccaggaacatggntccaatcaggggaannngtaagtacgtcaactaacggacaattcagaaatgcctgtcanagcggggtgaaagcagatagaagactctcagtagagaaaaacaagacggaagggagcggcaagnnacactgggctccgaggcagaccgttaggaaaggaaaagcccaagacgcacacnggaacacggaacaaacggaacaggcgaacttggcccccccctaagaaatcttggcaaagaaaacacccataggcgggacaaaaaattcacacgggcaaggaaaaccataaataaaaggccttggaaccacggggaacgctctttccccccaaggggagaacgttgggttgggccaaagtgggaacggaaacaccaaattag

SEQ ID NO: 507941 - DNA, 277 bp, Homo sapiens
  misc_feature (24)..(24): n is a, c, g, or t
  misc_feature (47)..(47): n is a, c, g, or t
  misc_feature (51)..(51): n is a, c, g, or t
  misc_feature (80)..(80): n is a, c, g, or t
  misc_feature (148)..(148): n is a, c, g, or t
  misc_feature (208)..(208): n is a, c, g, or t
  misc_feature (237)..(237): n is a, c, g, or t
aagagtccctgtttcttccttttnttccttttcacccagtaaaattntgtnttaccattcaaattgtctgcaagcctgantttttgtggccatgggacaaagaatgccatctttagcttcacgaaggaaaagtcctgcaacatttttnacccccaacatggggctcaagaagcgaaaattgtgttaaggaatggtactgaggcatttnactcctgggagaagccccctctgcctgtntatactcagttctatttcttcaatgtcaccaatccagagg

SEQ ID NO: 507942 - DNA, 936 bp, Homo sapiens
atgtctggagaaagctttatggagtgacgaccagattcagtccctcggtctttcgagcagccgtatacccagtctagtcagccttgtaagtgcccttaggcttgttcccccggtcatttcgagtgcagtatccccagtcaagtacgaccactcaagggacgaaagaattgcaagcacgtatagttccttggggattcctgcgccaatgcttagcgatctctagagtccattcgggcaagtatcgtcgctcatgagtctaacgctggagtcactgttcatgccttgcttggggaatacagtgccagtcctgccttgatgccagacatcactcttcacgggacagagcgcttaactccaacatgtgacctggactcgtctggaccttcgtcctccactagctctccaggaatcatcccgcctggggaccagctggagggccacaaggcacacacagccgtagctagcaccacaagggagctactgtctgcaccgttagacggccacatgcccattcgccacaggtgaagtcagggctcctgtcctaccaagcaacactcaagttcatcttccctacagtgttcttcattctgatctgtatgccaaacattttgcctgttttactgtttacacaacatgatacgcttgatatgagactgaaacccctgcggttgtggagggaaactggctcagagatggacaacctggcaagctgtagagttccctgcttcctgacatccagcctcattggaatatgcaagcaactccgtgtaccacagtaccacggtgttctggcagaccagggacacctgggccaatgggccatctggaccaaaggttggggtgtaggggccctggatggcagtctgctggcccagagcatgaatacctcgtgtgcctcctccctcaattactgtttcaccagagcataatcatagc

SEQ ID NO: 507943 - DNA, 462 bp, Homo sapiens
  misc_feature (14)..(14): n is a, c, g, or t
tcagaagagacccngtgccggagccacccagccgagccactgctgagatcctgaccctcagaaacagaagtaataaatattgttaatttaagctcctaaattgggggcagtttgttacacagtgatagataacgaattcatactccgtaattcccctcgcacatttgtggtgtctttttaaaaataccaattctcatatacacagtggtctgtttctgatcgctctgttgtgtttctcaggtatttttgtttctgtgcccgaactgataccgttctcactgttgtggctttgcagcctatcttaatatctggcagggtcggcctttcctctttgctcttatttttaaaaactgacctaagtttgggaggatggcttgagcccaggaggtcaaggctgctgtaagctgtggtcatgccactgcactcagcctggatgacagcaagaccctgtctcaaaaaaaa

SEQ ID NO: 507944 - DNA, 431 bp, Homo sapiens
gggacacggcagtgcacctgatcctgcatggtgactctatgagatcccctgaaccctcgagactagaggattcttattatcttcagtggacggatagtacacgtcgcagatctatccggaatttcgacctgcacttgagatatctatcaggctatgagacagacttcgactgtgcctatgatctcttctctgaggcctgtgtcagggaatataagggttttgagagaactatcttcgtccgggcaaaaactgaggttagcgggcctatcagctgtttcttctcactccaccactgctgctgactggaggagcagcctggatagcagccgccctcccgcaaacaggtaaaccacattacctattcctgtggcggaggcaaatggatggtcaaacctaacggggtagtgctgaagttcggggacaaaagccca

SEQ ID NO: 507945 - DNA, 101 bp, Homo sapiens
attttagcaacatgaatgaaaggcacctaatgttttaaattcccccttaaatctttggtgcctttcattcatgtttgctaaaatgccacttaatctaatat

SEQ ID NO: 507946 - DNA, 568 bp, Homo sapiens
taatctcctccttgataaagcaataacatgcttgagtctgtggcctaatagcatgtcagaatcctctcctggatggtgatttataggacagttgtatgcatatcaccagtctatcttttacaacttccgaccattacctgtatgctggaagtaatgacatatatgtggcatttatttcacaactcggggcaagttgcatatttttaccagtacgtgtcgagtacccacatcgcaggtactttttaaggcccccacattatatgccacagttacatcgacatatcagtcattcaccagtatcttgaatctaatggttctctcactcgcccacacatgcatgtatagcattcccttccatctcaagttccttgtgttgcctatgtggtccttcatatctccatgtatcgaagaaaccaacctatcttcccaccaccacgtcctcgctcattcgccctctcacctcccagcgtccacagtcacctcaagcctttctctacacccgaccctccacactaacattgcctctgcaaatccccatattgtggagccccacgtcgcatgcccgccc

SEQ ID NO: 507947 - DNA, 801 bp, Homo sapiens
tgcaagtacaagaaaatagctcttataaaagaatgtcttggtatgtctcaaggtaaattaaggatttactgaataaggtgtgaccaaatccagaccatttctattggatattctttatatttatttatttttggagatggagtctgtgcttggtcgcccaggctgtagtgcagtggcgtgatctcagctcagtgcaatctccacctccccgggttcacgccattctcctgcctcagcctcctgagtagctgggacctacaggcactgccacatgcctggcataaccttattggacatatttgagacgtacgaacactgggggtttcacacattgtttagccaggattggttctcaaatctccctgacctgtgtgattccgcctgcctgtggcttcccaaacagtgctgggacttacagtgcgtgatgccactggcgccttggccagaccattttaaaaaatgggcgacaattctaggtgagaacaaaatggcccttgtaacatatgcttaggtttaaattcagttgggatggcactacctaagcggaaaaatgggagaaaacttatatacgtttctcaggaggaaaattatcctgacatctaatgggtcatccaatgggataattattttaccccaagagattttcaagtaagttgacaaataaagttcttaagaactcaaggtgctgtggttacggggcataaatacttaaatctatttaaattttttaaaattgggcttttaggatccaaggcgtggaaaactttattaaaggattattactatgaatcactataacgg

SEQ ID NO: 507948 - DNA, 134 bp, Homo sapiens
tctagaggatccggtcggcgaaggggatgtaggcgtcattgccctgctcagtgtggctgcatttggctgcgtctggggtctggtcctttgtgcaaatgcttgggattccagttgtgagctgagagagatgatgg

SEQ ID NO: 507949 - DNA, 577 bp, Homo sapiens
actgatccaagatatgagtgtgaccatggatcaagtacaaatagcatttactttcagtgccgggcttatggggctaattttctattctcgtaaggaacatagtggatgaggaattaattagatggaagggagatattgacagctggaatttcatctttgcttttgtttaacatctatcatgggtagtgctcagggaggagcatgtgagggtgcagatcactaaaaaatcatatatatgtatatgtgtgtgtgtatcatatcacatatatatatacacacacaccagcaaaagaagtggacaatcagaaaattcagttcatgtcctaagtccttagcattacaggaaaatgcacagcatcaaaacctgaaataaaactaaccaggtcacctcaattagtcagcaagtcttataagaaaaaaataaataagagactcacttggaggttatactcttaacacggaatggctaagggtacacatctgattcttcatgagacccggacgactaaaaactccaatctcacctaggaagcctatctcctccactagtcatattacatcattcccttaagggcac

SEQ ID NO: 507950 - DNA, 914 bp, Homo sapiens
agcggagttcgcggtcgcagaggagacaccgccgcagattgccggtacatcgcgggatttcatggctctgtgtgcctcattgcgtccttaaatattcaggtgtgtctatttgatgaactaatcgagatagatgcagcagaaagcccaacgctatccaggcctagcgtttgtaaaacttaggaacaatacgagcatgagaacacgagagaggtttgacgcgctactcgagtttcgaatgcactgtagttgatctcgaaggactgtaacatgaagagccggagtagctagatttgcgaagcaagtatgctagagctttcgtatgatgcattcatggatgcataaactattgatataccggctgaagtatgcattgaaatcacggtcatttgaaacattcctggttgagcgtaggatgcgaactgcattggcccgcacggtaggatactacatggtctagcatggactattggatgcgataccagatcgtcttgcgatgtaatgccagcgctcaagcaacgattctagaagaaccaattgcaacagcatttttgcttcggaggttgtcttaacaaagctctaatccatggcgactatcaatataacgctggtaggacacacggttattgatagagtgacagtaaggaaagaagctgtgtagctagattctatgaaggcggtatttgcaagtagtacggagagggacagcaagcataagctagatgtagacgtgagtgattctttactggactaattggagacatctctaaattgtcagtaccgagttcttaagtgagacctttagtaactcgaacaatgtcgcggttgagcagaaaagagaggtttacagacagctatagagctgatgaaagcatctattaaaattcgattggaatatacatgagcacacggatagc

SEQ ID NO: 507951 - DNA, 431 bp, Homo sapiens
aagtcaagtatgattgtatttttagtagagatggggttttgccatgttggccaggctggcctctaactcctgatctcaagtgatcccccctgcctcagccacccaaagtactgggattacaggcatgagccactgcgccagccacctataaataattaagcccacatcccaagaatgacatttgcttacatcatcataataccattttaggtattataaatggtaatttcataatatcatctacaacccagatcatcgatttcttcaaatgaaggaatcatttttaactaggttataatcaaaaggttatttgggatggaagtatagtaatcctgtccctttatatccacaggggatggtttccaggaccctcacggataccaaaattcagatactcaagtctttatataacatggtgtaatatttgcata

SEQ ID NO: 507952 - DNA, 272 bp, Homo sapiens
cccaactgacacatgtaattctttgtacagtatttagaatccttcccttcattatagcagtcctctagatattcagtcttgtggctaatatagatcataaacatattttaaaactgtaaaagtaactgtatgactcatgcttcaagttctgaaatttgggagcgttatgaggtttccatgccatataccgctagatcatttgcattctctcacagagtacacggaagagaattgagaagacttgtaatcatcctgacttctttcatgagatg

SEQ ID NO: 507953 - DNA, 483 bp, Homo sapiens
tcaccaccttctgcctctgtttccccaactgtaaaatgagggaataggactagatttctaacttcacttgcagctctgaaagtctgtgatacatccgccttttccacaatgtctttgtctgttacctacaagtcttcaggagggataaaaattttggtaagtaccaaagcttttaagaaagaggacagaaacaaggccgggcgtgggtgctcacgcctgtgatcccggtactttgggaggccgaggtgggcggatcgcaaggccaggagttcgggaccagcctggccaatatggtgaaaccccatctctactaaaaatataaaaagttagctgcgtgtcgtgacacagacctgtggtcccagccacttggggggcttaggcaggagaattgcttgaacctgggaggcggaggttgcagtgagctgaggtcacgctactgtattccggcctgggcaacagagtgaatccgtctcaaaaaaaaaa

SEQ ID NO: 507954 - DNA, 109 bp, Homo sapiens
ggtatttagatcatgaaccttagctgtacctcctttacgatgccaacctccaagagaaactggcagatgttttttctttggtcaccttgaagctgaataacctctccgt

SEQ ID NO: 507955 - DNA, 255 bp, Homo sapiens
tgcgggtctcatatgacagcctcaaggtggcagaattggtcagattttgccatgtttcctgtgttccattttaacactgacagtcaagttgcctaacagcgtatgaacaacatactgacatgtaaagggagtttcatctctatgtcttcgtgacggaggaccttaaagagattttttttctgtattatacgtggatacagtacactgccaggtgaaacaggagccttaataaagcatgcttcgcccacacccctg

SEQ ID NO: 507956 - DNA, 186 bp, Homo sapiens
aatcaccattcctcaacaccattcaccatcatttggtgttggtgaactggtgttgaggaatgtgtgttcgtgaatggtgttggtgaatggtgttggagaatggtgttggtgaatggtgttggagaatggtggtggtgaatggtgttggtgaatgatggtgatattcgcacgggagtgttgaggaat

SEQ ID NO: 507957 - DNA, 321 bp, Homo sapiens
ttttatttattttctatattttaaactggttttaggcttttcatttactaggccatttattttaattattttgtaacacattcttattcatttaatcttttattgcttgtattccattgaaaatcatttaatattgaatcctgtatataatattttatttttaacgaattttgttgttttcactgttattttaactcttagtatttaagtaattaacttgagttattttaactcttaagtattattattggtgctgtattaatgtatatataatgcatgatgatcatgtatatgaatatagcatggtataaaccacaaaaa

SEQ ID NO: 507958 - DNA, 475 bp, Homo sapiens
attcggtgacctacagctcatagatagacggttgatatatgcctgactcacaggtgaacttttgccctatatcaactcatgttacttatgatcagtcttcatctctttctattattgcacattttgaattgtctaacttgcacccagattatatgtcatcgcccaactacttggtcaaatatccttttctctgtgcttggaaaaccccttctgggtggtgctcaaacggaggctgaggcaggcggatcatgaggtcaggagatcgagaccatcctggctaacgcggtgaaaccctgtctctactaaaaatacaaaaaaattagctgggtgtagtggagggcgcctgtagtcccagctactcgggaggctgaggcagaagaatggcgtgaacccgggaggcggaggttgcagtgagccgaggttgcaccactgcactccagcctgggcgattgagtgagactctatctcaaaaaaa

SEQ ID NO: 507959 - DNA, 336 bp, Homo sapiens
cgcgatgactggccctacgacagcaaccgtgatgccgggcttgagcaggtggccagcggtggcggctatccgtcctgcaggcagtggtgggccgatggcagcaatggcctgcgcgcacgcctgctggggcaggtagacccaagcctgctgaatcgcctggcgggctgggccggctttctgagccgagccgaggtggacgactcggtaatccgcaccatcgcctcgccgcggcagcagaaactgaaccagggcaacgtctatacggactacggcggccaaatcgacaagaccctcccaaacatcgtgacgcgggccacgggcggcgtcggcatggct

SEQ ID NO: 507960 - DNA, 688 bp, Homo sapiens
  misc_feature (1)..(1): n is a, c, g, or t
  misc_feature (175)..(175): n is a, c, g, or t
naaaggaattaattattttggtaagtaaaaacatccttttaaaaagagccactgttctttgggtggttccggttagtattccaaaaaagtctcaatttcctgccattaagacattttcttcctaatggtatctaccatgtgcctcaaaaatcttattaggaaccctttttcttcntgcccatgtctctgcgtgagccatcaaaatagtctagacccgtcatgtgaatatttcatttaatcttgagttagatagtatcagcttgtattttatcattaaaagaaactgagtttcagaggagttaagtcatttggacaagatcaataggaagccgagtcaaacgtaggtctaacaagcaaacccattctgtttccccataccaactgcctccctaaatttctggcgtgtctggccgggtgcggtgactcatatctgtaatcccagcactttgggaggccaaggtgggtagatcacgaagtcaggagatcgagaccatcctggctaacatggtgaaaccccatctctactaaaaatacaaaaaattagccggacgtggtggcgggtgcctgtagtcccacctactcaggaggctgaggcaggagaatggcatgaacctgggaggcggagcttgcagtgagccaagattgcaccactgcactccagcctgggcgacagagggagactccgtct

SEQ ID NO: 507961 - DNA, 750 bp, Homo sapiens
  misc_feature (111)..(111): n is a, c, g, or t
  misc_feature (134)..(134): n is a, c, g, or t
  misc_feature (148)..(148): n is a, c, g, or t
  misc_feature (157)..(157): n is a, c, g, or t
  misc_feature (191)..(191): n is a, c, g, or t
  misc_feature (208)..(208): n is a, c, g, or t
  misc_feature (221)..(222): n is a, c, g, or t
  misc_feature (247)..(247): n is a, c, g, or t
  misc_feature (333)..(335): n is a, c, g, or t
  misc_feature (389)..(389): n is a, c, g, or t
  misc_feature (391)..(391): n is a, c, g, or t
  misc_feature (443)..(443): n is a, c, g, or t
  misc_feature (501)..(501): n is a, c, g, or t
agcgggggggtggtccaagaatcacactttgagaaccagtgctttggccaatctccatgcagagaaagttctcaacctctgattgcaagtttattttgaccatttaccatnacttcaacttcaatgctcgtctngaagggcatgactngtcatcctnatataattagccccgtcttccagcgagatcaganccacaatacgccccagnctcgggaggacannagagagaatggaagtcgtggagaangaaaagagaaaagtctcagaggaccagggatataccctcaggactagcactgtgcctgccgtagaacggggcctgctcagtgtttnnngggttgagctgcatcttagaatgaaatcctacaactgagatggctaaaggaatnanaaatggtatctgtaatgttaaatttcagactgctgcacaatatgtcagtttnaggtactttttaaaagatgaacaagtacaagacttcaaagaagtctctcccttgtgangggtcccttccggcttcactttagagtctctgctagtttgagttcatctcatgtgggtgtttcaagggacacagagaagccctggtttagatgatgcagggttttctggatgccaaggtgagaatgataaaatgtctgaaggaagaacacgatgctatgcattccaggcagaatctggacttgaaaagcaatgaagcacaatacttttagatgaactgattcactttaatttcgtaacaatctagaaga

SEQ ID NO: 507962 - DNA, 113 bp, Homo sapiens
gtgctttctctgtctcccagattccttccctggttgactatgactcatgcttgtatcacttatcacatggaatttcccagtatatgaattaataaaaatcaatggtttaccac

SEQ ID NO: 507963 - DNA, 390 bp, Homo sapiens
acttgtctacttctctgcgccacaattggggacttgaatgttgcatgagaatacagtcagtcagggcagcaggtgtctgtcagggtgggcacagggtactctccaaaactgcttctccctcccttgtcaggcttcatacccaacaccctgcactgtacccttgacgcttggctcagagtgctacaggtgtgtggacacctggggatgtcactgtgttctactgtggccctcctctgcagtggccagcttggtgtctgagcctcttacaatgcagttactggcagggttgtaccaggccttggggaggacagtggctggtgggagggatttgacgggcgtcagaagtcactctagagcccaggtgccgaacaaaatggtcacatgacaggg

SEQ ID NO: 507964 - DNA, 441 bp, Homo sapiens
aagcagacctcagggtaatatgaaaattagccgggcatggtggcacacacctgtaatcccagctcctccggaggctgaggtgagaggatcgcttgaacctgggatttagaggttgcagtgagccaagattgcaccactgcactccagcctgggcgacacagtgagacaatgtctcaaaaaaaaaaaaaataagctgggtgtggtggcacacacttagaatcccagctaactcgaaaggctgatgcatgcaaaactgtttcaactatgggaggcggaggtaatagtagagccgagatcacaccgatacactccatccgtctcaaaaacaaaacaaaacaataatacagtcaacttaaagtctatccttctatgatcactaataagcgggataactctaaacaatgtccatgataaaaataatcttccccgggcggcattaaa

SEQ ID NO: 507965 - DNA, 544 bp, Homo sapiens
aggtggacagtctagttgcaggaaaacaagctcagagatcccactgagtctacgttatagtgagttgtagaatcatttcattatatattactatgtagtaataatagaaataaagtgcacaatatatgtaatgcacttgaatcatcctgaaattattccctcattcccagtctgtggaaaaattgtcttccacacattcactctgttttttggtagaggcagggtcttaatatattgcccagtctgatctcaaactcctggcctcaagtaatatacctctctcagcctcccaaagtgctgagattacaggcataagccaccaccctcaaccaagactttcttaaaccaaataaaaattaagtgagattacttgagccttgattgtctgggttccagtggttctcccacctcagcctccctagtagctgagactacatgcctgcaccaccacatctggctagtttcttttattttttgtatagatggggtcttgttgtgttggccaggctggccacaaattcctggtctcaagtgatcctcccac

SEQ ID NO: 507966 - DNA, 307 bp, Homo sapiens
  misc_feature (11)..(11): n is a, c, g, or t
  misc_feature (18)..(18): n is a, c, g, or t
  misc_feature (43)..(43): n is a, c, g, or t
  misc_feature (103)..(104): n is a, c, g, or t
  misc_feature (112)..(112): n is a, c, g, or t
  misc_feature (127)..(127): n is a, c, g, or t
  misc_feature (158)..(158): n is a, c, g, or t
  misc_feature (204)..(204): n is a, c, g, or t
  misc_feature (216)..(217): n is a, c, g, or t
  misc_feature (241)..(241): n is a, c, g, or t
  misc_feature (265)..(266): n is a, c, g, or t
  misc_feature (270)..(270): n is a, c, g, or t
ctgagaacgangcgatcncctctgcagagcttcggctcttccnggagcaggtggaccagggccctgattgggaaaggggcttccaccgtataaacatttatgnngttatgangcccccagcagaagncgtgcctgggcacctcatcacacgactactngacacgagactcgtccaccacaatgtgacacggtgggaaacttttnatgtgagcctgnntccttcgttggacccgggagaagnagccaaactatgggtagccattgnngtgntcacctccatcaagactcggaccaaccagggcagaat

SEQ ID NO: 507967 - DNA, 399 bp, Homo sapiens
tttagtagggcaattcccacacaactgcacccctagaggttctctttacccattttggtaactggcctcaaaaccaaatactctgcattttatcaaaataacttctgggctggtggggtggctcacacctgtaatcgcagcactttgggaggccgaggtgggcggatcacttgaggtcaggagtttgagaccagcctggtcaacatggtgaaaccgttctctaccaaaaatataaaaaattaccaagtgtcgtggagtgcacctgtaattccagttactcgggaggctgaggcaggcaaatcacttgaacccaggagacggagattgtggtgagccgagatcgtgccactgtactccagcctggatgacagagtgagactccgtctcaaaaaacaaaca

SEQ ID NO: 507968 - DNA, 248 bp, Homo sapiens
ttaaaatgaactgaaaaatgagattgaacatttaatattttggatgtaacttttgaagaaagtatgctttggtgcttaaaattgtatatgattttaggtaagaaactttgataatattggcataatttagatttattttctttcttttttttgagacagtctcactcagtcgcccaggctgaagtgcagtgagctgagattgtgccattgcactccagcctgggcaacatgagcgaaactccatctca

SEQ ID NO: 507969 - DNA, 256 bp, Homo sapiens
atggtccagggtgaagatgttgccactcgtcccattccacgtctagtgccacaggtcgcacatttgatggcactgtcttgggagagaagtgtgattgtggaatgtgttcgcattgcaggacgtctgattataatttccaatttcattgcccctgacaagtgggtgaccctacgagttctgtctgtcgagtcatgctcagcagagccttggacgtgatgcaatacaggacatgaacattcaaaccgcttgtcgctgg

SEQ ID NO: 507970 - DNA, 895 bp, Homo sapiens
  misc_feature (681)..(681): n is a, c, g, or t
  misc_feature (687)..(687): n is a, c, g, or t
ctgagatcagctgaggaaagctttgccaagcttcagaggatcaaaatgtgcatttgggaggggtaggcgggcagatggcgccagattaaaaagatgctgggctcgctcgctgctctgaggtctctgaattgcctccagcacagcagtgtgcaatcaggaactccatcacacgacctaaaaacttgttgagtctctccaaaaagacttagcctgctacaagatactgagggggattgagatgcacttccagagggcctgagattctagaagcccagcatccaccagatgcctgctgaagtcgatggctgctgcacactctgctgaggaatcagatttctgaaggtccttcataaatacttcagtctgcaaagatgaacaagaggagcccgaagaatgtcgtatgaaatgaagactgagatactgagattctctcaaaacagcctcaggtgaaccaggagaataagcaggttaataatctttagtgaggaggctgggagggagggggccacatgtgtgccgcatacctgtacaagagtacatatttcctgtctcttccatgtcacgttctcttaagccccgaggcgtctacactgacaatttccactgcacagaatgcctttctcctcttctctgcaatgagatcagctgctcctcagtgaagctttctcagaagcctcccanccccanaccgcacacacattgacagacacagaggacagacagccctgtgccaaacctcagcctgtgtctggggtcttctccaggcaggacctgaggttacctttctcttcctccctagtgcttagcacagtgccttggttcaaacatgcactcactgagcctaccctggccaaggtcccggcgctggctggactaggctggcagtgtgaagaga

SEQ ID NO: 507971 - DNA, 133 bp, Homo sapiens
attccaaagcgtggacttcatggacttcattacctgaatgttgccttcaatttccttatccaaaattagattagttaatatataatcacagaaataagctgaaaattattcttacaatataaatacgaccagg

SEQ ID NO: 507972 - DNA, 125 bp, Homo sapiens
  misc_feature (109)..(109): n is a, c, g, or t
ggcagtgccttgcggctgtaatggctgcccccagctggcgcggggctaggcttgttcaatcggtgttaagagactagcagggtggtcctcatgttgtgagggagcgggngatccctttttcctta

SEQ ID NO: 507973 - DNA, 193 bp, Homo sapiens
tcagtatcttcgacgtactgctccagggtggcttgccatgcactggcgtacaggcccagtcgatgttcttcttcgacagcttgtcgccaatatgctcgtgggtttgcggcaccagcacattgggcaggtctggcttggaataatccgggttttgcgggtcgcggatccaggtgggccagtagggtggggccag

SEQ ID NO: 507974 - DNA, 154 bp, Homo sapiens
tcaggttatactttgcaggagtgactggtggtgttgagtaagatgcacggaagaaaatgctggaatctctatcacagaatgaatcttggaacaagcacgtgcatttgagtcacttcgtacttttcagcataattgtctttcttggccatccacc

SEQ ID NO: 507975 - DNA, 337 bp, Homo sapiens
cgtactgtcgcagctggtggcctggtcgtcagtggaaaataataagggtggcaggactggagtcagttgaagagtgctagttgactagagtggcgacatcatgacattttaaaagtcaaacgggacacatccctgaggccatgagtttgaccttttgactataggcattgatgggtactgagacaaggaaggccaggaggtatacgtgatatcaagtataaatatgctagaggactcattgtaaaggccaggagttgactgaagactggggagaagggtccaccgttttgcagatgtcatttctccattccctgctacactctctttgtgccccacc

SEQ ID NO: 507976 - DNA, 857 bp, Homo sapiens
ggtggagcggccagtgggcaggatgacgagccagacccctctgccccagtccccccggcccagtgcgggcgacgatgtctactgtttgtggagctgaacgtcgggggtgagttccactaccagcacccgtggtgtaccctgaggaagtttccgggctcaaagctggcagatgatgttcgtctagtcgttagccaaggcctccatcggatcgcggagggccgcttcttcatcgagctcgccctcagtgacctatttcagacccatccgtggactaccatgcgcactgggcagagtgcccactagcgagcacatcccgtgaagtgtaccgtgaggctcagttcgtacgaagatcaagcctttggtcaagctgctggaggacatgccacagatctttggtgagcaggtgtctcggaagcacgtttctgctgcaagtgccgggctacagcagagaacctggagctcatggtgcgcctggcacgtgcagaagccataacatgcacggaacgtccagcgtgcttgtgtgcctggtggaaactgaggagcaggatgcagtatcacttcagagcgtcctgtagtcttctgcaggatcacgaagatgttcaaggtctgttgtcgggctttgggctccatgcgaaggccgggtcactgagacaatacgtgcgcatgatcagtagcgcctgccctggacagaatgcgcaccttgtacgggccccagggagttacgaaggcggcatatccttccacggtttcattagcctggaacgttagcccccaaccatgagaggacaacgaaacttcgcatacttggacccattgcacttccacttccagccgttctaccctgggtggatgaattc

SEQ ID NO: 507977 - DNA, 417 bp, Homo sapiens
gttgagcagccagcatcctatcactcctggggagccagacctgtgctgctggggttaggggacagccaaggggcccagccaggacatgctgggtgtcccagcctgcaggcaggctttgggaaagaaatttacttttgtttggatggacccactggtccctcatcaataaaggggccggagtccagccctgcacagctcactttgtccacatgctgctacagcctgaaccggtcaaggacacgggaagcagaaggagcctgttacagcccacgagggtgggagtgaggtggaggctgcccaggaacagtgcatcttgctctgcctctgtaagtacagggccccggagcagggcagacccctggggcacaggcctgatgctggaagagctggctaagctgggtaatcatcttcaattag

SEQ ID NO: 507978 - DNA, 328 bp, Homo sapiens
ggtgggggactgggcccacgtgttcctgtgtgagtcctggatgcccccaggccctggcaggggcttgtaatggagcaggggtaggtaggggtatgggttccagaactatacaactgggcccctctccagtgtccaggggcttggagagacctgctccctcccctccactctcccgggagtcgctgatcactgggacctggtctccagccgattgcaggggaggcgggtcggagaggcgtgtgcttgccgtgggtggcgcccttcccccgccctgcctggcttgatccttgtacttacttaattaaacaagcccctttttaaaccttga

SEQ ID NO: 507979 - DNA, 444 bp, Homo sapiens
ctgggctggcaggccgctgtcccccatctgccccccagatgccaggagccagagatacatgtgcgggaggggaggcacggccgatccctcaagggcggagccgtggtgtatgctgtgagctgagcagccaggactccagccccagacaagggctgctgcaagggggtattcccaaggagcccctggtgcggagagaggagctaggcagtacaacagtgtgatgcctgggcccacggggagttgtgcggcatcaaaaacggtgatcggtcccatcagacgacgcccatgtctgtccagaattagctatttgcacctgcaggatgctgttccagtgaaccgtgctcggatcaaaactcccctggagatacaggaggatgaagcagcgaggttgaggctgccgtgaactatgatggtgccactgcagtcaaggctcgacaagagagc

SEQ ID NO: 507980 - DNA, 201 bp, Homo sapiens
  misc_feature (109)..(109): n is a, c, g, or t
  misc_feature (117)..(117): n is a, c, g, or t
  misc_feature (186)..(186): n is a, c, g, or t
gggctgcacagcttctcaaagtgctgggattacaggcatgagcaccgtgaccggcggaaagtgttgggattacaggtgtgagccaccgcgcccggccccatgaaacctncttatatntgggtttgacgattaaagtccacaactggtcattgtagtgtattatactactacacacacagcacacancgcaatatgtattaa

SEQ ID NO: 507981 - DNA, 162 bp, Homo sapiens
tgagtatcccccagaggtattgagggaggattgctcagcccaagagctcaagaccagcctgagcacttggagaaatcctgtcacccaagctggagtgcagtggtgtgaccacagctcactgcagcctccacctccaggctcaattgattctcctgcctcaac

SEQ ID NO: 507982 - DNA, 115 bp, Homo sapiens
aacatatgcaactttaggaatagggatagatgataattttctgtattgtttcaaataagtgacttttcagccctgggtacacatagaatatatatttacacacgtcacaaatatt

SEQ ID NO: 507983 - DNA, 237 bp, Homo sapiens
ctctataatggtcagagagaaattcattttacaatccttttttctcccccgccaagatggagtttcgctcttgttgcccaagctggagtgcaatggcgctatctcggctcactgcaacctccgcctcccgggttcgggtgattctcctgccccagcctcccgagcagctgggattgcgggtgcccaccaccacacctggctaatttttttaatatttttaatagaggcggggtttcg

SEQ ID NO: 507984 - DNA, 370 bp, Homo sapiens
  misc_feature (257)..(257): n is a, c, g, or t
cctttaaaccaaaaaaaaaaaccccggttttgggcccccccgtgggggttagggggggggtttttggtttaaaccccttccggttttttttttaaggaagggccttgggtttggggggggacctctttaacccctattaggttatttgggggttgttttttaggggtttttttccccaattttgcccgggaaatttaaggggttggttaaaaaaaccccccccccccgtcccgggaaattttttcaggggcccaagnttttgggaaacccctttttattgcccccccggttttccccccccccttttaaattggggggttgttttcaccccgggggtttttttttttttttgtaaaaaaccccccgggga

SEQ ID NO: 507985 - DNA, 320 bp, Homo sapiens
tactgtcccgttctcctacagatgatcatgagcaaactgagcactaagcagcatcgagagcggggacactgacctggtgttcacggcgtagtctgcacctgaatgaactgagctgaagccgagaatattttttcatgacccttcgtaatcagcccatgtccctcagtttgtaccgacagttctgttagcatcaggagctacagacgctgaacgacctttacaatcaggatgacaatcaccaggaattgtgcagcttccacatccgagccagctatgctgcataatagcgtattgaggggcgagtagcagctctgcagaca

SEQ ID NO: 507986 - DNA, 882 bp, Homo sapiens
  misc_feature (33)..(33): n is a, c, g, or t
  misc_feature (83)..(84): n is a, c, g, or t
  misc_feature (86)..(86): n is a, c, g, or t
  misc_feature (91)..(91): n is a, c, g, or t
  misc_feature (114)..(114): n is a, c, g, or t
  misc_feature (131)..(131): n is a, c, g, or t
  misc_feature (144)..(145): n is a, c, g, or t
  misc_feature (148)..(148): n is a, c, g, or t
  misc_feature (162)..(162): n is a, c, g, or t
  misc_feature (190)..(190): n is a, c, g, or t
  misc_feature (194)..(194): n is a, c, g, or t
  misc_feature (209)..(209): n is a, c, g, or t
  misc_feature (214)..(214): n is a, c, g, or t
  misc_feature (259)..(259): n is a, c, g, or t
  misc_feature (292)..(292): n is a, c, g, or t
  misc_feature (296)..(297): n is a, c, g, or t
  misc_feature (307)..(307): n is a, c, g, or t
  misc_feature (311)..(311): n is a, c, g, or t
  misc_feature (320)..(320): n is a, c, g, or t
  misc_feature (328)..(328): n is a, c, g, or t
  misc_feature (331)..(331): n is a, c, g, or t
  misc_feature (338)..(338): n is a, c, g, or t
  misc_feature (355)..(355): n is a, c, g, or t
  misc_feature (370)..(370): n is a, c, g, or t
  misc_feature (372)..(372): n is a, c, g, or t
  misc_feature (376)..(376): n is a, c, g, or t
  misc_feature (378)..(378): n is a, c, g, or t
  misc_feature (383)..(383): n is a, c, g, or t
  misc_feature (407)..(407): n is a, c, g, or t
  misc_feature (418)..(418): n is a, c, g, or t
  misc_feature (424)..(425): n is a, c, g, or t
  misc_feature (429)..(429): n is a, c, g, or t
  misc_feature (435)..(435): n is a, c, g, or t
  misc_feature (442)..(442): n is a, c, g, or t
  misc_feature (445)..(445): n is a, c, g, or t
  misc_feature (452)..(452): n is a, c, g, or t
  misc_feature (462)..(462): n is a, c, g, or t
  misc_feature (465)..(465): n is a, c, g, or t
  misc_feature (470)..(470): n is a, c, g, or t
  misc_feature (533)..(533): n is a, c, g, or t
  misc_feature (554)..(554): n is a, c, g, or t
  misc_feature (569)..(569): n is a, c, g, or t
  misc_feature (572)..(572): n is a, c, g, or t
  misc_feature (732)..(732): n is a, c, g, or t
  misc_feature (817)..(817): n is a, c, g, or t
  misc_feature (822)..(822): n is a, c, g, or t
  misc_feature (875)..(875): n is a, c, g, or t
tatctcaaatgttacattgatgaaatcaatatnaaaaaaaagggaaaaaaagtgacaggcaaaagtgaagagcaccagacacnnancgcanacctaaagtagaccatgcttctntccttccactgacaggntatcgtcccgggnngtnccccaccccctcgntttcctcctccgctttccctaggccgtntagngggggcatctacgcntcgtnctcgccctcctcctcctcgaactccccttgttcgtcggccgtggngtcctggtactgctggtactcgggcaccaggtngttnntgttgttttnggcntcggtgaantccatttngtncatgttntcgcccgtgtaccagtnttggttggttttgtncnggantntggcngtgaactgttcggtgttgagcttntttagttcctngttggnngtgntgttgnagatganggnggccganatcttcaggncgnggggngggatgtcgcacacggccgtcttcacgttgttggggatccactccacgaagtagctgctgttnttgttctgcacgttgagcatntgctcgtccacctcnttnatggacatgcggccccggaagatgggagccaccgtcagtagcggccgtggcgcgggtcgcagggggccatcatgttcttggagtcgaacatctgctgggtgagctcgggcacgtgagcgcccggtactgctggctgccccggctggtcaggggcgcgaancggggcatgaagaagtgcaggcgagggaagggcaccatgttcaccgccagcttgcgcaggtctgcgttcagctggcccggggaancgcangcaggtggtgaccccgctcatggtggccgacacaaggtggttgaggtcccgtngtggggg

SEQ ID NO: 507987 - DNA, 834 bp, Homo sapiens
atagcataggtgttggcaagacattctttatggaatggctgtcctttctgtgcaactaatgcctttatggtgcatttacgtcagacatcattccccgtctagtttactactatgcttactcaacaaatgccacacagcctatgacaggatatgtgaataatagcctgtcagtattcctgatagctgattttccaaaccacactgcaccttcggaaaaacgagacttcatcactgtgcaggtacagagattacagatatcctcctgatgacgagaataaatattttcataatatgcaattctggcatgtccttgctgccaagaatgaccttcatcatgtgttatggaacatgtgtgttttagttaaattttgctggcctggatgatacctgatgttccaaaagatgtgtggagagaatcaagagagaaaagttaatgactatcaagattctccatgattttgagctcaacaaattaaaagagaacttgggaattaattctaatgaatttggcaagcatgtcatgattgaggaaaacaaagcacagtggtaaatcaacactctaatcagtatagggagggaagccagcagtgatctgcttattcactttatcctctgggtttagggggcagaagcaagaaagcatgtgttcattttacctttccttttttcttttttttaaacccaagtgtttaccacttgatagaggcccttggcctggggaaggtcacatctgtgcatagggggacccaaaggggttgggggaaaacttgagggggaacaaaagcataggttcgtataaaggggggcgcacagagaattgggttggggacccaa

SEQ ID NO: 507988 - DNA, 1218 bp, Homo sapiens
  misc_feature (224)..(224): n is a, c, g, or t
  misc_feature (318)..(318): n is a, c, g, or t
cgatgcagtgcactctagacgggtgagcctgttccgagaatgctgagagagtgagtggtgtgtgctccctggccatcatcatggcgaggagagtggactcgtttcctctgagaggcttccgcatatgccaggcaagcgcattatcccgagatataagtggtggcgcgactcgacaactactgtgcacactgtcctaggagtgcgaagtacgctccactctgatncactctgataccatgtgactcgtgtgtttgtactaattgccaatagaaagtacatgctatacgcaggcgcatccatagcgagtacggacacgtnactctttcgccagcgagagttctgctgctgcaagattgtggcttggcccagtagtagacatacaaccgggtgtggcaccgtgcatggtcgtttgaatagttgcctcccatgcggaatgtcatgagcgggacagccatgggagcctccgatcgaattgagaccgttggtgccccgcatcgcgcgatcgtccgcagaagcgcatcgtgcgcgaactttgagcgtggggccttgctgtcaccgtctcgtgcgcaaacgactcttagctatacaacgaagattgcgctagcgcgtagccccctttccctggcgaggagtgccgcactggggactatcgtcttgtggcgcctacgcttgagccgcctcatgggtgcttgggcttcctcgatgcgcatctttcgaacgggacgagggctccttgcatgtcttttgcgcatcaccccctgctctctttagtcctgggggggtttgggcccattgattccttccctcttctggaagccctaactggtgagagcccctgtagccctatggccaccatcccgtaaaagaccccggaggggggccatcgtcagacgtccccatgtgggtgttgggtatgggtcgggccgttgggttccctgcattcgctatgcgccgtgtgttggggacccgtggtgggtgggcctccttgtggcccgggatttgagaacccatgaggtggggtggcctttcgctcgttgcccacccaggacgaaaggtgcttcacagtctttggcaagcttatggtgtggcggaaatgcccggtaccacatcccaacggttccaccgggaacattccacaaacacttcagtcagagggatgcccgggtcgcaaatagaagggacttgctgtggcctttttccaaggcagaaaagtcctgc

SEQ ID NO: 507989 - DNA, 280 bp, Homo sapiens
  misc_feature (80)..(80): n is a, c, g, or t
  misc_feature (90)..(90): n is a, c, g, or t
  misc_feature (107)..(107): n is a, c, g, or t
  misc_feature (145)..(145): n is a, c, g, or t
  misc_feature (187)..(187): n is a, c, g, or t
  misc_feature (216)..(217): n is a, c, g, or t
  misc_feature (237)..(237): n is a, c, g, or t
ggccaacaccatgtggaagcttccaaaacctggggcttgcattctctgaagcaacagcctgggttgcaccttggccccgntttagccacncctggagctggagcagnaaaggaaacagggtgccatgtcccaaggttgcatagancacagggtcctaggcctgtcatagtcatttgtttccctcctnagggctaccaagggccctgccagtggggnnatggggctgcccttggaagngttcctcctgaaaattccccttggagagaacatctttttcccc

SEQ ID NO: 507990 - DNA, 110 bp, Homo sapiens
gcggccgcctactactactactactgctcgaattcaagcttctaacgatgtacggggacatgaatggattattcctaataattaataaaaaggtattttttctactaaaa

SEQ ID NO: 507991 - DNA, 788 bp, Homo sapiens
  misc_feature (229)..(229): n is a, c, g, or t
ccctctttgtgcacgtacacacacacacacacacacacacacacacacccctgctcaagagaggtatagtatacatgtctctgaactaaagtagtaccctcccaaattgtttttctctaataagctgagattcccctatttctctttaagggagacagcatcaccactagtagagatcgtcttttctcctttctcaccatctatcttatgagacgccagagtatatatngttcttgtgtcataaatcactagtgtagcttttgtgttccaagtgactttgcatctatcgtgctctcctttttgtgaatttttaacgagatagtaatgataatatgttgggtggattttctcccctgctgggcatcagatgtatggtaagaggggtgttaatcttatcagcccaggtagttgtagtggcagtcctgagggaatatttcgtggcccaatataaaccccagtaatctcaaatcttaacatttagaaatataagggctccagggccggacacagtggcccatgcctgtatatcccagcacttttggggggccaaggcaggctggtatcactctgaggacaggagttcgagaccagtctggccaatgtggggaaaccccgtctctatctaaatatacaaaaattaggcgggcatggaggggagcgcctgtaatcccagctactcagaagggtgaggaggagaatcacttgacctaggagggggagttgcagtgagccagatggcgccttgcactcccgcctgggtgacaagaggggaatccttttcaaaaaag

SEQ ID NO: 507992 - DNA, 543 bp, Homo sapiens
agcctggtccggaatggcgacatttcaaattctggatttgaggattagggatatcaacctatatttgcatttcttaaaaaaaacaatgcgttatttaaatttgaactagagctatgcaatgtgcctgaatatccttgttgttctttgtaagcatttgggcattatactcatttggcccaattattgggatttggctatgcgcatctcagatgccagaatgctcgtgggaagacgagctgctgttatgtgtgagcatgagaccagctggtaaacatgatgcccaaggggaactaaggtgcacatcttgccttaaaataaatacaatttaaggccgggcatggtggctcacgcctgtaaccccagcactttgggaggccaaggcaggcagatcacttgaaatcaggagttcaagaacagccaggccaacatagcaaaaccttgtctctactaaaaatacaaaaattagctgggtgtggtggtgcacgcctgtggtcccagctattcaggaggctgaggcaggagaatcgcctgaacctgggaggt

SEQ ID NO: 507993 - DNA, 318 bp, Homo sapiens
taaaaaatgtaaaaatttttttaaaaaaattttttttggtgaaaaaaaaaaaaaaatgctgtaaaaatttaagtgaaacgggtaccccaaaacggtgaactcccaaataaaatttttcccccctacaaaaaaaattttgcaaaaaaacctaaaagcctttaaaatttttgggggggaaaccccaaaaccttgggggaaaatccccaaaagggccttcttgaaaggaaggggaatttcaaaaaaaactttttttgggctttttgggggggggggtcccccgggttttttaaaaaaaccccctttttttttttttttaaa

SEQ ID NO: 507994 - DNA, 919 bp, Homo sapiens
tggtaaagcggcaaaggaggtggtggctgcttggggctccggaaacccgttcgggctggggctgtcggccgcggggcgaaggcactcgcgcgggggatggcccattgcgttgacctttggttcagcttgtccattttccttggtgaccatctctcatttgaccaaggacttcggcctccaatttctgacccacttctgcgttcctttaacagagatgtgcggagggggacagttggcgctgagctttggcccggatctgaacgtgttgcgagaactgtctcaagcccctgaagtttctccaagaatcttctacgagtcttgaagttaccgtctttgaagaacatgtccagaaagtctaacgccttgtggaatcttatgcactatagaacaacaagaacgccagaagtctgagggaatgatgacttcctataagggggtgctagagtgttcccttagagacacagtttgttgtccagccaggtactagatatcttcccctttagatgctagaacgccttggaaaacctgcttggcgcggggagaccatcacgggacttccgtggagaaaatcaagatccatttctggagttctacccgccaggttgatgggaaatggcccctggtgtacagatctgaggtcatcaagaaacaacctgaaccctacatggaagcgtttctcagtccccgttacagcaatttctgaggtggagaaccccagaaaacgctatccaggtgcaatgctccgattatgacagtgacggggtcacagtgatctcaatcggatacctttccaacaccagctttggcccaacctgtaaggacagtcccgagttaagttcgaatgcatccaccctgtaaaagcggcagaaaagaaacggtcaaaaacttctggaatttaccgggtcaaattgcgcgtaaa

SEQ ID NO: 507995 - DNA, 1155 bp, Homo sapiens
acggggtcctaaaatcgagggtccgcaatgggcggatagatacggcactataaaatgcttttttatattcctgaagtgcccatgttctgtatgcgccacatagtttggtcattcctaaacttcgtggtctccgcggcactatcgatccggaacaaagcctttgattccttgtaatagcacccttaattgtgcttccgatgcttgtattcggtccttcttgtccctgtgttccccttatggaagcttgcctcttaataatcgccaatacaaaagtcctattgggaccatgttaagatgctatattgatgcctcatattgcgttgaacattcaggtttgtcgcttaactttccaaggaatacgatatttgggtatctacggcgtctacaggcgtctgcgtttggggtccaaagtgtaatgggaccccctggcccttctagtcgagatgctggagcttcggacgacattaccccgttcatctagaaggaattttcggatgctctattcttagggaagactgtatctatggtacctatggaaagcagatgagacgactgggaacgcttcttctaggctctaggtgagtctgtcactgtgggtaacgttgaggcttatcttgcggataaaggcgctcttctaggggcactaaagctcacctactacggctcttatattgtactgtagcttatagtctctcttactaaggtgtcaccttagtaagcatctactaaattgacttctttttcttagttgtatggccaggcagtccccattttaggagttggcttctgcaaattcaagtccagttgagctaactgattggggagcaatttggtagttgtagacatttgcagggaagggagatgtctgattctaaatgggagttgatgctcaggtccccagccaggtttgcatccagccctgagacatgtaggaaacacctttcagagcccaggctctgaagattcccagaagccagcaaggattgaagggaaaaggtgatcctggtaactgttccaggattgctccaggtttgagatggtattgctaaaatattaaaattaaacaagaacccaacaaacagcttttaaagtgtcttctatctcattgtattttttttaactgccccaaataacagccgaggtcttttgctgaaa

SEQ ID NO: 507996 - DNA, 316 bp, Homo sapiens
  misc_feature (15)..(15): n is a, c, g, or t
cattcttaaagaccngtatctatgtatacttttggaaaaaaagattgctaagatccaaggatattccgaagtgcctctttttctgtaagagtgaccttttaaaccaatgtaaggttttggggaataagaatcgtccacattcccacaggaaatcattgctatggtctaccctaggaatgtgatagatagcttctataattatggcagcttatccatagtatgaaacctgtagttttaatggtttagaaatctatgtctcatttcatatctaactcatgtttttgatacgaatcaatatatatgttgatatcatgag

SEQ ID NO: 507997 - DNA, 500 bp, Homo sapiens
  misc_feature (20)..(20): n is a, c, g, or t
  misc_feature (404)..(404): n is a, c, g, or t
  misc_feature (440)..(441): n is a, c, g, or t
  misc_feature (447)..(447): n is a, c, g, or t
agacctcatctaagcatgcnctgagctactcatgacgctgccaagtcgacgcagtggagagtaaggtgccagacaaacctctccaccctcagtgacccggtgcagctagaagtccatatcggccctttcccgacccatgacctccatgttctctctttgtgaagtctgattacttggtgacatgatcgtgagaataagctctggcgatataagaatttcctctcttgaaggccatgctcagtaaattacttggtgacatgatcgtgagaataagctctggcgatacaagaatttcctctcttgaaggccatgctcagtaataaagttggtctcaccgaggccctgtgacaccttagaaaccacgaattgccaggctgagcaataccagtcccgcccttcccctncctggtgtttacattgagttctccttcacaatttcnngaccantccgtggccaccgtcaccttattcctgactgccacaagagtctttcaatattc

SEQ ID NO: 507998 - DNA, 570 bp, Homo sapiens
ctgatgataaataagtataagaaccatagacacctattatagcccagggcgcagatgaagtagactatcccagagtgcacgaagtaaagagagtagctctagcgcaaagtgaccccatccaaaaggatgatccaaagacaagctcattgtcaataacaccaagagatagaaccccatatagagtcaaactatctatgcctcccctacattctccactttgtagaggagatattcaaatcctctcttttcctgttgattactgagcagctgtggaatccgcctggctcacaattatgccttcctttggccggcataacatgcaagcagaagtagccacatagtgatcatggacttacttcagatgtataataaatgacatcccatgagaatgccttgacagcagctgatggcacttggcaaaggcattcttcatatgccataggatagaattatcacttaactaagagtaagtgtctacaagcaactggagatcaggaactagagaaataattccatgtcccaaattgaaggttacagcagaatatacagtggagtgactagcatcccgag

SEQ ID NO: 507999 - DNA, 333 bp, Homo sapiens
gcaaggccccaggggtcctccctcttaacccatgtaggtgccagagaaaccacccccactccatgagaagaggctcagacagcaggctccgggccacgcagcccagaccacacctgccacggtcttccaggaacggtgctcacggacggcaaaattggaagtaattgggagcgatcctcagagagtttacaatgtgctttttccgccaatcagaactgtggacaaaacttcctatttcctacaccgcagctgtctgttcaccttcagtcagagagcactcctgacctttcgtaatgaaatggaagcctccccttgtctataaactcagtgtct

SEQ ID NO: 508000 - DNA, 243 bp, Homo sapiens
gcttttgcaacccatgtccgtctgcgcgctatctcgacttacggcatccagtctggatccggatagttggtgcacgagtagtaagaatgttgtcaggctgaggtgatactctgtcagtcccggttcaataattcgtcagtgtggaagtctctcgggtaggaattaaagtctgtcactccggatggtaataagtccgcataagggggggaaaatccgtatgatggaggacctagcgaatgttca

SEQ ID NO: 508001 - DNA, 637 bp, Homo sapiens
tagtagggatgaggtctctctctcttgcccaggctggtctcgagctcctgggctcaaattgactccctccttttattgggcattgacgccaccattgccttatgcctttaattagaacgacagatttaactcacagaggtgtccactttcaaaggggtagcctcttgaaagagtagactcctgtggtggtaaggccctccgtgagcatttgcagcctcttggtgccccgcagtggaagtggcaaggcagtggcagtggcagtggcagtggcagtgcgactgcgcatgtggtatagacaatgaagaacgggcagcggcagaagcaaggtacaggaagcccccgttagggcgaagaaagaatttgtgcacgtttctaggatctctacttttccctcgagggccccccctttatccatatcatgtgccacgatgtgggccaccctgtggcctcttgcccgacatatatgacccgtggctctcttgtgggttttaccaggggcaaaccgtggggctctcatacacaaaccgctgtgtgccatctctattttaaaagagtttagcacgaaacagtaggccgaagcattggtgtggcctcatacccctgtgtttagctccccagacaccttgtgggaggccaa

SEQ ID NO: 508002 - DNA, 126 bp, Homo sapiens
tctgctgctcctcttcagcgcaacggacagagctagacagcgctccacggacacctttgaggaacgggagcgccagtcccaccaccaactggaccctcttacacaaaatattacacccattttggc

SEQ ID NO: 508003 - DNA, 426 bp, Homo sapiens
  misc_feature (143)..(143): n is a, c, g, or t
  misc_feature (304)..(304): n is a, c, g, or t
  misc_feature (361)..(361): n is a, c, g, or t
gaaacacaacagtataaatactatagtaaagttgggtgcagtggatcacggctataatcccagcactttgggagaccaaggagggatggtcacttgagcccaggagtttgagaccagcctaggcaacatagagagaccttgtntcaacaaaaaattttaaagttagccgggtgtggtggtttgcacctgtggtcccagctactcaggaggctgaggtgggaggttcgcttgagcttaggaggtcaaggctgcagtgagccatgattgtgccacttcaccctgggcaacagagaaagaccctgtntcaataaaaaaggaagagaaaaactgggagtgaggaactcttcctcctcttcataantcatagttttcccacgtttagggaaaatgctttctggaggagttaaactttaaaagttactgtgt

SEQ ID NO: 508004 - DNA, 649 bp, Homo sapiens
agcgggcgcaccccgttaaatcggctaaatgagagcaagggggcacccggaggggtcctgtgggtttcaagggtcttgagaggttgttcacggggctattgaggccccctttcctatggggcctttaaagcaggggcttaggctttttagggcataaggcttttttcggaacccaatgagggtgtcatggagaatgtcccggtaaaggattgttataagccttactgaggttgacagcccctttcactgtccctggtgcagaatttgatccttgacaacgtgattttggaagtgaaatgtgtgcataagttacacctctgggggcagttgcagggccacggtctgggcaagcggcctgtgaccgttctgtgaaggcagtaactgacaggcgaggctccggggtcaagcagtgaggctctgtgatctcggagggctgcacatctggcatcctgttatgggcagtgtccttcatctttgttcacacacaagaatcggcatggtggcagcctctcgcagtcaaacactaagtaaaaggggttgctctggcccctgacatgaatttagcacgacgaccctgactacgaagtaattgttttccttggcaagccctaagttgtggaacgactcgcctagttttgtgctaaaatga

SEQ ID NO: 508005 - DNA, 954 bp, Homo sapiens
  misc_feature (44)..(44): n is a, c, g, or t
  misc_feature (81)..(81): n is a, c, g, or t
  misc_feature (142)..(142): n is a, c, g, or t
  misc_feature (399)..(399): n is a, c, g, or t
  misc_feature (561)..(561): n is a, c, g, or t
  misc_feature (615)..(615): n is a, c, g, or t
  misc_feature (625)..(625): n is a, c, g, or t
  misc_feature (631)..(631): n is a, c, g, or t
  misc_feature (700)..(700): n is a, c, g, or t
  misc_feature (702)..(702): n is a, c, g, or t
  misc_feature (707)..(707): n is a, c, g, or t
  misc_feature (804)..(804): n is a, c, g, or t
  misc_feature (821)..(821): n is a, c, g, or t
  misc_feature (824)..(824): n is a, c, g, or t
  misc_feature (854)..(854): n is a, c, g, or t
  misc_feature (856)..(856): n is a, c, g, or t
  misc_feature (858)..(858): n is a, c, g, or t
  misc_feature (866)..(866): n is a, c, g, or t
  misc_feature (871)..(871): n is a, c, g, or t
  misc_feature (953)..(953): n is a, c, g, or t
gacacgcgcgtggggctggtgtggggagcaaagcgccgggcctncccgggaccctggtttccctgaggaccaacgtgaatnggggccccactggaaagaagcttggggctgcagagcggatggaatgcaggcccaggttgcngggtggtgccctcagctcctggcagggttgacgggtggtggccgccgggctctgccagccgatggtccgctggcacctgaccctgttttccagcttcacttccgggcctgcccgtagttgtaagttaaccaagcacaggtctccttcaccgcctgcttgaagggtgttaaccggaagtagggcaggaaggtcctcagcttgctgttactggctgttttcttaaactgcccaaccgactaggttgtttcaaaggtganttccccatggaagttcatggcctccaccaccgcctcggctgcctccttgaaggagaactcaactccctcgcccacggagaggatgaagggctccacttcattgtactcccgcagacccagaaaaagagctgggccaggaccagcgagtatataaactgcctncgcggattccctgttccccacaacgtcaggccgagccgctgctcttggccaggngcaccttgtngattangccaggaagcacgtggccatcctcgatgttgaagttgttgtggggcccgaagacgttggtggggatganancagtnaaggtgcagccgttctgctggaagtaggccctgttctgcacgttgataaacctcttggcaaaagagttcccaaaattgctgttgttgggaggccatngtggattaaggtctcanctnttgggtaggtcgtcttgttagggaagaaanangnggacaggnagganaccaccttgcgggcgcccaccttaaaggccgagttcaggacgtttgtggttcatgttcatccgggaattcggaccggtacanc

SEQ ID NO: 508006 - DNA, 231 bp, Homo sapiens
tttgcagactgctgagtagctgggactacaggcgcccaccaccacgcccggttaattttttatttttttgtattttatgtaagacgaagttttaccgtgttagccaggatggtctcgatctcctgacttcgtgatccacctgcctcggcctcccatagtactgggattacaggcgtgagccaccacagctggctggaagtcgcatttcgagatgatcagctctttccttct

SEQ ID NO: 508007 - DNA, 214 bp, Homo sapiens
atacatataaactactatatatattatacatgtataatatacataatctaatatatattatacatgtataatatataatctaatatatatattataaatgtataatacataatctaatatatatattataaatgtataatatataatctaatatatatactataaatgtataatacataatctaatatatatattataaatgggtagtcacaga

SEQ ID NO: 508008 - DNA, 546 bp, Homo sapiens
agtgggttgttgctggccccccccaaatgccacacgcggcccttttcccgcaggggatttttgggcctaatcatgttgttgccaagtcccgcttttgggcctttgtatttccgttaaaaaaaaaaaaaaagttttcaggggaaattgtttcttgtgggcaggggttttaaaagtcccccccgggggtgaaaaattttgggttttggttgggttattattcccggaggggcccccccaaaatgttccgggaataccgggaccttacccccccaggggtttttccccagtgtttccaaaaaatgggggcccggccccgggcccgggccccttccttttagttttttaaggtgggggagttccgggccaccaagtccccccggccgggttttaagcagtttcccgattccaaaattaagtttccgttgcccccccgggttttgggccgtcagcccaaaccccgttttccccccaaaaggccccaccccttttttttgggggggggcccttgtccgggggggccccaaataaatttaggaaggccccgga

SEQ ID NO: 508009 - DNA, 1143 bp, Homo sapiens
ggcgccatgccctgtgccccgcattgcttgccgcctggggccaggcctgtggatgctgggcttcgccgagtcggcgccggcgtggcgactgcgcagcgagcagttccccagcaatggtggtgctgtggctgtgcctggcatggcttgggctgctggccgtgtgctgcctggtggccccagtgccctggcctgctgagcttgtgctggtctgccctgctctccttcctgctgcaggtgtatgcgccgctgcctggccgcccggacgccttccacctgctgcatcttcctcttctgctgcctgcgagcatcctgtgcttgtgccgtgctgcgaagtattttcaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagaatgccacaaagcatattactgcagcaaggagcatcagaccctagactggagattgggacataagcaggcttgtgcacaagcagatcatctggagcatataattccagagcacaacttcctttttccagaatttgaaattgtagtagaacagaagatgagattatgctgaggttgtggaagggaggatgatcagagatataggggagtggggactccaagcagtacgagccaacactcccaggtcgtcacactgacaggagacatacttgcggccgccccacactaacactatggggcgcgtcacgggcacactagaactgactagagtccgactacgtcttcctggcacagcagctacgctactcaagccggcctcaaggcacaccgcgtggacagcatacagtagagaaagaaataaatattatgcaaaccacagagaaggctagccaaggattgaagagaagagagagggagaggaaatacagtagggaaaaatagtcaggtgtaaataaataggagagaggcaagatcataagatgtaagacgagatacacaggtgaacgcagggaaagaaaacaacattactaagtaggcgcaggaaagaggaagagaacggagcagagagcaaggcctgctatctatagagg

SEQ ID NO: 508010 - DNA, 135 bp, Homo sapiens
tgaaaactgaatataggcaggagagtcatggatgtggaagtctgattctcaaagttttttcacttctctgtggctccgggaactgtctcatcctcacatgtgagctctgggttgttgttggtgtagatattggtg

SEQ ID NO: 508011 - DNA, 161 bp, Homo sapiens
tctcgtaccttacgtctacagtgttagagatatgtgatttcgatcatactgtgtgcccccaattatgtctaaaactaaatttggcttcaactatgctgtactcctgccatcggacttcaagccataactgctgtcagtacttcaagggagagacttctaga

SEQ ID NO: 508012 - DNA, 150 bp, Homo sapiens
gatccaacaacagcaaaacatttttacagtgtctgttaacccaaagttctcgtatacacattgaggaaactacagtatctctagcaatgctattaccgctctagagcgtagttaagtagatatgcaccttctgggtcccaatcttattgt

SEQ ID NO: 508013 - DNA, 122 bp, Homo sapiens
cctggtcccacccagaccataataccagccaggaagcgaagcagatgatgaataggaggctcatcgccatggcaatgaccaggcctatgataatccagtaccaagagacggtgtaatcttca

SEQ ID NO: 508014 - DNA, 135 bp, Homo sapiens
ggtgatgattaggaatgaggtcgaggtaaagcatcagtttgccactctggttgcttttattgatgcacgttcgtgagtgacgtgcaatgcgtcattctggaatgcgaattccttggtccgccggcaatttttcga

SEQ ID NO: 508015 - DNA, 343 bp, Homo sapiens
  misc_feature (68)..(68): n is a, c, g, or t
  misc_feature (282)..(282): n is a, c, g, or t
  misc_feature (308)..(308): n is a, c, g, or t
  misc_feature (310)..(310): n is a, c, g, or t
cacatattcatgatgaaagttttcaattaaaaaatacataaggccgggcacggtggctcacaccagtnatcccagagctttgggaggctgaggtgggaggatcgtctgcgctcaggagtacgtgaccaggctgggcaacatggcggaactctgtctcttccaggaatacaaaaagttggctgggcgtggtggctcatgccggtggccccagctgctggggaggctgaggtgggaggatcccttgggcctgggaggcaaaggttgcagtgacctgagattgtncctctgcactccaacctgggtgacanantgtgacctcgtctcaaaaaaaacacacacacat

SEQ ID NO: 508016 - DNA, 746 bp, Homo sapiens
  misc_feature (1)..(1): n is a, c, g, or t
  misc_feature (117)..(117): n is a, c, g, or t
  misc_feature (171)..(172): n is a, c, g, or t
  misc_feature (186)..(187): n is a, c, g, or t
  misc_feature (196)..(196): n is a, c, g, or t
  misc_feature (203)..(204): n is a, c, g, or t
  misc_feature (267)..(268): n is a, c, g, or t
  misc_feature (285)..(286): n is a, c, g, or t
  misc_feature (399)..(400): n is a, c, g, or t
naacttacggctaggtacgaggctgggtgtgctgaaggtcccctggcagtgctgagggaccgagcccagcagatctcatgtcctctatacctgtgtccgatgctggaggccctcgangaaggggggccgccgctgaccctgggcctggagggggagcaccagcggtccaanngccgccttgtgccnntgcatgctntgcccanntgcttggcttgcatgctggcagtgacctgccatggtgcttggtggatgccaaatggcatccanngccatgtggctcctgtnngcagctgcccctgtgcacctgtgttccagcccacatcccacatgcgtgctctggtgcttcgtgaacactggagtgtgcctgtggccggacgcatgtgtgctgctggctgctgnngcccctcacctgtgtaccttggactgtgttgctgcacacctgccatgcagcgcgcagtgcctgcgtgcgctggttccgccaggcgcttgcagtggcctggcgagaggccgatgctggttggccccgatggttcgatgtcttgctcttcaattgctacctggggacctggtgtgaccctggcggccctgcttgaagctgctgcagccctgccagtttgactatgccgtcttctgccctaacctgacagaggtgtcatccacaggcaacgcagaccaacagaacttcacagtgacactggaccatgtcctgctccgctgcctggaacaccagcagcactggagacaag

SEQ ID NO: 508017 - DNA, 107 bp, Homo sapiens
tctctccacactggcatctttaataaaagaggcaggtttcctcctggagtagtgaatatgttcctggttatgggcctacagcaggggcagcttctttgatcaacttg

SEQ ID NO: 508018 - DNA, 384 bp, Homo sapiens
  misc_feature (282)..(282): n is a, c, g, or t
  misc_feature (287)..(287): n is a, c, g, or t
  misc_feature (353)..(353): n is a, c, g, or t
cgcctgtcatcccagcacttccggaggccggggagggcggatcacctgaggtcgggagttcgaaaccagcccgatcgacatggagaagccccgtctccactaaaaatacgaaatcagccagacgtggcagcgcatgcccgcaatcccggctactcaggaggccgatgcaggagattcgcttgaaaccgggaggcagaggttgcggtgtgcctagatcgcgccaccgcactgcagtctcgaccacgaagaataaaactctgtcacggggaaaaaaaaaaccanttatncacaaaatagaaccagtgagcgtgaaaagataactggctcagtactaaaagaagaagttggtggancggataaaatcagaaggggggccaggtacaa

SEQ ID NO: 508019 - DNA, 399 bp, Homo sapiens
  misc_feature (17)..(17): n is a, c, g, or t
  misc_feature (55)..(55): n is a, c, g, or t
  misc_feature (93)..(93): n is a, c, g, or t
  misc_feature (123)..(123): n is a, c, g, or t
  misc_feature (207)..(207): n is a, c, g, or t
  misc_feature (226)..(226): n is a, c, g, or t
  misc_feature (264)..(264): n is a, c, g, or t
  misc_feature (327)..(327): n is a, c, g, or t
  misc_feature (336)..(336): n is a, c, g, or t
  misc_feature (377)..(377): n is a, c, g, or t
gtctgaagttcagaganccttaccacatgtctaagaccacataccttccatcagnccttctatgctcccttttcccattctcagatctctganctcaggatgctttttacaactggcagtgtnttacaatccagtggaagtatttttctgcttttagtggtatataaactaatgtatcttatattagcttagattcaatgaaatatngtagtcagtattgaagtcnaaattgaaacatatttcacaagtctgtacatcttcgcntttcaaggagtttattatctagttggagaaaaaaatacgtaggaaaactcccacaaatctttnctgcaaatnacagagtagggttttcatggaacactggagtgggagggccntcactaaagctggcaggggtgg

SEQ ID NO: 508020 - DNA, 88 bp, Homo sapiens
ggatttgctggtgcagtacaactaggcttaataggcttgaattcgagcttctaacgttagaagcttgaattcgagcagtagtagtagt

SEQ ID NO: 508021 - DNA, 1642 bp, Homo sapiens
taaattggtttggtttaaaaaaaagtaaaggggcagcccaaagttttctaacccaattggtcccctactccggtgtaaattttttccccccgcgggcagggggacccaggggtacacgcaaagggagaacaaaagcagggagtggagaaggtgagagggcggttccactcgggtggtgcaactacagcgccagggaggggctataaaggctccacaggcttaaaaggggttggtagagcccccttgggcggtgtccagggagaacctgagcttgcccagggtgcagtggtcgatgtggttagttggggcggcccccggggcgcacaagaggggcgaatgggtgacaccgcgcccaagatttcctcccaacatcccccagtggagatcctgggggctaaaacaggggggggtgtcgagaagaaactctgtgactcatcacaacacggtcactacagaggcgtgttgtgtggggcccccccgagaccctctcccatataatattgctgcccctgtgggagataaccccaaaggaagaggctcacccagagacaaagagggagagaccggtgagacagagaaagcgaaatcatctattgcgggagaaccgcgcgagaggctcccacaatggtttgtggatcacccaggggtgttccacaattatttccccaataatgaggcgtggggggggcgatcaccccacacggagagacagaagtgataacccacaaagttctaaccccacacgtcgggatcgtttcgcggctctctcaaacaactgggggcgggccccaatggaaggtctactacaaaccaaccacgtgggtggggcaccccctgatgtggaagagtcgtgtgtacccaccacagagtgcagcacatatggtccagacagcggcgcgccaacaccatctgagggagaaaccagccatgcgagagcagtcgagtcacaggatcagagagcgacacacaaccactccttaatacaccccaaagatggagggcggcaataggacgcacagacatctgcggctatggattcccccccaacaaaagccctctaagaaccggagcaagtggaggtcccccaagagaacaaccacatcaggtgcaccacactctgcttcggcgagaccgaacgggcgcacacaaagttcgggcgagcaaaccgcaccttacggacaaagcacccacgacgacggcgccttctcaaggagacgcaacaacaacaccctgatgctgcataatgcatgaacacaaaatgttacccggactgccgcccactactggtatgtcagagacgtgtgccgcgaccacgtagagaccaacgatacttacctcgcaccacaccaaacagacgccgccaatgacccacgaggaagcacaaaacaacaaaagaacacgtacgctctcctcactacttacgcgagaacgagcgaggtgaacaccccgtgtggggcgcctacaggcccccacaagcgcgaccggaagaagaaaatctaccacagcagagatcaccacgcaagtgaacacggggggcaccaacggacagagcagagatggtgatgtgcccacagcgaggggtggacgagccatattcagggagaaaccagtgtccgccggagtcccccagagtcattaccaa

SEQ ID NO: 508022 - DNA, 1349 bp, Homo sapiens
taattcggttcagtcgaatccttttggtagtccctcataggcccaaactttagggcttaggattgatgatttaattaagaagggaattgacattaacttatttagagtggcgaggtttagatgtgttgtgttagggcctcagtggataggggttaaaaggagggcaatttctataaactcaaattatattaagaaaggtgtaaataccctcctctacaaaagaaattttatatgtgggaaaagagggcacccgggcgcgtggggaatctattagggtctcgaaacccgcccccctcgcttagagggggtggaattttctcctattgttagccccgtgttgaagattgtggggggataggtctcacacagatgtgtgtaacacacaaaaaaaaacaaacaagagtgcggcgcgtggccgggtgtggtgccaccacgcgtttattttatctccccccacgcgcaacactctctagagacagacagtaccaccgaaggcgagagagaaaatctcaccctgtgtgaggccccccagagagagcgttcataaaaaggcggtttgacacagagagaccccagaaatatgctactcatattgtccccctgtgtggcccctctcacacactgtgtggggcatggaacaaccgtctgagcacacctctgtgttatctaataacaaacacaacaacaaccaaacaaagattttttttggtgccaaccaacaccgccgcaacttctttccaccacaccaactctcatttttcaactctcctttatatcacccgcgtggaacaacacaaacacaaaaaacacccaaccacacaaacaacaaacacaacaaacaaaccaccacacacaaaaacaaaaacaacaaacaacaccaacaacacacaccaacacacaccccaaacgacacacatacaagcactcccaccactcccatcatcacactaactcaaatcaaacaccctcaacaaaacacaaattaactctaattccagatccccctaccgtccatcctaaattatattaactacttcttcttcctcacgaacacgcccaaacaccctactaccaccacacacacatctacacaccaaagtcttacatacaaaagaaaaccaacctctcccacacctctgcatacaatcatactattaaaaaataaaaacaaatataaaaaaagaatacaatatactaacatactatccaatatacacatcacagaacaaaacaaatccagaataaatagtcaaatctatagaaaaaatcacacccccacctcaccaacaacaaatcaacaccacaaccaaaacacaccaaccacacaaacaaaaacaaacaaattaaaa

SEQ ID NO: 508023 - DNA, 1771 bp, Homo sapiens
  misc_feature (1752)..(1752): n is a, c, g, or t
aaacgacccgaagactcattgagttttgagtctgttaccttgtgactaaactaaagtgaagatgtttctggagtccctgatgaagagccttatttgttttcttcttccctacaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtgttacatggacacagaacagtatgaagaagcagtacgagactatgaaaaagtataccagacagagaaaacaaaagaacacaaacagctcctaaaaaatgcgcagctggaactgaagaagagtaagaggaaagattactacaagattctaggagtggacaagaatgcctctgaggacgagatcaagaaagcttatcggaaacgggccttgatgcaccatccagatcggcatagtggagccagtgctgaggttcagaaggaggaggagaagaagttcaaggaagttggagaggcctttactatcctctctgatcccaagaaaaagactcgctatgacagtggacaggacctagatgaggagggcatgaatatgggtgattttgatccaaacaatatcttcaaggcattctttggcggtcctggcggcttcagctttgaagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 508024 - DNA, 403 bp, Homo sapiens
tgctgtgttagaacataacatataaataaacgatgcaaatggagcagccattttaaactatatatatatagccactatttattgtgcaggtatttgagcggcttcctctgtcagctgccacccggctcttcttaacctgtattgtattctgctcagcacggttaacagcacaacgtgtgtggatcaaatataaaggccacacctttcagcacgaacctactcaaagatcctttactttgtaataatttgaactggagaaccaaagacgggagcagaatgcaagcaaagatgctcaaagacacaaaggaaagcactgaaggaatccacctgcataggccacgcgtaccactctgggtcaaatgcttccacgatgcagaaacctttttttaaaaaaaagtttctg

SEQ ID NO: 508025 - DNA, 2328 bp, Homo sapiens
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtggtaagtgcctctgatgggtagggggaagagggagttgccgctggcctcaggggaattgccttgtggatgacgaagcagacccagagatgttgtgaggtcatttggtccttccccctgcctctaggtgggattgttccagccctagactatctttatagacctccagcggaggagattgcacaagctccctcagtctcccatgcctgtgtctaacgcccctcacggtcagtaagtttcctctgatgcctgacccaaattccttttgttaaaaagtttaaatccatttcctttggagattttattttgtgttgtacacttatgctctaccctggcacagtgcttgacacataggtgctcactgaataaatgttttgttgaatgaatgtatggtgcttggaagagaaaacaactcttggagacagttgagagttgtacttcatcctgtttgttctgggcgagggaagacaatcttagagttggaagagatgtaatccggctcagcctcccaggataaaggaacttccttttgaaacaccctggatggctactctctgcttgagtgttttgagtggagggcactctgtgtctgacagggtgattatgagccaggatgtgcctacctctaatgctcacatttgccccagagtcagggtgctccctggcatggttgctcctcttactcttagacccaccagctggttttctccagataggaacagggctaggagaaatctttctcagaaatccatctcttctgatttcagattattctctaggcggagaaaaacttcccgtctttaaagttcttagagaagatgtatttattgtatactaatcctccagcacctgctccactccttattataaaatgtcatatccaaagaacagatgctgtcactgatgcctgatgagccagtagtttaagcttccttgtctcatcagtggtacagaatatctcatggactacctcccacttagttttctcaaaattatctcacttaaaataggaaaactgctgctgtgtgtgatgctttttttaaaagtgaatttctaagttgatgactaagtctgtccaacagaaacatacagggaattataacttctgtgagactgactgtcagtcattccatctttgcaaaccactggcacacagaagcagaagctttggaagacaaaaaaagcaccctttgattcagccaaagactgactttaacagacgcaaaatgctatatacatgaaggtgtttgctgcaattttatctataatagcaaaaaaaaaaaa

SEQ ID NO: 508026 - DNA, 2202 bp, Homo sapiens
ccggcctcccacccagctctctggtcccggcggtaagatggcggctgccgcggagtgcgatgtggtaatggcggcgaccgagccggagctgctcgacgaccaagaggcgaagagggaagcagagactttcaaggaacaaggaaatgcatactatgccaagaaagattacaatgaagcttataattattatacaaaagccatagatatgtgtcctaaaaatgctagctattatggtaatcgagcagccaccttgatgatgcttggaaggttccgggaagctcttggagatgcacaacagtcagtgaggttggatgacagttttgtccggggacatctacgagagggcaagtgccacctctctctggggaatgccatggcagcatgtcgcagcttccagagagccctagaactggatcataaaaatgctcaggcacaacaagagttcaagaatgctaatgcagtcatggaatatgagaaaatagcagaaacagattttgagaagcgagattttcggaaggttgttttctgcatggaccgtgccctagaatttgcccctgcctgccatcgcttcaaaatcctcaaggcagaatgtttagcaatgctgggtcgttatccagaagcacagtctgtggctagtgacattctacgaatggattccaccaatgcagatgctctgtatgtacgaggtctttgcctttattacgaagattgtattgagaaggcagttcagtttttcgtacaggctctcaggatggctcctgaccacgagaaggcctgcattgcctgcagaaatgccaaagcactcaaagcaaagaaagaagatgggaataaagcatttaaggaaggaaattacaaactagcatatgaactgtacacagaagccctggggatagaccccaacaatataaaaacaaatgctaaactctactgtaatcggggtacggttaattccaagcttaggaaactagatgatgcaatagaagactgcacaaatgcagtgaagcttgatgacacttacataaaagcctacttgagaagagctcagtggggattgttccagccctagactatctttatagacctccagcggaggagattgcacaagctccctcagtctcccatgcctgtgtctaacgcccctcacggtcagtaagtttcctctgatgcctgacccaaattccttttgttaaaaagtttaaatccatttcctttggagattttattttgtgttgtacacttatgctctaccctggcacagtgcttgacacataggtgctcactgaataaatgttttgttgaatgaatgtatggtgcttggaagagaaaacaactcttggagacagttgagagttgtacttcatcctgtttgttctgggcgagggaagacaatcttagagttggaagagatgtaatccggctcagcctcccaggataaaggaacttccttttgaaacaccctggatggctactctctgcttgagtgttttgagtggagggcactctgtgtctgacagggtgattatgagccaggatgtgcctacctctaatgctcacatttgccccagagtcagggtgctccctggcatggttgctcctcttactcttagacccaccagctggttttctccagataggaacagggctaggagaaatctttctcagaaatccatctcttctgatttcagattattctctaggcggagaaaaacttcccgtctttaaagttcttagagaagatgtatttattgtatactaatcctccagcacctgctccactccttattataaaatgtcatatccaaagaacagatgctgtcactgatgcctgatgagccagtagtttaagcttccttgtctcatcagtggtacagaatatctcatggactacctcccacttagttttctcaaaattatctcacttaaaataggaaaactgctgctgtgtgtgatgctttttttaaaagtgaatttctaagttgatgactaagtctgtccaacagaaacatacagggaattataacttctgtgagactgactgtcagtcattccatctttgcaaaccactggcacacagaagcagaagctttggaagacaaaaaaagcaccctttgattcagccaaagactgactttaacagacgcaaaatgctatatacatgaaggtgtttgctgcaattttatctataatagcaaaaaaaaaaaa

SEQ ID NO: 508027 - DNA, 837 bp, Homo sapiens
gtcaaccagtgaggctgccctgaacaaaaaaaacaaaatagaagaaagagacacagaggacaagaaggaatctgataacaagaggcatttccagcccctatgttattgatggaaaaagaataaagaagaaaagcaatctcgcagtacatgttacttgtcgaaaaaattccggacaagactaccctggtttttatgttttcagtattctgaaatataccagttgtgtggcagttctcgcagatgttacctaaaactgctgaacttgaccggcagaatgttctgccgtttctgctccctcgacacttgattgggagggctgtcgacctcttcctcccgtgggggcttccccagtgcctatcttctcgtgatagtcatggagaggttacacttaatttaatgggagatgtaagttggtgggatttggtattggtctggtttttagaaaaatatatttaaatatataatagatatctatcgctatagaataatgctttaataaaatgaggcttttttagaggaagaccaaaaaattcaatgtcttaaaaatatatttaatgggcaatgcaaaagtcttcctgcttaccgtgctgaacttttagaacagaggatggtattgcaagacaaagttgacttgtaaagtgatctccctgaacatttttaaggttgacttttctgaaatttataccataacagcagtgcattaggacatataatgttagctggaaggttcaattttacggggtattgaaatacgttaattaagaatgtttaaaaatcctgaaagtttatatagatattgggaataggattaatgggtggaatagattgtaatcccga

SEQ ID NO: 508028 - DNA, 488 bp, Homo sapiens
  misc_feature (14)..(14): n is a, c, g, or t
  misc_feature (60)..(60): n is a, c, g, or t
  misc_feature (111)..(111): n is a, c, g, or t
  misc_feature (139)..(139): n is a, c, g, or t
  misc_feature (153)..(153): n is a, c, g, or t
  misc_feature (341)..(341): n is a, c, g, or t
  misc_feature (483)..(483): n is a, c, g, or t
gccctgaatttganaaaacctggtaatttttgaaagccttggggtacctgccttattttncccccaaaagcaagcattttgggtgtcctccccttagggtttaaagcctanatttccttgggaacccccaggagtaacnggaatagggagcantgtagggataaaactttccccccttgattatcaaaaggagtcttttggctggcacccgaggctcatacctgtagtctcagcactttgggaggccacttgaggccagaagattgcttcagcaggagttcagcagcagcctgggcaacaaagtgagaccccatctcttcaaaaaaatttttaaaaattanccaggtggtggcatgcccctggtcccagctacacacgaggctgaagcaggaggattgcttgagcccgggaggttgagactacagtgagccgtgtttgtgccactgtactccagcctgagtgacagagtgagaccctgtcttntaaaa

SEQ ID NO: 508029 - DNA, 1759 bp, Homo sapiens
  misc_feature (1740)..(1740): n is a, c, g, or t
ccccaagcgcccttccctcttgtaccccccctcttctttatccccctagggcccttcagaacgggcgcaaacttggccctccggtttttttgccgccccctttttttgttttggatctgctctaattattttggaacattaagtggaacatttgaccttttagtagccgctccagcattatagggagacagagtatggggaaagtcttgtgtaagtgcaaatggcattccatttgttgagaaaacagcccaatgaagcaagctgaagcagagaaagcttcctttggggcagcagttggaaggagaagggaacatgtcctaggagtgggatcaggtagcatgttttgcacgggatggggcaggtttgctcacttgcagtctgaagtgttgggaaaggaggggagtgagactctccaggaaagctttggagatctgttctcagtgtcatcagttctcttcgaacatttctaatttttcaccttttcttcccttccatgttacttgccctgctctacagattttgatccaaacaatatcttcaaggcattctttggcggtcctggcggcttcagctttgaaggtaggtgggcctgctgttcttgggagttcccagatcacaagccaacacactcattgcctcttaggcagctctttgggagtcagaggggcccatgagcgggggcagctgaattctcatctagcagggcatctatccactcggctgttgctaaggatgaagacaggaaggttcccaggcaccccttgccttgggacctttagccaccgcatctctgcagggtcagggaggcatctctaactgcctagtaccaaggcttctctgcaagagcaaaggtactatatagataatgctgaggtcagaagctacccatgtataatacagtcacgtgctccctcttgcacccaaaaacagcctgagctgtttgatacccatagagtttctctctgtgtttgagtttgaagcagcccttgaagacttttccataatcagagcaaagtgatcttccttagaaaatccatagccaactaccaacccctcttttctctttcagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 508030 - DNA, 1252 bp, Homo sapiens
  misc_feature (1233)..(1233): n is a, c, g, or t
cctacggatccccagtttgccttcgtaacttcaaggcattctttggcggtcctggcggcttcagctttgaaggtaggtgggcctgctgttcttgggagttcccagatcacaagccaacacactcattgcctcttaggcagctctttgggagtcagaggggcccatgagcgggggcagctgaattctcatctagcagggcatctatccactcggctgttgctaaggatgaagacaggaaggttcccaggcaccccttgccttgggacctttagccaccgcatctctgcagggtcagggaggcatctctaactgcctagtaccaaggcttctctgcaagagcaaaggtactatatagataatgctgaggtcagaagctacccatgtataatacagtcacgtgctccctcttgcacccaaaaacagcctgagctgtttgatacccatagagtttctctctgtgtttgagtttgaagcagcccttgaagacttttccataatcagagcaaagtgatcttccttagaaaatccatagccaactaccaacccctcttttctctttcagcatctggtccagggaatttcttttttcaatttggctaatgaagggcaaccacccagaacccagaaaatgcagattcactcagtttaatcttgaatgtggaaacagttcacctcctcccttcatcacgtctccgtgtgcttagagcagtttcgttttctcagttggatgccctgtgtctctgtgagtggggtggagcaaagggaaccaatgccgaagaccgagggcaggggagggaggcgggggtggacagggaggcagcttgtgaatttttgttttactgtttaactttattaaaaaagaaaaaaaaaaagagaataaaatgttttgacccttcctggccctttgctctggcatctgcattgtctccagtctgtgagccagagctgagcccgacctggacttggggtgcagcaagctgctgcatgcgggctgtgggcacccagcctagtggcaggtggggcactctgcctctcccagacctgtccagcatgtgagtgctaggcaggccccggctgtgcctctgggcccagcctaacatcagtcacagagaagcgagttcagaaagcatgctcactttacggtggggccccagaaatcactagaagctgtgtgtgtccaaagctcaggtgggtactaaaagctgtgtgcgtccaaagctcaggtgggtactnacctagacagggcagttta

SEQ ID NO: 508031 - DNA, 242 bp, Homo sapiens
ccctgtgaggagaagtcctcagttattggatgaacaaattcctattttagccaccagatctgaagttaaggataattctgccacagaaatgaattgtagcttgatgtgtgtgtgtgtgtgtgtgtgtgtgtgtgtgtgagagagagagagagagagagagagagagagagagagggttaagggctcgggagggtaaagggatcccgggagtgtaaggggctcgggtagagagctcgaatgcg

SEQ ID NO: 508032 - DNA, 123 bp, Homo sapiens
  misc_feature (16)..(16): n is a, c, g, or t
  misc_feature (67)..(67): n is a, c, g, or t
  misc_feature (95)..(95): n is a, c, g, or t
taattgagtcttgagnatttccaacagatgcacaccccggaaaaaaatgtatgccccgaaaaaactntgtatttttgctttagttttccagctgnttctatctatagctctgcaaacgagatc

SEQ ID NO: 508033 - DNA, 122 bp, Homo sapiens
caggcatgagctagacctcagtggtggggcctctgcttcaggccccgcctggctgacattctgagcccccctcggaggccccggccacagtcaacctgcccagttctttcctctgaggcttg

SEQ ID NO: 508034 - DNA, 102 bp, Homo sapiens
taactgatactgtgtatctagagctatacatcgacgggctgacccctgcggggggatcgttctttatcagatcaaaccacccgtcggccctctcggcccggc

SEQ ID NO: 508035 - DNA, 240 bp, Homo sapiens
gcgtcgacctattctctgagcttgtctgtaaccacagccaagcatgccttctaattttgtcaaatgggattagacatatgtaggctaagggaaaaagccactaatcccaaagcctagatggtacaaagtattgtagatggcttaatttctaagattttggtactattctagccctattgtcatttcagttattatgtgaagaaggtcatttaacagactatatgtaaggattttgtgatt

SEQ ID NO: 508036 - DNA, 629 bp, Homo sapiens
  misc_feature (10)..(10): n is a, c, g, or t
gacgaagtgntggggaagcagccgctccggagcctcgggcccatcaaaccggcagccgggaagaaacggacagagctggtcccatgaaggcagatgtggagatcccctttgaagaagtcctggagaaagccaaggctggagaccccaaagcacagactgaggtgggcaaacactacctacgccttgccaacgatgcagatgaagaactcaacagctgctcagccgtagcctggctaatccttcctgccctttccttactttgtgttggatttgttttccaaatatgtgtgtatgtagacttcatggtagtgtttcttatttatttggttgctgctaagccttgacagtggttcaccttcctgggctgtccccagtggtcacgtcctgcctggcttcctacttgggtatagcatgtccaaactgggctctgaacactacagcctgccttggagctggcctatctctgggggtgttagagagtttgtggggatctcttctgagtaccccaggacttgggaaataatgcaagagtatccctttcagtacataggtaagcttggctatgttcaatatgcagagccaaaagccaagttctaaggcagccgaaataaaaagctttgaaacctaaa

SEQ ID NO: 508037 - DNA, 1048 bp, Homo sapiens
gtctctctggtccgtgcctccaagatgacaaacgaaaagaaggaacaactggtcgtgccatacaaagggccgtcgagccacgtgcatgcctattcgtctgcacataatctgtgcccgatgcgctgaccaatggacaagggcgcattaagaaattcgatcaattcgaatacgatagtgcgaggccagtcgagcgagtcagggacagtttcatgagatgcggagcggtcttcagatgcctatgttgcttcccgaagctgtatgtgaatgctactttactgtgttgagttgtcgcaattcacaagttaacagtcagtcgatggcacatctgcatcgtccgttgcagagccctgcaataggcaacctgatacgtagcgctcgcgacccactagattttgacgcaccatagcagcgagttagctttggcgcccgacagatcaccacacgaatcaaaatgccacccattgacttacaatgagcaggtcgtgccatggctctcgtttcagagaggatcatgtagaagaagccaggggcatagtttacttccttggggcacgaacaaagacacttacacagagttaggccagaacgtgtagtttaaccgtgtaagagaaaccaaaccaacatcatacaccagatagagaacaatgctggacgcgacacagagaaactacccatcccagtaattttgcaaaggttgatgttggaagacacaaaacaacggaagaccgtggaatatacgccaatacaattaagtgccgaacacaaacatgagtgggtcatacacccacaataacgcatatgttggacaccatagacggccgtaggcattaggccaacgatccacaccccgtacggggagttcaaataaaaccaggggggatagacccccaatacctggtatgcgcagaggggcgctagctcggagttaccaataggcgagcgaattagagaaccaaatatacaaaagactcggtggacaataacaacagagggaacgattgtgcgaatatataggacaacgcgtcagcgaatttgaggcggtaccact

SEQ ID NO: 508038 - DNA, 550 bp, Homo sapiens
  misc_feature (24)..(24): n is a, c, g, or t
  misc_feature (28)..(28): n is a, c, g, or t
  misc_feature (56)..(56): n is a, c, g, or t
  misc_feature (79)..(79): n is a, c, g, or t
  misc_feature (81)..(81): n is a, c, g, or t
  misc_feature (93)..(93): n is a, c, g, or t
  misc_feature (98)..(98): n is a, c, g, or t
  misc_feature (228)..(228): n is a, c, g, or t
  misc_feature (231)..(231): n is a, c, g, or t
  misc_feature (249)..(249): n is a, c, g, or t
  misc_feature (263)..(263): n is a, c, g, or t
  misc_feature (294)..(294): n is a, c, g, or t
  misc_feature (298)..(298): n is a, c, g, or t
  misc_feature (302)..(302): n is a, c, g, or t
  misc_feature (305)..(306): n is a, c, g, or t
  misc_feature (308)..(308): n is a, c, g, or t
  misc_feature (319)..(319): n is a, c, g, or t
  misc_feature (331)..(331): n is a, c, g, or t
  misc_feature (344)..(344): n is a, c, g, or t
  misc_feature (370)..(370): n is a, c, g, or t
  misc_feature (378)..(378): n is a, c, g, or t
  misc_feature (404)..(404): n is a, c, g, or t
  misc_feature (407)..(409): n is a, c, g, or t
  misc_feature (417)..(417): n is a, c, g, or t
  misc_feature (419)..(419): n is a, c, g, or t
  misc_feature (422)..(423): n is a, c, g, or t
  misc_feature (443)..(443): n is a, c, g, or t
  misc_feature (464)..(464): n is a, c, g, or t
  misc_feature (470)..(470): n is a, c, g, or t
  misc_feature (473)..(473): n is a, c, g, or t
  misc_feature (543)..(543): n is a, c, g, or t
cgcgcggccccggcagcccctgcntcgnttctccgcgactcgcggacgccgcctcntccacttcgcgaacgccgggtgntngggggcggggcnttgcngctgcggaggccggagacgcggcggcgctggacgcggaggcgctgggcgcacggcgcggaccggccggagctcgaggccggcggcggcgggagagcgacccgggcggcctcgtagcggggccccgagatnccngtgtggcgtgccggagcntcgaaaagagattntcagcgctgattttgagatgatgggcttggnaaangggngtnntngcttgaagtcnccgcccctcgtnctggccgccctgntggcctgcatcatcgtcttgggcttnaactactngattgctagctcccggagcgtggacnatnnngacacggntnatnnagctggaaggcagggtccgnagggcggctgcagagagaggngccgtnganctgaagaagaacgagttccagggagagctggagaagcagcgggagcagcttgacaatatccagtccattnacttctt

SEQ ID NO: 508039 - DNA, 186 bp, Homo sapiens
  misc_feature (103)..(103): n is a, c, g, or t
gcccagactatggtctttttaatcagtcattgtttacacaatgaacagaatatgataattagtttaaaacaaaacaaatgatttcgactcattagactatganttacttcataattatcaagtgccattagtatacataaacatcttataacattcacgattgacggtaacaccacatataaggct

SEQ ID NO: 508040 - DNA, 350 bp, Homo sapiens
  misc_feature (189)..(191): n is a, c, g, or t
ttttttttttaaaaattgttttgaaaaaccaaaaatttgttttgttggggtcccaagggagaaaaaaaaaaaaaaaatgctttttttcccaaagaacggggccaattgccttttttggaaagggaaacctttctaggccagggaatttccggttggttttagccccccccattaattccctgtggtttnnnggaatttaccccctcaaattaacccctccttttttaaaaaaaccttttttttgtttggccatcaaaattaacttggggtttcccccctttttggaaatattgtttttgtggcccctttttttgaattgttttttagtctttaacccaaaatgggggcca

SEQ ID NO: 508041 - DNA, 643 bp, Homo sapiens
ttgcgcgggctcgttaactgctgcgtctagccgtacagccgcccctgtatatacggtgacctgcatgcgcggtccagagaccgtcccggccccaaaacgatcccgcagcaaactcatggcaccgacccgaatcgggacgcacaatggcaccttccactgcgacgaggcactggcatgcgcactgcttcgcctcctgccggagtaccggagatgcagagattgtgcggacccgggatcccgaaaaactcgcttcctgtgacatcgtggtggacgtggggggcgagtacgaccctcggagaaaccgatattgaccatcaccagaggtctttcacagagaccatgagctccctgtcccctgtggaagccgtggcacgaccaagctgagcacgattgcgggaactcatctatctgcacttcagggcacaaagcatgctggccccagtttgctgggccacatagtgaaagaggacagcatggtgggcaaccctctatgacaagatgtatgagcaactttgtggcaggaggtggaatgctgtggcacactgggatctcccaatgggccgagcggggagcctcgatatgcacttgaccataaacctgagtgcacgagttgctcgaacttaatcctacctggaaaccacac

SEQ ID NO: 508042 - DNA, 502 bp, Homo sapiens
gcgaggtcgatctaaggatccctatgtctcgatcgtaccagcaatggggggtaacctgagccccctctcctccccttcctcaaccacgggacgtttatatattataggcaggcatgcaatgggcacctagtcagatcttctcagcttgctagccagaaatgactgtgattctgctgggggctgctgagaaggtaatgtaggttgaaaaggggctctaagtttatttatttcgttagatggacacttccacacactcccgtgtagtccaggtagggcccagaaataggaaaggctaggatgggataatgctgcaaatgcttttttggtgtgagaaactggagagatgtgatttctcctttggggagagaatgtcccagaatcgattaggctgagccttgggaatagtttggcaggtttaacatcccaaggttaagctaacgtagttgggaaaggtagatggaatgagacatgtattctgtgcttctaagggttctgtccctta

SEQ ID NO: 508043 - DNA, 131 bp, Homo sapiens
attagtgatcacagaagaatacagggaagggccaagttcaagcctgtaatagaaaaaagagaagatgagaatcaggaagaggctcttgtagctttcagaagtcccgtttacgtttaagtttcgggtcaggt

SEQ ID NO: 508044 - DNA, 1397 bp, Homo sapiens
gctcctaatagtgtgggcttctccgtcctctgctatggagttggggcctgctccttttggtttgtcgcggcgcctttggatatagtgtgcacctgcttctatcctgggggttatctggagactccgggttttatgaattattgggtgaagattccctcctgtgcttgcccagattatctttcttcggatggtttctacacaggggccctttgtaccacgctgtgtataaaattggggatatatccccccctgtggaaaatgttgtgcccccacatatatgggccacagattgttttgaagtagagggtttcaggggcctaaaaggtgccccagtttgtgggtttccccccgagtaacatgtgtgtcacgagggaatagggccccccgcggagtaaatggtgggcccccaagtgtgtggaaccccaaaggagaattgttgggcaccacagttttttgggggggttgccaaactatgagaagaaagggttcttttaatatggaaagagttgtaaacaccccgcagttgaaagttttttccttcggccccccctggggggagcccccacacactgtggaggaccccccctcggggcccacacgggctttagagccccctctaagactgtgtgttgtatactgcagttgggataacgcggggaccacgtgtcatcctccctccccgccccaatgtgctcttcacgcggattaaaaaatgagtatgggtgtcctcggcacaccctcgtttcgttgtgtcttatatgaagagaaaagtttcacagaaaagcgctgatatatatacacgcctgtgagactatacccacctctcttatgcccccgcgagatatactgtgtctcccgcggggtgctcacaaaatgtgtgggtgttgggagaccccttccccacttatatgggagaatatggtgcccacattccaccccaccttttagcccacacctgtttacccacaaaaccacgcggttgtggtcacactggagaagaattttgagacacataatgttggaaatccactgagacgcctttgcacagccttgtttctgcggcacacatatagtgtttaaagaaactctgtgagtttaacaccccagagagaaaggtgcacaatatatttagaaggagagggggcgtaatatagccctggggccacaccctctttggagccatttggctgtctggatattttgtgacccctgggacacacacacacactggagagaatggcgccacgaaattcgtggtgttgccagcccctgtgccattgggggtgggatggggaaacgaccacaagtgtgttcagaagagaatgaattgctttaactttggaccacccccattttttttttaactaattaagtactagggtgccaaaagtggaaaa

SEQ ID NO: 508045 - DNA, 1202 bp, Homo sapiens
gagcggaatagatgcatagtgtctaaaatatatttgcattaaggccagggtatgctatactaataatctgctctccactctaaatatttaccacctatattcgttactacttgtgctagtgatctattgtgccataagatactggtttgtgatgccgtgtgctctatatacataggcttgccgaagtagttctcataaagtcggttttatgcactatatgttacccgtgctcaagtcgtctgaatgtgacctcatcacgccacttttcctaaacagcatcggctaaggatctcatttcagcttttgattattcttctgaatgaccaagatttaattagaagcacgactaggatagttgattgtgagttgaataatataacattgatgctagtacgcatgcattagggagagatgtcatttgtaaagtacatttttggatggcataatataagaaataactattgatgctcatcatcactcgctgaaatatagcgtgtatagtacaccttgtacctattcttagttccgaagctcatgctcattagggttctccaaaaattactaatttatagacgaccagatcggactccttggattactctgaactagttagtagtccgaaactgaactcggaagtcttacggctttaggggaggacatatcctttatataggcactcacatagaatggggtaacaggcctcaccacggtgctttctccttgatcagaccatttatttcatggctacttacaagtggcgcactcaacatacgagcatacagcagctgtgtttcgaaagtaggttacccatcaagagaaatcacgggatccgtcggaacgacggtctaggacacttgtcctcagactggacactacgctgaagctataccctccaacaacgctggcacacccagtgccaattacaaccgcgcagcgtaaggtcataaacgtccaatgaaagcagggcaccacccaatttacgtacttcgtgcggcaaccacctttgcgggccagtttgaggaccataccagggaccgctgacacaagccaaacctgtatcacaaacaaggggccaacaaggggcaacacagcgccgcgccacaacccgctccacgatcacacctgcaatagcgcagcaaggccccaaccaaggccccacgacagggcaccgcaccaccgacactcgcggacgagacacgagc

SEQ ID NO: 508046 - DNA, 333 bp, Homo sapiens
aatctgggcctggagagctgccgggagcgtaggagcatatgtagaatcagtgggcgtgtaagcttgtttcccgcaagtggatgttcccacgttttgctgtcacccctctggaatccacgtatacgagaattccaaatgttagttgggcatagtggcaagcacctgtagtctcagccacgtgggacgttgaggtgggaggatcgcttcagcctggaaggttgaggctgcagtcagctgcgatagcactactacactccagccttggacaccagagggagacccataatgtagaatcagtgggcgtgtaaagcttgttttcctgcaactggatgt

SEQ ID NO: 508047 - DNA, 866 bp, Homo sapiens
gtagctgcgcaaaggacctgacgacagtgctgcgtcgtatacttttgaaacgcttgtgcggggaatgtgctgttggagcctgctgtggttgctgtccgcggcagttgaaagcgcgtgacattatggttagggtgtcccctaggccaatgagcgcttgaggtactcaccggaggagcaagggaaattcacccttagcggctgggacgctgccaaaaattctgttgaccagaagtttactatcttcattacgagccattccaaacagtcaatttttcaactattccaggggttgtgccaattattattcccaatcgttgaagatcccttttttacttccgaggttggcaggaacaatccggggaacctcaccatctttggccttggctacaacattacttggattcctctgaaggcctacattgaaaccgattcaccactaaaaacttaacactcgtctgctattggctacgaacaaacctgtgtgcaacacagcgatttgggggattcaattcacaacagtcttgtcttacccaagactctccaaagaaacaaacttgggcgtcatggtacagcactaaagttccctccaacccacttctcttctcgcacacacgcttgccctcgcagggccttcccctttggggacaacagcacttcgggcagcggggcagtgctggataccttcaggaacgcgttagttagaccaaacaggatcattgggcaaagacacaagcattgaagcatgggctagctacccccaagggaacgaacaaaactggtctctcacacaaacagagcctaattcccagagggaatttgaaagactccaagggaaccaatgagtgaattcagagaagcagagatca

SEQ ID NO: 508048 - DNA, 145 bp, Homo sapiens
caccacttatgaggtggaagcacagaggcggaagggaaagtctgtgtgcccccaggaggaagagccctgagtcctgggatcagacaccccttcactgtgtattcccacacaaatgcaagctcaccaatggtcccctctcagtccc

SEQ ID NO: 508049 - DNA, 441 bp, Homo sapiens
aactagggacaatggaaagctccagtcattatcatgacctttagtctagggactccattgagagaaagctatgagtaagatgactaacacgcaatgaggacgaattgccctgtctgcccatctcagagccataaggccatctttgctagagctatttttacctatgtatttatcgctcttgatcataagccgcttatttatatcatgtatctctaaggacctaaacgcactttatgtagcttttaattaatcttaagatctcgttacggtaactaattaggggccccacttcccacttcattagggatgactgtggaaatacagacaaggctcttagctgatattccgggcttgtggcagcgcgggcttaggacaccccaagtgcgttggtaaagcacgagggacttgttgccctatagggagctcttcccaccgcacgcg

SEQ ID NO: 508050 - DNA, 912 bp, Homo sapiens
gctcattcataaaacaaacctatcaaaagcaagacaagagcattattcaagacttgaagaagaattttgaaatagtgaaattggtaacgggaagtttgatcgcttgtcatcggcttgcagctgctgtggccgggcctggaggcttaagtggctcgaactcctgacctcatgatccgcccacctcagcctcccaaagtgctgggattacagatgtgagccagctcgcctggccttaatgatagtaattataaaagatactgtaaagataatagtatagaagctctgaactaaggcctaacattaaaattaaggaatctagaaacaccaaaaaagagacaaaacaatcataacaaaagaaaagaaaaaaaaaaaaaatcgaaacaaacaaacaaaagaaaaaaaacaaaacacaaagacagacccagacataacaaaacaagaaaagaaaaaagaaaaataagagcgagagaaaaaaaagagaaccaagaacagaaacaaatagaatgtagagaccgagtgaagcggacaacatcttactggcagggcacttacgcctcatcaagacccttctttcactctgtggggcagaaaaggaaatgctgggttcatcactcattaaaccatggttagatgacttccttttccgagcttctagaattatttcaaatagtcattcctccagctggcagtgccgccatcagtcaacaggacttcatccaaagtatggaaaatgcccgtggtgtcagtcttgggtaacaaattctatttgaaactttcagtcccaaaagattcggtaaccttggagtttgggctcccatctgtgagaccgggatcgaatattatccactaatgagaactgtctgaagcgttacataagactgactgaacttagtagccgggacaagttctgaa

SEQ ID NO: 508051 - DNA, 1145 bp, Homo sapiens
  misc_feature (297)..(297): n is a, c, g, or t
  misc_feature (455)..(455): n is a, c, g, or t
gctattccgctctgcccgagcgtcgccaggtgtggtgctgtcctcttatttcccaggctccaggccttcaatactacgtagttgtctcgtgctacgtcaatgaggcgagacgcaccaggtgtacgagagatgtgattatatagcacagaccgtaggtcatcgcaacgatgaacccatcgcagggtagactgcaacagtggaagactcatcataaatacccgtgcgactgtccatgacggacattcaaaagttgtccggaccgatgaaatccgatggctctcagtatctgcatagccnagggaacttggatagttggctgcgatggctaagggacaaggtcaggagaatcagtcactttagttagtcatcaactgactcagaatacaatttgcgatgcggcgcaggaaggcacgatcagatgctaacgccaaggtgcttgatgatttgattccttncgcgccatcggtagttataccatacctcttcagaaacctgtggggttattgacaggaaaagacgtgggtaccgcaatgggcactctaagttgaaggcacaggcaatggcccgatgcctgcgcgacataccgcacattgacgaggagcgaggagggcgcttgttgggcctttttgcctcttgcaccatttggtagtacatggactccatcgagttccttgtataggcaacatttattcctcgacgagggggtgtgtgataccttaggctattagcccactaattcgaccttgagcgctcttgaagatagaagagcctccggttggctcctaacttttatccatagggcaatcttgtttcccgtgtgtttgagcgacctattgttcgaacaggaatttttgcattaaacgcattgcggcccccttagacccggtgggcgcagtttacgagtttgcgagcaccttatggtcactacaggtgctctgtctttgacgaaaaggcccaggaaaaccacgggagagatttcgggcagcggaacgcccaagagctttgtcgcacgaacaacatcgtttggtctcgttggggggggccaggctcggcgagttcgcgcactttgaaaggccatccttttttgtgttggcttagacctccccggggcggatttggggggtgtgccccgtgggggttccccc

SEQ ID NO: 508052 - DNA, 377 bp, Homo sapiens
actgcagtttttgatgagtgatttagtgtgtggccatggttgtaacatgggactgggggagcgagggggcctcgtgagaagagcccagcaacttctacgtggggaaatacgggatgatgcagatgcttcccagagcagccagtcagcgtgcatcgtcgcagaattcgagctctgttcaagaccttctagtcctagagaaagtatagttacatttctgcttcagatacacagagggttgggagcaggttttaaatatccttgtccctctacagagtgcacttgaattctgtgtgaaggtctgctatccaaatgtgtctgagcttcaaatgtgggttcagggagtgtatatacggggcaacttaactctatgctcccag

SEQ ID NO: 508053 - DNA, 117 bp, Homo sapiens
cttcggacgcttcttactaggtggtatgctttaggcctactatgagtgtgttaaatattttactctctctacaaggttatttcctagatgtcaaagagctgttcctctttggactaa

SEQ ID NO: 508054 - DNA, 532 bp, Homo sapiens
ggaaggttttccaagcaagatgaagcccaacatcgatcttgtgtactttccctggctccatcatctttggcagaagcaacgcagcgtgtgatgggacaagagacaggtggatcatagaaggccgacttaccaagtgatattttcccaatttccacgacgggagcaaagagggccgagcactatgtctggacaagaaaggccagcaagagactgaatccaaaggcaaggttgttccctatgtcaatacacattgtcatgtagcatgccatactgatcatggaccagtccgcgaaggagaggtcaggcaatatgacttcgaattgcccgtacataagacgacgaaaatcaacaaacgacatctaggtggaagtcaacaaactgctccataataaacaagaaggcagagaccatgataaatcaaaaggtcattttcacagggtagttatacaccataaaggaggcaaagctcatcgtgggacacaaaatccttctcaagatcaggcgaatagcccatctggaaagggaatatcca

SEQ ID NO: 508055 - DNA, 272 bp, Homo sapiens
cgcagatcgccgttaaattctactaaactcgatgttccccgggtgcgcggcggaagcaagcgtctgttatcgtctattaggtaacagtaaatagtgttacactaggtatgacagtgttgactcccggaaagttaagaaaattcgaatctctccgccgggtagggtattacgtcgcggcccttcgagctataaggagtgcgcgatgactgtgtgtcgcgagtctagtagagtagttgaggcgtatagctgagtatgcgtatatcagtttagtc

SEQ ID NO: 508056 - DNA, 381 bp, Homo sapiens
gtgactctacaggatctccacctcccgtagccaaccaggcttctactcgtatcaacagtgtcactgccagcaccaccacgccaggcctcagtgaggaatctaccaccgtctacagcagcagcccaggctcaactgaaaccacagtgtcccctcgcagcaccacaacctcagttcgtggtgaagagcctacgatcttccacagccggccagcctctactcacacaatcactgtccactgaggacagcagcacctcgggcctcactgatgaatctacagccttccccggtagcccagtctctcaccaaaacagggttacctgccacactcacaaccgcagacctcggtgaggaatcaactacctttcccagcagctcaggctc

SEQ ID NO: 508057 - DNA, 213 bp, Homo sapiens
cctttttttttttccccccccccaaaaggggggaggggggaaaaatgggttcccccgggggggggggggggttccggccccccgggggcccccccccttttgggggttttttttttttttttttcccgggcccccccccggggtcccccccaaggccccccccccccctgggggttttttttggccctttttttccgggggggggggggggta

SEQ ID NO: 508058 - DNA, 686 bp, Homo sapiens
caatttggcaaatgtgaggccgttgctcttcatcacaaaaggcggtgtcctgaccgtgttcgcaccgccggttcagtgaaggacggctatccgtgcctgtggcagcacccattccctaaacagtgaattatagggtttacggcgtgcaatgaactctccgtggggaagtcaacaaacagaccatggctatatacgctacctgcgctgtacagatgatgcatgccacaaacacatcgtaggtgggggcaacttcttcttgtacgtggagttagacttaattgcctgtttcgaggcccatttcaatttggaccagagccccttctatgagcttctctcatatgataaggcccgcattctgctcattccagatcaacgctgagccttggcaggtcaagatgtccttatggaagtccacgctgtcagaacccgtagatgtctgcactggcatcgcctgtgccggtcacctcatatgaagtcctacgaccccgtgtattcgcacccctgaagtggtggcccctgccttgtagaaggtctcaccatgtgcatgcagcagtagacagtcagtgtagtcaccagtcgtcctctgttgtagagggaggggttctgccctccttcattccgtcatgattatcatagccccggtgtcggtgcaaacaccctcacgtcgtgcaattaaatagcagcat

SEQ ID NO: 508059 - DNA, 243 bp, Homo sapiens
tacaaaaaagaagctgagagttcaaacttatcacacttgtcataaattctagttttattagttgtttttaagtttttgtctgtattttagactaaccctacttattctgtgaaccaaccagtgatctctggctgaagctcagaagaaacaagggatggttaatatagaaatctggatctggatcaatattctagaggaggcggaggttgccgtgagttgagatcatgccattgtactccagcc

SEQ ID NO: 508060 - DNA, 238 bp, Homo sapiens
aagtcggtaccactttcagagtagcttagattacaggtatgcaccactcatgatgcccaccaccacgcccagctaactttgtatattttagcagagacggagtttcaccatgttggccaggctggtcttgaactcctgacctcaggtgatctgcccacctcggcctcccaaagtgctgggattacaggcatgagccactgtgcccggtccccaatctttctaaccactctggaaagtg

SEQ ID NO: 508061 - DNA, 817 bp, Homo sapiens
agcatactcccgaaaccagtcctgataagagaggaagccagcatccccaagaagctgcagagcgacaggccttcagacagacagagcaagcgattgattcggtcagacaccagtcagtcagtggcaccgcaccatgaggtccctttttatcgtccacgtgcaagtcggaaggtggcgagcgtggaggacaagttaccagcgagccagctttcctttgccggcctttcctaccagccagcagcaccctcacctgaagtcgtgctggcctgggccgttaagggctggcactcggatatctggggacccccagaccttctacccctttccctgaccgagctagcatggtatttgccacagagtcctcacacttctactctgcctcagccatctacggaggcgtgccagttactctgcctacagctgcagccagtgacccacttgcggagaccaagtctatctgtgcgcaggcggcgaagccaagtgacagagctgactcgcgggcgaagctgggatgacgagagcccctttgacaaagcagtttaaaacgcaggaagctgccaaatggatttggagagagcatcagtgtccagagaacaggtcacggggaagagctggggaaatgtgggcagtcagactagcttttgcgggcagcgtgaactcatgagggctcctgagaagaaagaaacttgtgagttctataagacaagtttttcttgtcaaaagaaaatccctgtaagtctgaatatttttggtctactttttttttggaaggggcattgtgtggaaccagagggatacgggggtacacctaaatggt

SEQ ID NO: 508062 - DNA, 256 bp, Homo sapiens
gagataacccatgacctacataaagacagcaaaccaactggtaggaaactacgctcagctcttctaccctaagtcaaagacactatcaactgatgtgttagggatggattctgattggcagacaataaatcagctcccaatggaagcccacggaactaagtagggtcccaagaaaaaaaacggaagctatttcacagagcagagcttctagccaaatttcattcctcaaacctttagtagagggttaatacaccgg

SEQ ID NO: 508063 - DNA, 243 bp, Homo sapiens
ggttcattgctcgcgcgcccaaattgatgggctggacaagtggagcgagctctccaatccagcgcgatctggccaagattttttccacgcccgattacgctgcatggcgctcgctgcgcgaatccgaagactccaagtacatacggtctggccatgcctgctgcactgctctcgcgtctacctatactggcgctggccaccagcccatgtggaagacttcgatttcgatggaagacaccgcct

SEQ ID NO: 508064 - DNA, 429 bp, Homo sapiens
cgcacaggtgagcattgccctactttcaggagggtatgagccaaaagcttcatggtcgaaagggcactggactgggcccagggaaccatcaggcctgggattctcactgcataaatggagagtggattagtcgccacagattcttctgatctgacatttggaaatggtgagagaaactagatgactgtaaactgggtcacaggcctggttcgggcaggtctttgcggacttttctctagcataatgccaaataaacttgcagtctcagtgtgctctcgcttgtatgattatctagtcctttctgtggtgctcagccaagacgtaaaaactaggattcagagcagatacaatagcagttatgtttcggaacgagggcaaggagtccccgagccgggatctggtgctgctttactcacggtgggggaaggg

SEQ ID NO: 508065 - DNA, 794 bp, Homo sapiens
ggggagcgggagctggagaatactgcccagttactctagcgcgccagtgccgaaccgcagcttcttgtgcttagtgtacttctactcacagcgtgccgattcctgaggccaactccagcaatgtgcttttgcaaatctgctgtgaaatgtgctcatcaggtgacatgcctgggacccttgctttgcctgggaagatcttgcaaatgatgtgatggtgcttgcatgtgtgtgtgtgaaaatgcagaaccttagcacaatgatgtgatgcttgatatgctgtgagcttgcaggacgtgtgaaggtgccattatatgttactgctcttgccacacaatggtgacctgcttgatgtcatcaagctgcagctgacgaaactccatggtggttggtgcatgggcttggacacagtgtgtggacaattgtggatcttggatggcctgcaacatatggaatggggcatctatggttaattgaacacccccaaattggtgaacatgacctcagttgcctgcatgaaccttcacattgttgtgaattgactcaatgttgccttgtgcctagtgcatggattcccccatgtgcgactgtggctttcagacttgaagaggtgcacgggaaaaaagtggggaaggctggaagcaatgttccattggggaaacaagaagcttgaaactgtgaaaagaccccctggggaagttccttgtggctgtctcatgggatttgggagaccacggtagctccccggaatgcagtcctttggaatgataatatagggaatgaccacataataccca

SEQ ID NO: 508066 - DNA, 452 bp, Homo sapiens
gcacaggtagagaagcagttatcagagttgacatcgaaagggaacaaatgagagcaaaactagaaccgagaagagaaccggctcaaaaccctgaaagaagacctggaaagtataacgaagatagtgaaggacctagaggcttctcaccagcacagtagccctaatgagcaattagaagaaaccagtaacggtgtccaaaggcacaggaactgagcctctcatagctaatgtctgtgtatagtcaaacagagagttattacagcagaaagaacccatgggagcaacatagccaagatagacaaacactgggttatgctagtcctgccactcctgcttactcatattctaaaaccaatgggcctatgtgacccaaagatacaaactaccagggagctgactgcaggcaaacaaatgtagacaaccaaaggtgcgtaccacggggaaaatctgtg

SEQ ID NO: 508067 - DNA, 719 bp, Homo sapiens
gagagaactagtctcgcgtttttttttttggttttggagggaaagacaaaacgtatttattccaggccaggtcttaaaatgcacactgcacggtcccctgtggttatcagcaccagtaaggaaagaacgtgccttaaggggagccccacccaaagccgtgctgcggtggctgctgtgaggctccccagtgaatccaccgcagtcttcttcctcacggggtgcagtggggtgaggttttctaccctcacagcaaagggatccttaactataaattcacggtatgcagagaagaggacagaatctgatttactggatggtgcctctatttaaaccatgacttaaatctctatcttaaggatttaaactatcttaatttcctgggttaaaatttttaaaaaaagtgggggagaggtgtgagagtcggtaaggggcaatagcaatagagattacactggggctgacacaggagactaaattcctagtcagagtgaagaacccattataaagaggccggctgcagggtcacaaagggacgtaactacctggagtctaatcgagaacatctcatgagtcacatctccattattagccttagtaaggtaagaaaacaattctccaacaacactgggagtccacaagttggtcaagtatggctttctcaggcccggggtaggtaacaatgtctgggagaaacggggtcctctccaatgcccaataga

SEQ ID NO: 508068 - DNA, 544 bp, Homo sapiens
  misc_feature (1)..(1): n is a, c, g, or t
  misc_feature (14)..(14): n is a, c, g, or t
  misc_feature (22)..(22): n is a, c, g, or t
  misc_feature (52)..(52): n is a, c, g, or t
  misc_feature (81)..(81): n is a, c, g, or t
  misc_feature (102)..(102): n is a, c, g, or t
nccatgaaaacggnaatttttnaaagtgtaagccagaaggatgtccttctcnatttggaaaatgcattaagatgagaatgnaaaaaggaattccaataaatncaggccaggcacgttggcttacgcctgtaacccgagcactttggaggccaaggtgggaggatcacttaaagccacaaattcaagaccaacctgggtaacaaagcaagacatcctcaccatctctgcaacaaaaaaataaaaataaaaaatacataggctgggcgcggtgactcacacctgtaatcccagcactttaggaggccgaggtgatcagatcacttggggtccgtcgggagttaaagaccagcctggcaaacatagtaaaacaccatatctactaaaaaatacaaacattagctaggtgtggtggtacatgtctgtagtcccagccactcgggaggctgaggcaggagaatcgcttgagcctgggaggtggaggttgcagtgagccgagatcacaccactgcactccagcctgggtgacagaatgagactccgtttc

SEQ ID NO: 508069 - DNA, 717 bp, Homo sapiens
agcggacttccgcgctcgccccgacggcgtccggcggccgcgccgagggtctggcgggccgcaggatcagtctgggaagcgtgccgacccagacccaaccccccggtgcggaagagccgggcgctggagatggcgccgcgaggcccggaaggcggagagaggacgccatgaggcaaggtctacgggccgcgactggttacgcgcgcgcaaccggcgcatgcaccagcctcgagcgcttcagtagccagactatgggatgatctcacaagagaccgaagcacagaccagatgtgacagtgtgcggcatcaacagtggggcgttaccacactaggacgtaccatacacccagcgacatacctatgtcctgagcttcggagaacaagaaggaagaaggtcgagacgctccattaggaagacgaaatggtaacagtccaagaaagatgggagggctataacagcacaggtgtaaagacaatcctcccggaaagacacacagttcacatacacaagaagacatttaacctggaagtgggacaacctggcatgtatgacattagtcgagcacaccggaaagaagagatcctataacggtcgtgttacacccccacaaggctcggtttcccccttggaacacggcactacccgcggcaccagccatccacaacggaacgacaacccgcacggcaccaaactacaacctcgggctcataagagca

SEQ ID NO: 508070 - DNA, 443 bp, Homo sapiens
cgatcctggcgaccgtttcttagggaaaccgcgtttatcttcttcgtggggaaaatccttgtgcgtcttttgtggcgtggaacgcctgttttgtttctgtctccgggcaactacgccgttgtgttgctgggagtaccctggttcactgcaatgcgcatgtccctccccgcgtcgccctgagggcagtgcgcaggacttcgcccagccgaggcagttgtatgagttttagcttgcagcacttcgagaccgactgcgggaagtatcggaggaggaagcagagtcagcagaagttgaacggtgggcccggcggctcttgagggctaggtgtagtacttcgagaccgctttcgcttaatgtccttagatttacgtttgctctttggagtgggagacctatgcttacgtttcttggactcagattctgacctgtgcttcttcttcttt

SEQ ID NO: 508071 - DNA, 369 bp, Homo sapiens
  misc_feature (176)..(176): n is a, c, g, or t
  misc_feature (254)..(254): n is a, c, g, or t
  misc_feature (311)..(311): n is a, c, g, or t
  misc_feature (328)..(328): n is a, c, g, or t
gttagccaggatggtcttgatctcctgacctcgtgatccacccaccttggcctcccaaagtgctgggattacaggcatgagcctccgcacctggcccctctcattctttctcttcccaaagcacaggtttctatgagccacgggctcgaccagcaaatcccacttctgacactagntgtgtgaaaacacacacacacacaaactcaaaatactttctctattctttcactcaacaacaatcaacacagaatatntgtgtgaccaaatgtgtggggattcctccccaccaacaagcaaacaatcaattctgnaggaaataccaggtggntatactccaattcaattctgacaacatctacctggagatag

SEQ ID NO: 508072 - DNA, 696 bp, Homo sapiens
  misc_feature (288)..(288): n is a, c, g, or t
  misc_feature (661)..(661): n is a, c, g, or t
atgaggaaggctggtatctttcagagtgtaaagtaatcttggaatataaagggtctccctctgtcacccaggccgtagtgctgtagtgcgatcatggctcactgcagcctcaacctcccaggctcaagggatcttcctgcctcagcctcccaagaagctggcactataggcatgtgccaccacacctggctaacttctttatttttagtagagacagggtttcaccatattacctgggctgtgcttgaattcctgggctcaggcgatccgtccaccttggctcccaangtgttgggattacaggcgtgagccactgtgcctggcataatttggtattttttgatagtagccatcctaataggtatgaggtggtatcattgtggttttgatttgcatttccctgattatttgtgttcttgagcatcttttcatgtacttattggccatttgtatgttatctttggagaaatgtttattcagttctgctcattttcaaatttggttttttgtttattggttgagttgttctgtatatattctggatattaaccccttatcagatatgatttgtaaatattttctcccatttcataggttgccttttcactctgttgtgtcccttgatgcacagaaattttgatgtcgaatttattttattttngttctgtgtgcttttagtgtcatattcaataaatc

SEQ ID NO: 508073 - DNA, 225 bp, Homo sapiens
  misc_feature (195)..(195): n is a, c, g, or t
ttgaaggcattctccagattctttttaaaagattgttcatatttctctctctctctctctctctctctctctctctctctctctcttctttctctctgagggagagggagccctccaaacttcagatcgtgtgggttagtatcattatcttcagctcttgataccgtgtgcgagagtaatagtctagagaggagnttcgagtcaataaatacatacttatatcac

SEQ ID NO: 508074 - DNA, 181 bp, Homo sapiens
tggattagaaaaaggaccagaaataagatttcatctatgtcaataatttggtgtttataattgtactgtggttatgtaagatgttaacattagtaagagctgggtgaagggtacatgaaaacaattatttatgccacccttagaaagtcaaacttttttcgaaatgataagttttacaaat

SEQ ID NO: 508075 - DNA, 452 bp, Homo sapiens
  misc_feature (71)..(71): n is a, c, g, or t
  misc_feature (440)..(440): n is a, c, g, or t
  misc_feature (442)..(442): n is a, c, g, or t
tgctgcaaaactaaggcctgttaggccagttgagggctaaaggagccacaaggggccagactgctgctacntcctgaattttaataggacatgcatttttttccatataaacttagaactagcacgcctaaatttttttttaattttattttttttgaggcagagtctcactttgtcacctaggcgggaatgcagtggcacagtctcggcttactgcaacctctacctcctgggttcaagcaattctcctgccttagcctccctagtagctgggactacagacatctgccaccatgactggctaatttttttttttattagagacagggtttcaccatgttggccaggctggtctcaaactcctgacctcaagtgatctgcccgcctcagcctcctaaagtgctgggattacgggcgtgagccaatgcacctggcctcanantgcctaatta

SEQ ID NO: 508076 - DNA, 410 bp, Homo sapiens
gcaggaaagaaatcagactaacgactccatctggcttctaacccttaaacggtcctggtcattcctgggaggtcgggctgaactaacttgggggaggaatccagtgcatagtttaactctgaaacaaaactgataacagcacattcccaaaaagacccccttctggcctggggaccagtctgccttggcaggactaacaaataagctacaagatttgaaattacagttaaggggtctgcagcctcgggctccaagaatctgaacctccccaaatggctccgggggatgacatcagtactgtgaaccctaagatcagggcttgagatacttggcagaccctgcactccagggatcagctgacaccacccagaccggcagtcgggctcaaccagtccggccagctggctcag

SEQ ID NO: 508077 - DNA, 738 bp, Homo sapiens
  misc_feature (68)..(68): n is a, c, g, or t
  misc_feature (114)..(114): n is a, c, g, or t
tggtatttctcaactgacttccaagaagtattctgagctggctgggtggaggtaagaatggcctcacnagaacctgggttcccacctatctatagtggctcttttcttccctcntatatccttttcaaatctcctataaccataaatctggtcctctgaattcctacagaaggaatctggaggaatttcattctacgtgggaaaaatggtctttctggatttatatgggcttatcctggtgttggctaactaacctggctggggtttaatagctggttataaaaatctctgggatcttcagacctaacctccaaaatcatccgggaatttcaaggtggaaagatgaagaagagagggcatctaatacttacctcttataatactggggtctatttccataactggtgaacctaatacctggtgttccccgagtatgtttcctccactttctggtgtaatgggttaaaggaaaagatgtctgaagtattagctgggaactggggtagcactcatctttccaattctggatctaatctggattggagggatgccctaggatgaatgccttcgggaacggcgaaaagactctgaacggttcctcttatgttcttatgcctttggtgaccagaagaggacgcaggatgatgatgacgaccctggatccatcaggagaagaaacctttgcaagaagaaagttgattgctctacttaactcacatagagcctaaaaaaaaacag

SEQ ID NO: 508078 - DNA, 221 bp, Homo sapiens
  misc_feature (54)..(54): n is a, c, g, or t
gtcgctgtcgctggggtggagactggcggagcggtgatgactgccctgatcaangcgcaactccaccatccccaccaagcagacgcgatcttcaccacctactctgacaacaaccctgggtgctgatccaggtgtacgagggcgagagggccatgaggaaagacaacaatctgttggggcgcttcgagctgaaggtgcatccctcggacccccaggggcgt

SEQ ID NO: 508079 - DNA, 112 bp, Homo sapiens
ctaactttatttcttttgcaattctactagaaagcaattagagagagagagagagagagagaaacagagagagagagagaaaagagagtgtattggtcgttcttctctggta

SEQ ID NO: 508080 - DNA, 772 bp, Homo sapiens
caagacctgtgtcagactgtggttgagtatggcctacggggactatgtgcagtgacggcaaggtagccagcgggaccatgtcagatgtgtgtaccccgtacagtagtatctgattctaccccttccttcaggctcttatatccaacccatcagaaaatcctgatgatgctacctctagaacaaatctgctcgtgcctttaacacagccagtgtaaacccaaggccacactatattccattgggagtgcgtatatatccactcttgccttcgttacaatccattctcgtacacagcaagctaaagcaatcgtctgaaacctgtgtgctctgatgactgtacatccttgcttacacacaaatttcagtggcttgctattcaccacagtcaaataaaactcattcttggtctgacaaggtcttgcatcatgcgtggcccttaactaccactccagtatcatctcataccagtcttccccctcagtcatgatgcttgcattcccagtggtcttttgattcacagaacatagccaaactctttcccacctcaaggtactttgtaccttgccgtaccctttgcttataacatgttcataccaggttagacttgatctgtttcctgctctaacaattaggcttaaagccaagtaaacaagttaccaggttaaccacctaaaccttgacacaattaagttctaggcccagctatcttctcagagagcgatggcgttgacctatgagaagagtcaatggccccagttactctgtctcctaa

SEQ ID NO: 508081 - DNA, 185 bp, Homo sapiens
ttagggccagaaattatttcgggctatgttgagcaagctgtcttgcataaaagctatattgggctctagcagaaagttagaatggaacagaatttgagagatacgtgagacccaaagaaaacaaaaatatacattccaaaattttgctattaagccagtgccaagaagtcctttccacaacggta

SEQ ID NO: 508082 - DNA, 318 bp, Homo sapiens
ccagactagcccgacagcaggaacaccctcccgcaggcagtccctgaagctgccgggttctgctctccgcgactgagagccaccggtgtagagagctgcccacgtgtgcacgcaggcggacctgtgctcgtcatcacaggggctccacttttggggagactcacccgcacaccgtccgcgcacgcctgtcgggctagtcggggccccgactagcccgacagtggagaagggttccatgccccgactagctcgacagctcgcgaacgtgttatcccccccccccttgtggggcaagccgggggggtacggagctcgaat

SEQ ID NO: 508083 - DNA, 722 bp, Homo sapiens
  misc_feature (598)..(598): n is a, c, g, or t
gaagtcactgccgggctcgggtgagtcgctgcggggctgacggggtagcagtgcgcgggttacggcctggtcagaccataatgacttcagcgaaataaagcaactcgaagttacaactacaagtgaaacaaaatgcaagagtatttacaaagactttatgcgggatttagaaaagtgggaaacaagacattaagcacaaaacaggatatggaagctaagaagacagagtggtgtccctgaagagaatttacctcctattcgaaatggggaatttttaggaaaaacgaagaataggcgaacggttaaagagtcttccaaaaaaacaagagaggaaaacaaaaaaacagtgataaaatcttatgatatgaggcatgggcaaaattgatgtggaccgtatccttgatgagcttgacaaaagacgatagtacccatgagtctctgtctcaagaatcagagtcggaaagaagatgggattccatgtaagattccacagaaaggtctgtgtttttaaacgaaaaggggcactaagatactttcgaaacaagggagcaatattgattgaaggcaagtggattgtaacacaaaaaggcattggatngccggatccattaataatccgcgtgttgtgcaaggaaacaagaagggttcagcatatttcagacgtgaaaaaatttgggtgtgcgtgggtctgattggtatttagagttgcttgatagaagtta

SEQ ID NO: 508084 - DNA, 115 bp, Homo sapiens
agttagcacgaggagacagcagagactcagtgatggctgtcacgaccggaggggactcgcagccttaccagggactttaagtattcatcggagggtcaccccagttagcgagtga

SEQ ID NO: 508085 - DNA, 374 bp, Homo sapiens
ggataatagatgccatgcaggcaatccaaacggcagatactaatgcggtggacagtacacatggaacatgcctaagcgttgcacatatcatggcctagtctggttgaactgcatacgcccatgccactcaataaaatgactattaacatgagtcccttgttgccacactactgactggccctacagtgatgggctctcttgtgtatgcgacaacattcttggacattacgtcatcgtcttgtcttatacattatatttctatcagactctccagccaaggcgacattgacgatatgtacacagtctacgatgcattccatcccaatagcgcaagagcctccttgagggcacaatgcacctcgagtaccgacatc

SEQ ID NO: 508086 - DNA, 231 bp, Homo sapiens
tggggctccaagatcctgctctggttgccttttgtaggcatgatcacctatcctgtaggtattgctccctcaggatggctctgggcctgcccctaagggcctgtggcctatggtatatgtcctcctggctttgctcatctgatctcctcttctgtatggaaacccagtcatccctgtatcttgccactgtgatccgggtttcaggagctctctgtttcttagggatggact

SEQ ID NO: 508087 - DNA, 270 bp, Homo sapiens
aaataaattgatgatatatgtctatttagaagatcccaaggaatctacaagaaagcttctagaataaattgagtttatccaggttataggatatataggacagcgatatttccacgaacaaatacatgatatatatttttgagaacagaagtcttggctggtgctttgcgcccaaggctgggaagtgcagatgggcggcaatactatgggctacaactggaaatactacccaaactttcccaagagttcgctatctcatagctgtggcct

SEQ ID NO: 508088 - DNA, 946 bp, Homo sapiens
gtgtggggttttttcccaacgacaggtggtggagtctgtttgttgtgacctgtggcgtcaccgcccgataggggggttccccctggggggcccacccgatggggcgaacacccattgggggcgcggcggtggttgtggtgcgacgacagtgtttcgctgacgcccttggggcctgtcttcgggagcggcctttgtgggtaggatgtgtggagtgccccgcggctggctctctgggtcttgtctctcatggtgtggtggccgcccccgcccttgggtgtacactccatgtctcctctgcgctctgtcgcaccaatatgtggggggggggttctggttaatttgtgtggcccccggagatagtatctgcatgtggtggtctcgcatttctccctcggttgggcttttggggcgaccacggttggggagggcgtttaaagcgaattgggttgttacgatccgccggacaaatagggacggtcggttgggtgctttgtttctctgcgccgcccaggggtcggccccccccctcaggcggtcgctctggtgcacacgcccgtgttccctggtgcgcactttggggggggccacgccaccaccttgttgtgggactctctcttccctttctcctcaggtgagccccggagggctgtggcaccatctccctgctgttggcgccatccggtggggcgcggggttgttcttctctcccgaagcgtcttcctggagaaatttttctcgggacctttggtcacccgaggtggcgcccctgatagcgggtcgttttgcgctccctgaggggccctttgtcttctattcataccctggttttcccccaagggccatggggggggggtttaaatgccacttcttggttttggattcccgtggccccccccataggggtggttttttttcattaaagaaatccacggataaacccaaacga

SEQ ID NO: 508089 - DNA, 391 bp, Homo sapiens
ctgcttcatagaaatgagagttagtgggccaggcgtggtggctcacgcctgtatctcagcactttgggaggccgaggcaggcagatcacgaggtcaggagatcgagaccatcctggctaacacggtgaaaccccatctctactaaaaatacaaaaaattagccgggcgtggtggcgggtgcctgtagtcccagctacccgggaggctgaggcaggagaatggtctgggaggcagagcttgcagtgagccaagatcacgccactgcactccagcctgggcgacagagcaagactccgtttcaaaaaaagaacaaaaagaaaaagaaaatggaggagggccaccaggaaggggaataaggtggaaaataataagattaaaatagcaaaaaaca

SEQ ID NO: 508090 - DNA, 881 bp, Homo sapiens
  misc_feature (168)..(168): n is a, c, g, or t
cccacaggcgtttctcagaggaaatgtacacacaggttgtcgcccaaaattgcttgtggacgcatttggggccccttagtggctggtgttctttctcaaaaggggggggcggaaacaaaaacccttggttgtgcaacacacccttctcacgagagttagaccatactntttctcaccacggtttgacacgcctccgcgtgccgtattctcccctggtacacactggcccgctttggggtgacacccccacatatttaagagagcctttgagtccacggagggattcccgcggacccataactacctcttcctgcggaacacaacgtggtgcgcagagataccctccaacgtttccccccgcccctcatgggagatacccgtggtcgcaaagcacggcccacaatgggcgcttcgcactttattgtttttttgtccacgctatgatggaaattttgcacagccacactttggctcattggagagccaccccgagcacccccctgcgttatcacgcgcctggagtgtttcctcggaaagctgaactccactctggttcacctgcggtgaggctttgaagagtgagaataagattaaccccacggttctatttgagctcaccaccaccactgttttaatagagtggaaaagcctgtaacttttggtttccttggccaggacacctgcgagaaagggagggattcccaaaaatttcagcctccctcacaggcgtggccgctcatgcccgtaatctcagccctttgggaggctcaagcgggaggactgattgaatcccggtgttcacagggcccaactaggccaacccccgtgaggaactcatctctgtaaaaaaataaaaattaaaccattaaaaaaaacctgga

SEQ ID NO: 508091 - DNA, 824 bp, Homo sapiens
ggagcattaaaaaatgtctctcacagatccgctggcctctccattcctggaatgccctagaccctctttcacctggagacagatctccctctgtgcccagactgagtacagtggaatgatcacagcttactgcagcctcgacttcctgggctcaagcgatcctcccacctttgggctctggagtagctgggaccacagagaactgttgtgaagattaaagcagatcacagagacttaaagctctttgaaaaaaaaaaggaagaagagaatcagcctttgggtcaatagaactgtgcttgagaaggtttccaaccatggctcccatgggttggctgatgaaatgaacaaggaaaggctgacgacatgtggatcttttccatgggttacgatctcggcgatactgaacatgtgtcctacaagtttccctactgctggggggtgatatgggggtgccacaaccggatgaccttatcatctcctgaaaaggaggacagggaaagatcgggtccctgaggggcagagttcaaatgtatctctcactgtatcataccgtatctttcttcgaacagaaatcacagtcggttctggaggatgcattatcctgggatgatgggaaggggtggcctggttggatctgggctctggaaggggtgtaagactgtttccttccatggatttctaatttatgagtctttgaccatcttcaaatgagctaggtttaactattaatcaaaatagggggttggatctaattgacttatatgaaacggggggggatccaaaaacggtggcacgaagaaattggcaaaattggaaggaattca

SEQ ID NO: 508092 - DNA, 208 bp, Homo sapiens
cggtggtcgaaatattctgctcttgttgtttggatatatggaggatggggattattgctaggatgacggatggatagtaatagggcaaggacgcctcctagctttgttagggaccggcactcggagcaattgtgttacgctaatagcgaatattatcatctcgggccttcgatgtggaggcacgcgggctgatttataggcgcgttgg

SEQ ID NO: 508093 - DNA, 1560 bp, Homo sapiens
ctgtcctgtccaggtgcggtggctcacgcccggctaattttgtgggtattttcagtggcagacggtgttttaccatgttggccaggatggtctcgatctcctgacctcgtgatcctcccgtcctcggcctcccaaagtgctggcattacaggcgtgagccatcagttcctggctgggaagtccgaattttttcttttctcttgttaaacggatctttcgctctgtggttgcccactaccacgccccaggctaacttttgtggtacttattgggctaggagacagagatttcaccggtgatgggcgcaggctgggtgtcgaactccgtgtagcctcgagggtggtatcgcgcccggccacttcggacctacccgaacaggtgtcgtgtggcatgtcacagagcggtgaagacccaaccgagcggccccgggtccccgcacccgcggggacaacatgtaccataaacgcgcgttacaagacctacaaccccgtgcgacccgagtgccccgcaggatccgaggcgtgcttagacccatagggagggctatcccgcgaagacaccccctgtgtgctccgtgtgtcccttaggagaagagggtgggacaacccttcacagtcaggtatgtcacaatactttggcatgggcacacagaaagcccgtcggagagctacccctctcccatctaagaagtggggctcccacaaccgctggagaccagcggcaatagagcctgagcacccacgaaggagccatccagggcgaccggcgacccgcttcctacgagaagaccccccccatagtagtggcggccccaaaagcagaacagtgtcacacacaaccacaataggtgcctttcggcaacgtcatcgtgctctaacatgccgcaggaaaaagacttccaaattggccactgcttaacaagatcaagttgactccaaacgcggataacaacgtgagctacccgccccggggcatatcaggtagagaggcaacagtgcactaccagcgtatgacgcgcacggaggaacgacaaaagacaggagccaaaacccacctcaggatcagaacacaagaaaagaagagcaagcaccgacacacacacaaacaaaacaccaaaacagcaagacacaaaacaagaacacaaatcagacgaagcactaccacaacggttcccatccctcgatggtcgccgccccgccacgcacaccccaccccccaccgccctcgctctcgcaccacaccagcgccagcaccagtcggcgtcgcaccgactcataccctcgacgccaccgtgccagcgcatgtatcacacaaacgccgtggcagtctgcgaagaacagcactcaaaagatcggaaacaacagatatcgaagatcacaccaaccaggaggagtagcgataaagcacacgaggccgatccccacgaggacactaatgcaactcactctgctgaacacgaccagcatgtcctgcctaaagagtagatcatgtagttgccgtctcaacgaatgacgatccgaggagcgagtagacaatcagccacgaggtctcgctagctta

SEQ ID NO: 508094 - DNA, 133 bp, Homo sapiens
  misc_feature (62)..(62): n is a, c, g, or t
tcccgcagttggggcttggcacggactcatggcctgggcacagacatcgatgtctgtggctngagccacacctggggccaccacataaatgcggcgggacccagaaacccccagctccaggactgagtccagc

SEQ ID NO: 508095 - DNA, 188 bp, Homo sapiens
cccctcccccccccccccctgttaattaggggggtgcagcaagcagacctttgcatcaacccagcagacccccaaaaccagtgagggccccccttttttccgcccggccccagccctcgctagctttccttgcccctgggattgtggccctggcccccagcgggaaattaactcccaccagcccgtta

SEQ ID NO: 508096 - DNA, 114 bp, Homo sapiens
gacctgccgtctagaaaacctgccaaatatgatgacatcaaggaaggtggtgaagcagccgtccgaagggcccctcaaagggcaattccttgggctacaataagcaacaaggtg

SEQ ID NO: 508097 - DNA, 185 bp, Homo sapiens
tcacacggcacgccagctacagactgctttctaactcaggatgattttaatgaaattcactttcattttaactggatgcccctcaaacacagttcaccctccctgaaaacagtttagaagaccctatgcctttcttttttttttgggggagtctccctctatcacccgggcggggggtgcggggg

SEQ ID NO: 508098 - DNA, 121 bp, Homo sapiens
cttgcgtcctggctactgagggtttcactcaggtcgacactactgggaagtggaggtgggcgacaagacccactgggcaagtggtgtatgccgggactccgtgagccgtaaaggccgagtt

SEQ ID NO: 508099 - DNA, 226 bp, Homo sapiens
attactcgagacagactatacagagacaacaagttgtcaccagcagaagatagataatatgacctctattaacttgatgaattaacgggagaccaagaggaaatatgtaagttactacccaccctaaaactttctgtgtccggggaccctctgagtagacctataattcctacctagactgtgtgcatcatttgtaagctagcagatctatgaggtgaaaatgcac

SEQ ID NO: 508100 - DNA, 890 bp, Homo sapiens
  misc_feature (887)..(887): n is a, c, g, or t
  misc_feature (890)..(890): n is a, c, g, or t
ggactgcggggcgggccatgggggtgaacctgagcccggagcgggccagcgctggcaagaggcctacgtgcgggtggtcaccgagaagtccccgaccgactgggctctctttacctatgaatggcacacagcaatgactatccgcgtggtgctggcacaggagaggtgtggcctggcacgcgagatgggtggaggtgagctcagagcagcgggcaaggtgatgtacgccttctgcaagattgaaggacccctaactctggacgtgcccaaatttgtcctcatcaagctggacaggcgagggcgtgaacgatgtgcggaagggagcctgtgccagccacgtcagcagcatgggcagcgttcctgaagggggcccatgtgaccatcacgcacggggcgacgaggatgtggagcgctgtgagtgcatcatggtggaaggtggccaagcgcttcaggtgccatctacagctttcacgagaggagagtggcgcttccaggacgtgggaccccaggcccctagtgggctctgtgtaccagaagagcaatgcgcgtctgagattcacaagggtcggcagagacgcttctgggccacaagcggagaaaggaggaggagaacgcggtggaggtagacggcgggccgtgaggcccagagctggtggagcaggacgccgggagcgtgagctgcgtagtgcacgcggagagcgcttagagcggtggcggcgcccgaatcgagtggagccgcagactggtcggacccagtgcagttcggcccgggttcggcgaggggctgcccccctcgtccctgaaggggcctcggggccaccctgggggctcctgcgggtctggccctcgggagttcccccgcgggtctcgcgggccttgtctctccnagn

SEQ ID NO: 508101 - DNA, 1104 bp, Homo sapiens
tggcttcgtcatgtcttcacccaggcatccagcggacagcgaagggcacgagaaggccacactatgggcgacactcctctccctatccggagacagcgtccctcccttcttgcgccaggccatcaagataatggcgtccgctagaggtcagagatctacaggatcccccgccccaaatggcccgcggagatccgagtctccatcaccatccacgttctccgcccgagcaaacggagccctgctctacgaggacagcagctctacactgtctttgcagcggcctgtggatcactcctgaagccgcaatccgagtgttgacaggcatggacctctagagcgtgcttgcgactacgcttgcacgggagggccctgtccatcgatgtgcatgccccggaagggggacgacatcacaaaggcgatggcaaccacccgttaggcttacgtccgcgaggtcccaatggggggcaaagcttgtggaacgcaacaggtccctaacgttaatataatctggtgcgtgtggagttcgcgctagagtcgagtcggaacaccaagtggtacgccacgtatggccgcccgaattctccgttagggcggtcaccaacaagcaattggttccacaggtcagaggggactttccaaggactgaaaacaccccccgttaaacgatgggcccaatggcgctagggggcgcccaactttttgggaacgggccacagctgaggaggaggactaaacggaggccaagggaatgtggcccccaaaagagaggcagcagcacccacacagacaccccgccccaggacgcgggatgtcacccccacgagagagcgcagaattccagagcgcacagaatgcataaaaatgcgagcccattggggacgcggcgggcgtcggcaacgcgggggccaacacaccgagaaccaccacaaaagaaatcgcgccccgccggcaaaagaagggcacacaggcgcaaagagtgacaaccccgcgcccagaaagcacccggaggagaatccaggcgaccgaacgggggagcttcccaacaggtgtcccaaaagcggccacacatcaaagaggaaaagcccacaacactgtccgcagaag

SEQ ID NO: 508102 - DNA, 934 bp, Homo sapiens
cgggccgcaccgtgggtgtcaaaccttgcgcgcaaagacccgtggcgcgagcatgacaataacgcggggcgctagccctcaacaaaatacccggccacttcatttcccgaaacctctgggcccgcctgccccccggtggtgatgcccctggggccccgcggggccccccgtcccaaagggccgccccccggggaagccccgggcccacactcaggacgccaatttcgctgcgcgcccgcggttatgggtcgccacggggaaacactcccgcgtgtcgacaccgaaggatgctgtcaggtggccaccgggtgaacacacaagggcctgtcacaaccacccgggcagcaaacaaagtgaatagcccggccctcctcccccctgaggccgttgccttctactaaaaccccccctctggggcggcggcagattagaccccacaggaggaaggactcctccccgggcggtccctctccaccacacaggtgacgcagatatcacaacgcgggagaagttatacacaccacgaagagcccccacaagggtctctggggcgtttctcactcgcggaaaaccacgcgagagacccgcagaaaaaaccccctcggagatacatcggcgccccccccaccacaggtactggcgtgacataaccaagaggcgaactaatcttctggcgcacacaacctatggagcacccgtgccgctttccgcggcacacacaacgcccctgcgtgggtgaatactccgttccacccaaaacagtcgccccttgcgagtgagcacaccaagaaggtgggggcaaagagcacgaatcatctgatggcacccctgtgcataaggcgcttgagccccccaccaaatctcgtgtatcaaacatcccttggcgccgcccccgggttaccacagggccgcccccccctccttaaacataaca

SEQ ID NO: 508103 - DNA, 232 bp, Homo sapiens
ggaggctgaggcaggagaatggcgtgaacctgggaagcggagctcgcagtgagccgagatcacgccactgcactccagcctgggcaacagtgagactctgcataaagagcatacccatgtgtgtacctatctatctatctatctatctatctatctatctatctatctatctatctatctatctgtatatagatatattaaaatgtaaatggtggcatacctgctgttctgt

SEQ ID NO: 508104 - DNA, 721 bp, Homo sapiens
atctgtaatcccagcacttgggagactaaggcaggcggatcacctttggtcaggggttcgagaccaccctggccggcatggtgaaaccccatatctactaaaaataatttttttaaaaattggccagtcacgttggtgtctgcctgtggtcccagctactcggggggctcgggcacaagagtcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccatgtgcactgctgctatgctgaaatgaacttttataaagtattatggactatagccaactacagatggcatatgccgttaaagatgcattttctatgtatctaatatttgtgtacagtacaagtcagaacctcatttacaagacactttaagggatcctttagaacacatgttttacttaattgcaaatgagtgggctgagcatggtagacttagcagctttttatcaaaacccggcatggtcaggtgaacttcatacaatacgaattagtactactctgaactggtaaatgtagcctgtaacagtatgacggacttttacgacagcactagactagttcattatcctataagaccagcattccaagtgcggatcatcaggtccctccaa

SEQ ID NO: 508105 - DNA, 247 bp, Homo sapiens
atcaggtatccaatcaaatctagcctcagggatgagggatggggattgatctatggcccgctaagacaatggtttatccactgtggaatcgcacttgtagacggtcctcacaactctcgatatctctcggcgccaatacctgtttctcaacgtacttgggcgatgagcatgcggaagatagtgagagaatggagctcccatgtgtgcgacatcgatctcttctatggccagtcgctcgtcattagat

SEQ ID NO: 508106 - DNA, 902 bp, Homo sapiens
gtctcaagcctgtggcgttcgtctgatggggttaccacgcgggttcaacatgcgtatcgatgacagtgttatttctgttcggggcccatctatcctggcacgacggcactgagtgttcgtccgccaacgattgcaaggtgttcagattgttgcaaatctataatgtctagtaaaaaactttaacaaaagaagcgcaatcctcgcaacgttaggtggaccaagagcattccggaaagcagggtggtaaagagcttacagtggataattcattgtgacatttgataccaaaggtagaaatgaagcctatcaaataccagtcgatgagctatggaataaaactattgatgctgatgaacgagagttggcaagaaatcacacgagaagcgccaaggctaaatttaataatgaagcagattgcagaaaaataaagagcttacggaagggttcaggatatcacacagaagtcaaggcaaaaatcatccatctttatccggagaccccttcttgcatggcaaaagggaaacctacgttgcgacacgacgaacacatggtaccagcagttacacacgaggactgttgggcccttggaagatgctccttaaaaaatctctgtaaccattttcttttatgtacatttgaaaaatgccctttgggatacttgggaactgtaacattatttattttttaacataaggttcacttaaatgaaaagcgattaaaagacatgtttccctgcattgcccatttacattactattcagatattacggattgtaggattggcatctcaggtgtttaaattctttagtggatagatgtagctttaagtaaattcatggacaaatccttacttgtactatagaaagtgaattgtggacgcttaaagggttgggcaaaaggat

SEQ ID NO: 508107 - DNA, 1284 bp, Homo sapiens
gcctgctgctgcctcacggtgcctgcacgggactgcctgctcgatccccgagccccctcgcctgaccccgacagaccccccggctgccatgcaatccctggcttctactcctcggggcaccccggatggccacaggcggcccggcctcgctggcgcatgctggctgctcctgcggcagggtggtgcagctgcaggccgggtggctgacagggcagcttttcctggaggtcatcgactgtttgcacgcccggctctgggggccagacacaggtgatacagttaatattcgcgcaggatgtatcctacaagttgaccattcctaagcgaatccagaacttgtgcccaacagaactacattttcagactctcttggctcactcttgtagatacagcatctaaggatggataaatgcagcaacggatctatattgacggcaagatgtcactctaataggaccttcctggagcctcttcgacgctctattgcatatgcagagactaggagctgaccacaccgggaggtcgaatacatttgcccttgtcacgggacaccaactgacacctgatctcaaacagcgacgagacggatccgtgcaggcccaggctattacatttgctccagtgtgcagtacgtgcaacccacgagaagtgccacaacccctcatcttgcaacggtttggaaccagggcagctcagccagtgcaccgcctgctttcggccccaccttggctcgcaaaacagagagatgcagcttgcagcatggacgcctccactaaagtactgcctcacccgtactcaaacaagaccttactcaccaactacataatcaccccacaacaacaagtttgacaacctcctgaacaaatcacacccaagcaacaccaactacaatttccagcaacataatgccacatatcgtattgcatatatcacaccactaaactatgcgctcactcaaatcatctcccccactaaccatctcacaaccacaaacagcaccgactattacctacttaaccacacacaccacaccaccactaactgatcacaatctaccatggctcaccgactcacccgaaaccactccatcgcttcatctgcacaaacgaaacacatacaataaccgaatacgacaacactcctcatacaatagccacgcgcaacctatacaatactaatttaacaaccatccacgatctacaataaagcatagcagacaatcgacctcatcaacacccactacatatcataacacgatcacttacatatcttgatccacactac

SEQ ID NO: 508108 - DNA, 108 bp, Homo sapiens
gactacatgtagacccctaccacacctttctacccctactctggctacaggtaaaaatccagtggcagaacaaggagatgtggcggccgcctgtcagatgttcctgga

SEQ ID NO: 508109 - DNA, 260 bp, Homo sapiens
agccagtgtaacgactcatgaccacaagtccatgccatcattgccacctccataaactgtggatggccctctcctgcggaaactgtggcgtgatggccgcgtggctctccagtaacatcatccctgtctctactggcgctgcccaggtctgtgggcaaggtcatgcactgagataacccggacgctcactggcatggccttccgtgtccccactgccaacgtgtcagtggtggacctgacctgccgtctaggagcgtaat

SEQ ID NO: 508110 - DNA, 166 bp, Homo sapiens
ctcataatcattgtccttatctggcttcctagtcctgtatgcccttttcctaagcactcacaacaagaactaactaagtactaacatctcaggacgctcagtgaaattagaaagccgtctggaacgtatccgtgcgccgccagtcatgcctatgtccatcagtcgc

SEQ ID NO: 508111 - DNA, 197 bp, Homo sapiens
  misc_feature (124)..(124): n is a, c, g, or t
  misc_feature (188)..(188): n is a, c, g, or t
ggcccccctcccctgaggactcgagatatgagttttccatccatctccctggagaagcgccatgacggtgctctccaaggccctggggaagatcttggcgaggggactagccaagtcaggtctnccccctggagcccccctccccctgaggactcgatgataaggacaccaaaaaatctcatagaacntttaatgtt

SEQ ID NO: 508112 - DNA, 384 bp, Homo sapiens
attatgtgtaatctcttacgttctctttatgtagatggattacatttatagatttacatatattgaaccagccttgcatcccaggtatgaagccgacttgatagaggtggatagtttcatgatgtgctcctggattcggttctccagtgttttattgaggtttttcacatcagtgcacctcagggatattggtctgaagttatctttttttattgtgtctcttcccagttttggtatcagaatgatgctgtttttatataatgagctagaaaagaagtccctttttctcaatattttgaaataatattagaagtggtaccagctcttctttgtacatctggtagaattaatctgtaaatttgtctggttctatgctatttgtga

SEQ ID NO: 508113 - DNA, 935 bp, Homo sapiens
cacggtggctcacccctgtaatcccagcactttgggaggccgaggcaggtggatcacaaggtcaggagatcgagaccatcctggctaacacggtgaaaccccatctctactaaaaatacaaaaaaattagctgagcattgtggcacgtgcctgtaataccaggtactcgggaggctgaggcaggagaatcgctggaacccgggagttggaggttgcagtgaaccgagatcaccactgcactccagcctggcaacagagcgagacgccgtctcaaaaaaaaaaaagcagaagtcgtgaaaagagatgcataaagaggctcacacattggtattgacctgaaaatagcgaggacctaacatattttaccaaaaaaacttacacgagaaaatacacaagacaagagggaaggctcccaactggaaacgagatggcaaaagtcaggctaaagaagctggagggaactatagggagggtgctcagaccgtgcagaacgagggaggagcaagcactgattttaatttaccccgggacgtgctagaaatccaccagcagggtggcagaccaggaaaaatgtcgcttttaatctccccagacttttgtgggttcaggcctatggtaaatacggaagattgtacggcgaaaacagaatagttattgttccccacccaagtggaacatcttatttgtccttagctttaaatgctttggctaaccgtggcccatctgtattcagacattggagagccgcgggcgacacatagcagagtcgacagctggtattgtgtgacccctttgtaatacaaagtcgggcggggggacgccagcggtcaacactggggagagccgcaagtgtgtaaacaccggtggcgcgtcgcaacacggggtggacagtgagagacaacacgaggagttccaagagaaaacagcagagtgag

SEQ ID NO: 508114 - DNA, 420 bp, Homo sapiens
agacagagtcttgctgtgttgcccaggctggagtgcggtggcgcaatctcggctcactgcaaactccgcctcccgagttcacgccattctcctgcctcactacgcaagaggctgacgtgggaggatcacctgagcccaggaggcatagcttgcagtgagctgagattatgccactgcactgcagcctgggttacagagccagaccctgtctcagaacaaacaaacaaaactccacctatcctcccagagttaagttgatgtatgttaggtatttaactagttttattaattgcattataaaggctttttttttttttaaacttctagttctcctcagctaacatccccaaacttctttggccaattttttttttttttttgcctttattttggccaattttgttcttttttagctgcttt

SEQ ID NO: 508115 - DNA, 110 bp, Homo sapiens
tctgggagcgatgtgggcagattgtctgagctcaggagttcgagaccagcctgggcagcgtggtgaaaccccatctctgttaaaaagcagaaaaatttaaccgggcctgg

SEQ ID NO: 508116 - DNA, 814 bp, Homo sapiens
  misc_feature (1)..(1): n is a, c, g, or t
  misc_feature (85)..(85): n is a, c, g, or t
  misc_feature (191)..(191): n is a, c, g, or t
  misc_feature (209)..(209): n is a, c, g, or t
  misc_feature (219)..(219): n is a, c, g, or t
  misc_feature (274)..(274): n is a, c, g, or t
  misc_feature (277)..(277): n is a, c, g, or t
  misc_feature (309)..(309): n is a, c, g, or t
  misc_feature (336)..(336): n is a, c, g, or t
  misc_feature (355)..(355): n is a, c, g, or t
  misc_feature (357)..(357): n is a, c, g, or t
  misc_feature (380)..(380): n is a, c, g, or t
  misc_feature (424)..(425): n is a, c, g, or t
  misc_feature (429)..(429): n is a, c, g, or t
  misc_feature (454)..(454): n is a, c, g, or t
  misc_feature (472)..(472): n is a, c, g, or t
  misc_feature (533)..(533): n is a, c, g, or t
  misc_feature (547)..(547): n is a, c, g, or t
  misc_feature (550)..(550): n is a, c, g, or t
  misc_feature (555)..(555): n is a, c, g, or t
  misc_feature (605)..(605): n is a, c, g, or t
  misc_feature (617)..(617): n is a, c, g, or t
  misc_feature (667)..(667): n is a, c, g, or t
  misc_feature (677)..(677): n is a, c, g, or t
  misc_feature (681)..(681): n is a, c, g, or t
  misc_feature (683)..(683): n is a, c, g, or t
  misc_feature (686)..(686): n is a, c, g, or t
  misc_feature (689)..(689): n is a, c, g, or t
  misc_feature (712)..(712): n is a, c, g, or t
  misc_feature (725)..(725): n is a, c, g, or t
  misc_feature (748)..(748): n is a, c, g, or t
  misc_feature (775)..(775): n is a, c, g, or t
nccggggccggggatctggaagcgggggcggtcctccccctggaaacaccgtctctggaaggacacccttaggatcccctgaccncagggtgccacccacacgggcctggggtcctgggaggcccgggctggagttacccccagcccctccctacgtcccagggacccttgggtctgtcgagtcccttgcnggatgagggtcaagaccnaggtcaagcngacttcagccagggtgtgggggcccggcttcgtagcccccagacttacctccccnctnctatcccgggccaggaaggcaatgggagggcnccctagtcaggcacagccccctgaccngtggcaccgtgtgggtttntngggaggtcctgacgtgcccagcnggcatcactgccgtggtttcccagaggctgaggcagaccgcagnnggtncattcggaccaggactccgactccntcatggctaacgcgttangtttgggagaagcagtttctaagaatgaggacagaaggggaagccctgagggtgacaaggnggggggctgccccnctnctctnagggctccagaattcatgaggaggggtccctgggggaggctgggccaggnggtgccccaatnagtgccggtgggtgaagagggccggggtgcagttactgggcgcgcacacnctggcgggtntttncngtnctnggtggggacacggtgcgtgttancctgcagagtgcnggctgggctggagcggggccgcnggacacagaggggagggagacgcaggnttagacaaacgcagaacacagtcctggcagaccccgggt

SEQ ID NO: 508117 - DNA, 384 bp, Homo sapiens
atggacgtcttcaagaagggtttctccattgccaaggagggtgtggtgggtgccgtggaaaagaccaagcagggagtgacagaggcagctgagaagaccaaggagggtgtcatgtatgtgggagctaagaccaaagagggtgttgtgcagagtgtgacttcagtggctgagaagaccaaggagcaggccaacgccgtgagtgaggccgtggtctccagtgtcaacactgtggccaccaagactgtggaggaggtggagaacattgcagtcacctctggagtggtgcacaaggaggccctgaagcaacctgtcccctcacaggaggatgaggcagccaaagcggaagagcaagtggctgaggagaccaagagtgggggagattag

SEQ ID NO: 508118 - DNA, 281 bp, Homo sapiens
ttacccacccccctcgtgctataaatttccttcttaacaccaccttagctgtgcctcagagattctggaatgttgtatttttattctcattagttttgaataacttcttgatttctgcccttatttcatcatttacctaaaagtcattcagtgcaggttattcaatttccctgtaatgtatggttttgagtgaatttctcagtcttgatttctgatttgattgtgctgggctttgagatattggtgtgtggatggatgaggtgctggtgtgtggatggatg

SEQ ID NO: 508119 - DNA, 167 bp, Homo sapiens
agtactgaactgagttctcccagcgttatcctgagcagagttcctcccagacgttatccctgagcccgagttcctcccagcgttatccctgagcccgagttcctcccagcgttatccctgaggcccagttctgccaaactcattctcagcagcctaggaggtaatat

SEQ ID NO: 508120 - DNA, 864 bp, Homo sapiens
ggcccaacatggcggcggccgtaaggggcatgggtagagccttgatacatcatcagaaaggcatagtctttccaagatggtttatcagacatcacttgtgcttgtctgtaaacatccgagtgcccaaagacattttgctgctgctacaaagtctgcaaagaaaacaaaagagaaggtgctaaagaaaaagacaccagatgagaaagaaagatgaaatagaagacataaaagcatatccctatatggaaggcgaactgaggatgatgtctatgtaagagcttatacccgagacagatatatgaggtggagaaagctgtcacttactgaagaaattcaaattacttgagtttactagtccaaagcaaagtgtttatctgtgatttgacacgtggatatggcactgggaaagaagagaaacgtggagccatttaccaggggtcttaggttggcatacccatttgcttccgaaatcaatacagttgtgtatttacagagaatgcatcagaggtcagaatagggaagacaatggagctggattttgaggaggactagtctgatagggaggattgggatgatgaaattgtgcgaactcaaggtaacctggtgcaagaagtaatgctggacctgcagcgagtcaaggagaaatgcggtaaaagaggatcaagagatctcgcacgacccaggcgcgacatcccaaaggccgaatgtaaacgggcagaatcacggaaggcaacaggcaccggccaacagagaacggaagaggcagaccggccgacacacaaacgaggccacctggacggggggaacacacgcagcgaacagcaaacggccacggggaggacaacgcagagaagccgaggaaga

SEQ ID NO: 508121 - DNA, 333 bp, Homo sapiens
taataaaaaaaatacaatgaagagagtacttcatttcacaaattaagtatcaaattggagtgcttaaaaattaacaaggtgggctgggcgtggtggctcacgcctgcaatcccagcactttgggaagccgaggtgggtggaccacgagatcaggagattgagaccatcctagccaacacggtgaaacccgtctctaccaaaaatacaaaaaattagcagggcatggtggcacgtgcctatagttccagctacttgggaggctgaggcagaagattcacttgaacccagaggtgaaggctgctgtaagccgtgacagcaccactgcaccccagc

SEQ ID NO: 508122 - DNA, 792 bp, Homo sapiens
cggttaaaatagagttgatgacaaatattttaaaggtgcagaataccattagaaaatactatttgaaatgggcacttatcgcaatatatctgggcatgaatggccagaaaatatgtattgctgggccgcacaagaaggataaggtctagagaggaaagtagcagattagcagttgagtggcgtgtctcatttcacccagtataagcaaggtgcagtgtacaaagaagtatattctggaatacattatttccattcatttagcagaaataaatcattggtttcacttggcagtggagacacctgagtcactcttttcttaacaccgtgcaacatcttaatttgtgatttcagcagttgcgggtcatgtactgtggtagtaggaagtgatttttaccacctgtgtttgcatatttatatatgctgtggatgaaaataacttactagagaatgtatattttaatgacaagaatgtgtatctgtgggatataatcagagaagtgaaaagtaatttatcagtaatttttaagagtccatgtcgggtgacaagcatctctaatagccaactctttattaaagcacacctcctaaacaataaggaagccatggaacattgtagatagtctaagctaattgtgacagtagtaggaaagctccattttgggcttcgaagtgctattcaaggagtcaacagaatggccaccgacacagggctcggggggtaccagagggcgcgcaaccggttaacgaaagttcggcagtataggcgagcctgaggattgttccccccttctg

SEQ ID NO: 508123 - DNA, 414 bp, Homo sapiens
  misc_feature (373)..(373): n is a, c, g, or t
atgctactcgaggtaaaccattacttggtataataaataagcagatattctgtaaaaaaaaaacacagcctgggcatggtggcacatgcctagaaatcccatcactttggaaggctgaggtgggtggatcacaaagtcaggaataaaggtgttctacccctttgtatcattttcctggcgcacttaagtcggaaaaatcatgggctaagcttaattaagagaaccgtgagattaaagccaaatattttagttaaaaataggatcctataatttcgtggaaaactgagttccttcgtggattacacatttaggcctaggaggcagcaaagtctcacagaaatggcaaaatcttactaaagattacttacagggnaatgttctgaatgagcaacacattgaagtacttttaaaaga

SEQ ID NO: 508124 - DNA, 803 bp, Homo sapiens
gaacttctgcctctttggccagctagttcaggggaccttccacgtggcaagtaacaggaacaatcaggacattgcgcattctgaaggtcgcaggcatgcatccaacgtcatcataaagagcattagattactaatgtatcttttgctataaaagatagaccgtcatgtatccctcactggtatctggagaacctcgtctccgcacttaagcatttggcaccatcgtgataggttgtgcttatgggcgttgacatctcattgccccacgcagagcatcgtctgacatacctcgaagactttttcactgatggtgaggtgaaaggctgagtggagggcacctgggaggatcttaattgtggagctagaaactaaacacataggcttcactcacacaagttaagggccgaaccattgtaggttggcaccgagctccgtatcttgtgatttccatcctaggaccctggaagattggccagttggtctaattgattggtacaaggtcaccttttgggccccagaggcatggacctttcacgtgatggacgacatgtggattccagctggaaagtatctagtcaggcagttaacgaggagcgattgtggggttcgccaaccttttataggttttaacgtttaaaggtgcacaaacgcaagtgttatagtggggcacagcaaaggaaaagggaggttcgttccgtggtaagtgtgggaccgcgatacagattgagcgtttaccggagacatggagaatcgcgatatagcaaaggggaggccagaggataacaggatttttcacgttgtga

SEQ ID NO: 508125 - DNA, 334 bp, Homo sapiens
ctcgatctagagatcgcgtggtattagctaggtcagctctagcagatgtcacgcattaccaagataatgtaggtaagaagggcagatcagtaaagaagattgtgacaatgtgttgcagtgcgcagctcagcctagaatggactagctgccatgaggccagggctgggggacgtttttatagaggtctctgtgatgtgggagctctgtgtggaatgaggtcattgtgcccgcaggttgttagtgattagctgtctctaacaattgtacatacaataattgttcattattgttctcaacttggggctctccccaacctggggacccttccttattg

SEQ ID NO: 508126 - DNA, 152 bp, Homo sapiens
aataattaaattgtacctattatgaatatgtgagatgtgtaaataaattgtgaaaaaaattaaataaagcatgtgtggttctccaaaagaaaaaaaaaataatttcctgaagaataaaatagatatatggcacttggagtgcaaaaaaaaaa

SEQ ID NO: 508127 - DNA, 401 bp, Homo sapiens
  misc_feature (14)..(14): n is a, c, g, or t
  misc_feature (42)..(42): n is a, c, g, or t
  misc_feature (115)..(115): n is a, c, g, or t
gctagggccggggnagtcgggatgatcttgaacttgtcagcntctgcttggcttttaaaagttatcccaggccagatagatgcttgtgtcacgcctgtaatcccagtgctttggngagccaaggccgcaggattacttgagcccaggagtttgagaccagcctgggcaacgtggcgagacccccatctctacaaagattaaaaaaaaatttagccaggtatggtggcgtgcacctgtggtactagcatcaaaaaaatgcaaaaatttgctgggcgtggtggcatgtgcatgtagtcccaactactcgggaggctgaggtggggggattgcgtgaagcccgggaggtcgaggctgcagtaagccatgattgcaccacggcactccagctgatagagatccta

SEQ ID NO: 508128 - DNA, 395 bp, Homo sapiens
  misc_feature (144)..(144): n is a, c, g, or t
  misc_feature (203)..(203): n is a, c, g, or t
  misc_feature (234)..(234): n is a, c, g, or t
  misc_feature (350)..(350): n is a, c, g, or t
  misc_feature (368)..(368): n is a, c, g, or t
  misc_feature (390)..(390): n is a, c, g, or t
  misc_feature (395)..(395): n is a, c, g, or t
agtgttcctgccttgagtggaaggcagggccagccctccttggccaccaattccccttttttcctacctagaggaggactcagccatccccatcacagtccctggccgcctgcctgtgtccctggcgggccaccctgtgtcgangcctcaggcagcagctgtgcaagcagcagccgcccaagcagctgtggctaactaggcanttgccctggaacagctgcgggagaagctggnagtctgcagagcctccggagaagaagatggccctgggtagcgaattgagcagcaacggcttgattgcaacgtgcacttccagcagaaactttcctgggccatggcggcccaagctngcccattgaggcatttcngattcaacagccaaggtaattnaactn

SEQ ID NO: 508129 - DNA, 581 bp, Homo sapiens
aactttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggcccccttgggccccatccatttttaacctggacaaactttttcctgggggccgaatttgggcctccttggcccattcccccttttgggggggcgtttacaattaaaggggccgggttttaccaccggggggcggggaaaaccctggggttccccaaatttattcccttggaagaaaatccccttttcccaggtggggtaaataccaaaggggcccccccgattcccctttccaaaaattgcccccccctgatgggcaaagggaatttgaaccccttaattttttgtaaaattccggataaaatttttgtaaaatcagcctcttttttaacccaatgggccgaaaagggcaaaaaccctttttaaataaaatttccccgaataggggtgaggggttgtcccctttgggaccaagggccccttttaccgggcctcccccgccgggggcgagttttttggggggtgggg

SEQ ID NO: 508130 - DNA, 431 bp, Homo sapiens
tgtctcatgatgctgtgaggcacatctgtctccaggggctcctgtgagtgtctcctgtccttcagggatctcctcaccttgtggaagagacatttgtgtccctcatcctccaaaatgaaagcccttactgttgggcatcctgatagttcagtcagtaagacataaaatccaattagaaatggctcaacccaaaaagggaatctgttgactcaggcaactgaaaggtggggcttcaggcatggtttgatctaggggatagtccagcccctggctgctctcaggttagatgtaccttgactgtcaggatccttgcaggaaattgatggttgcctcacgtggacacaggcagaatccaggagacctggtggacactgggcatccaggaagtgaattcaggagatttggcagacactgggcatccaggaagtggg

SEQ ID NO: 508131 - DNA, 110 bp, Homo sapiens
ttaagctgaaaggcatacatataagggtacctgagaatatctaaaggtaattcgggggggtaaaaattttacaaaaggcgtgttgggccggttaagcctccaggaagtta

SEQ ID NO: 508132 - DNA, 158 bp, Homo sapiens
gacctaacggatccccagattccggctgagaaaaaacaaagcaaaaggtacgaactatggctcgagatttatacgatgaccattttaaagctgttgaaagcagtgcctcgtggtagtatctggtaacactcatgaaatattgcaagctcagttagagt

SEQ ID NO: 508133 - DNA, 568 bp, Homo sapiens
tgtggtggctcttgcctgtaattccagcacttggagactgggacaggtggcttacctggggtcaggagtttgagaccagcctggtcagcatggtgaaaccctgtctctgcaaaggtgccaaaactagccagatgcagtggtgcggcctgtagtcccaactactcaggaggctgaggcgtgagaatggcttgagcctgggagatggaggttgaggtgagctgagatcacaccactgcactccagcctgggtgacagagtgagactccatctaaaaagaaagaacaattaataaggggaccagcagatttcccagacaaggcttttgctttgtttttttgaggtggagtcttgctctgttgcccgggctggagtgcagtggtgtgatctcagctcgctactgcaacctccacctcctgggttcaagcagttcccttcccttagcctcccaagtagctgggactgggggcatgcaccaacaaacctggctaattttgtatttttagtggagatggggtttctccatgttggccaggttttctcgaactcctgacctcaagtgatccccctg

SEQ ID NO: 508134 - DNA, 371 bp, Homo sapiens
aatcgagctcggacccctccatatgtgtgcccagccaacatagtgaaaccccatcgctactaaaaatacaaaaattaggtgtgcgtggcggcatgtgcctgtggtctgagctactcgggaggctgaggcacgagtatcacttgaacctgttaggtggaggctgcggtgagtcgagatcataccattgcactccagcctgggcgacacagtgagattctgtctcaaaaaaaaaaaaaaaacaccaccaatatggcaggggtactaaacaccttgcaaagaggttctgctgagaataggagatttcatttgaggcccatgtacttttttttttggaaaaaggtccagtttttttggtgggaaaaaacctcctt

SEQ ID NO: 508135 - DNA, 334 bp, Homo sapiens
atagaaacattttcagcataatgaccaatgaaatttcctgttgccattccaagatacgccagcatggatgacaatgcattataaaggacagcctgcttaacgggcatggccagcctttaggagaacagcaaagtcacctaattcatgaggcaactcatgacagaacacagcaacagacgtacttaaaccacttgatacgccttcagcagaagcagcaccaattgctaggccatcgctgaaatgcgtgcaggccatcacccattatcaccatccagaccaaagtggcgacgccgacatatgtcagctcctaccgagagtagcgctggctgtgact

SEQ ID NO: 508136 - DNA, 484 bp, Homo sapiens
aattctatcagatggatgtgcatatgagagtcacaatctcaccttcgttctgggtcctgttatgacactgtatcatttgagggctttatacaatatgccttgatatcataatacactatgacctttatttaagtaggagacccaggaccttatctgttgccctaagcctagatatcagagtcaaaatctgttctcttagctggatccaggtatgagagtcatcatctcacctgtgagctgtgaccatgtatatgtcgcaatttcacctgtcatcaggaagcagacatgagagtcctatcacctgggtgctggatgaaaaaagatgcaaagaagacatatttgctttttatccacacatcatttccaatcactatgctgagcaaagtcaatgtgagcagagctgagaatagcagttttctggcaggacggccacttctgagcaaaaaatgacacaataaaagtataaatatttaatagtaaaaaa

SEQ ID NO: 508137 - DNA, 183 bp, Homo sapiens
ccaggcagactccggggcggttggtgggtgagcatggggcagttgacctgggtctgaaagagtcgggagtgacacgctcagagagcatgaactgatgctggcatgacaggattccaggaagatcatggagacctgtccggtagctgtaacagagatggtggagtcacaggacacagcctgtct

SEQ ID NO: 508138 - DNA, 858 bp, Homo sapiens
ggagaagccgcagcgccgcctcttctctcgcgcctcgcctcttcctccgcctcctccttcgcctcttcctgcctcctcctggcttccgccgccgccactccagcctaatcccaaccccaggcgaagcgttcttatttatttccgttttctcgcactacagcctcctgacaaggtgatccgggcgggcccgcaggaattttatcccctcaccggctcacactagtatcgcatgtccactatccagaactccaatctttcgaccccttgtgtgatgcaaactaagggtgagacttactcccggcagggaactgagggatcacatttcatataagaatccagcaacggaacggaagaaaagacatgactaatgttcagggggcaatgcaggatgatttatgacaaaaagaaaatttggtgaaaaggctttcaaaaagaaatgtgcctgtaaatgttacttggtgattgaacatcctgaatacggaagaggttatgcagccttcaaggtgaccaaaggaaaaaatatctgccagtttctctggaggtgccatgtacaggaggaacagtaaggttcatggattctaaaatgacctaaatacgtggagaattcctgaaatagttaggtctctaaacccggttggtggctggtgaatgatcctgcagtaaggactttcatatttatcaatcaacttcatcactctgcgatacgaacatgggttgggctagtacctagaatgcgagaggaaccctatgtcagtcagacgtgggtatgacgacagacgaattgggctacactgcgtcacaacatttggtgtcctaaaaaaaaagggcaaaagggcgaagagatacatacacacaaag

SEQ ID NO: 508139 - DNA, 607 bp, Homo sapiens
aattctatcagatggatgtgcatatgagagtcacaatctcaccttcgttctgggtcctgttatgacactgtatcatttgagggctttatacaatatgccttgatatcataatacactatgacctttatttaagtaggagacccaggaccttatctgttgccctaagcctagatatcagagtcaaaatctgttctcttagctggatccaggtatgagagtcatcatctcacctgtgagctgtgaccatgtatatgtcgcaatttcacctgtcatcaggaagcagacatgagagtcctatcacctgggtgctggacgaagtttcgctcttgtttcccaggccggagcacaatggtgtgatctcgactcactgcaacctccgcctcccggattcaagcgattctcctgcctcagcctgccgagtagctgggattacagatgaaaaaagatgcaaagaagacatatttgctttttatccacacatcatttccaatcactatgctgagcaaagtcaatgtgagcagagctgagaatagcagttttctggcaggacggccacttctgagcaaaaaatgacacaataaaagtataaatatttaatagtaaaaaa

SEQ ID NO: 508140 - DNA, 238 bp, Homo sapiens
aaaattagctaggtgtggcggcatgccagctacttgggaggctgaggcaagagaattgcttgaacccagaggcagaggttgcagtgagctgagattgcactgctgcattccagcctggcaacagagtgagactctgtctcaaaaataaataaacatatgtctaaaatggggcaaacacatctctcagatctttatgctgggggggtaggtagaatgcattatagccagtgtgtgctca

SEQ ID NO: 508141 - DNA, 319 bp, Homo sapiens
ccattgagtgtgctacagcacctggcacagaatatgtactcaatacatattcatgtgcatttaatacatttggaataagttaatagatgaatgacataaatggatgagtggggagaaagagagagagagggagacaagaaagaggaagtggggagagagagatggggagagaaatgttaatcactgactctagagctaggactcagacatgtggaatatgggccaaacttcccattcaataggcctttggcttaaaaggaaactcttcaattcttagaataaaggatgatgtgtgtatgtgaaaaaagcaacctggagt

SEQ ID NO: 508142 - DNA, 252 bp, Homo sapiens
gaccttactagcagacaacagctctagaatctaagaacccagaagttagcagggcatgttggtgcacgcctgtaatcccggctactcaggaggctgaggcaggagaattgattgagcccagaaggcggaggttgcagtgagccaaaatcacgccactgcactccagcctgggccacagagtgagactttgtctcaaaaacaaaacaaaacaaaacaaaaaaagctgctggctcccatcctgtaatcccagca

SEQ ID NO: 508143 - DNA, 343 bp, Homo sapiens
cttctcggatccacaataagtgatgcaacctgtccgaaagctcatgtttgatgccaatatagagatggctttatttttatagtcgctcaaactaaacgcccgcttgttttgtttgtcgaaaatgcatgcaaagacttttaaaccttgaatttggcataaaaaggagtatttaaaaccgtttataatcacacaaagttgtcgcggtgttactttttttttcttttagaaaggttgtatttgatatttcttttgtccagttgatcgtagcatctgtttatattgaaaatgtagtatttttgtcattgcagaataacatgatattaaaaatctcttgtatgtatga

SEQ ID NO: 508144 - DNA, 375 bp, Homo sapiens
  misc_feature (161)..(161): n is a, c, g, or t
  misc_feature (165)..(165): n is a, c, g, or t
  misc_feature (369)..(369): n is a, c, g, or t
  misc_feature (371)..(373): n is a, c, g, or t
cgaatgagctgtcctccaccccacgtcggagacctcagcgcccgggccccggcctgttagcacctgcatgcctttgacggcaacccctggcatatgcctgggcctcacagctattagcggagcgcctactctgttccaggcacagggcacagcagcaaccntggnacccccaggggtggctcctcctccatcccggcttcctgctggaacatgagcaggcaattcacacaagaagcctgtaatcccagcactttgagaggtggaagcgggaggatggcttgagtcttgggagttcaaggctgcagtgggctgtgattgcaccactgcactccatcctgggtgacggagcaagaccctgtctcaaaaaanannnaa

SEQ ID NO: 508145 - DNA, 1321 bp, Homo sapiens
  misc_feature (96)..(96): n is a, c, g, or t
  misc_feature (280)..(280): n is a, c, g, or t
  misc_feature (304)..(304): n is a, c, g, or t
  misc_feature (318)..(318): n is a, c, g, or t
  misc_feature (328)..(328): n is a, c, g, or t
  misc_feature (340)..(340): n is a, c, g, or t
  misc_feature (348)..(348): n is a, c, g, or t
  misc_feature (350)..(350): n is a, c, g, or t
  misc_feature (356)..(356): n is a, c, g, or t
  misc_feature (382)..(383): n is a, c, g, or t
  misc_feature (386)..(386): n is a, c, g, or t
  misc_feature (403)..(403): n is a, c, g, or t
  misc_feature (405)..(405): n is a, c, g, or t
  misc_feature (422)..(422): n is a, c, g, or t
  misc_feature (446)..(446): n is a, c, g, or t
  misc_feature (451)..(452): n is a, c, g, or t
  misc_feature (456)..(456): n is a, c, g, or t
  misc_feature (469)..(470): n is a, c, g, or t
  misc_feature (476)..(476): n is a, c, g, or t
  misc_feature (487)..(487): n is a, c, g, or t
  misc_feature (489)..(489): n is a, c, g, or t
  misc_feature (497)..(498): n is a, c, g, or t
  misc_feature (508)..(508): n is a, c, g, or t
  misc_feature (514)..(514): n is a, c, g, or t
  misc_feature (518)..(520): n is a, c, g, or t
  misc_feature (527)..(527): n is a, c, g, or t
  misc_feature (556)..(556): n is a, c, g, or t
  misc_feature (561)..(561): n is a, c, g, or t
  misc_feature (616)..(616): n is a, c, g, or t
  misc_feature (618)..(620): n is a, c, g, or t
  misc_feature (892)..(892): n is a, c, g, or t
  misc_feature (1075)..(1075): n is a, c, g, or t
  misc_feature (1110)..(1110): n is a, c, g, or t
  misc_feature (1113)..(1113): n is a, c, g, or t
  misc_feature (1145)..(1145): n is a, c, g, or t
  misc_feature (1189)..(1189): n is a, c, g, or t
  misc_feature (1201)..(1201): n is a, c, g, or t
  misc_feature (1203)..(1203): n is a, c, g, or t
  misc_feature (1213)..(1213): n is a, c, g, or t
  misc_feature (1216)..(1216): n is a, c, g, or t
  misc_feature (1282)..(1282): n is a, c, g, or t
  misc_feature (1311)..(1311): n is a, c, g, or t
gtaccccaaaagtcatacagtgtcatgaacaaaggctgggatgggtatgatgtacagtgggaatgtaagacggacttagatattgcatacaaattnggaaaaactgtgtgagctgtgaaggctatgagtcctctgaagaccagtatgtactaagaggttcttgtggcttggagtataatttagattatacagaacttggcctgcagaaactgaaggagtctggaaagcagcacggctttgccctctttctctgattattcattcatcagtggtcctcgcnggtttcctgtaacatgagtggatngattaccatcgtgntactccttgngatcgcctttgnagtctatnangctgtncctgagtgaggggcagtattctcctnncancggtacttctgagtatncntccattttcccaccgtntaccagagattcaccaactcagcnaggannctcnctcccccaggctnnaagtcntgagttcacangnaccacagnnatactggccntggtgnaacnnnctggttnggcagtgcttttacaggacaacaaggatntgaanattcaggaccagggttctggacaggcttgggaactggtggaatactaggatattngnnnggcagcaatagagcggcaacacccttctcagactcgtggtactacccgtcctatcctccctcctaccctggcacgtggaatagggcttactcaccccttcatggaggctcgggcagctattcggtatgtcaaactcagacacgaaaaccagaactgcatcaggatatggtggtaccaggagacgataaagtagaaagtggagtcaaacactggatgcagaaattttggatttttcatcactttctctttagaaaaaaagtactacctgttancaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatatgcagtttttgaaagtgatcattacgtggaatgctaaaaatacntaatttctcctgtgatgccctaagaagcttaagangangtgttgtactaatagaaactaagtacagaaanttcagttttaggtggttgtagctgatgagtatacctcatagagnctataatattcnantggtaataanatnattgatgttgctgtcctccaacatttccagcttggaacgaattatgctaatttgtgagtgccgaanactttgagctcggagcttggtcattcagnggggagtgcc

SEQ ID NO: 508146 - DNA, 583 bp, Homo sapiens
  misc_feature (240)..(240): n is a, c, g, or t
  misc_feature (250)..(250): n is a, c, g, or t
  misc_feature (317)..(317): n is a, c, g, or t
  misc_feature (327)..(327): n is a, c, g, or t
caggaacccgcgaaccctctcttgaccactatgagcctcccgtccagccgcgcggccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccngcaggcccgncagtgctccaaggtggaagtggtagcacatccctgaagaacgggacagcaagctattgtctggaccncggaagcccncttttctaacagaaagtcatccgagaaaacttttggacagtggaaacaagaaaaactgagtaacaaaaaagacctatggcattcataacacatttgcccccagtcttcacgcggagcagttttctggagatccctgggaccccagtaagacataagaaggaagggttggtatatctttcccagtatttcttacccatggattcccatactttgcaagagtgtgggcggacaagcctacgcttctccctgaagttta

SEQ ID NO: 508147 - DNA, 337 bp, Homo sapiens
gctcttggactccaaaacctgttacggctggatttcatagcaaaggtagagcaaacaaactccgtttactcacttcactggtgcctctttatgacctgcttaaactaaacccacttcgcataaattgacactttggtttcctagatttaaactacttgtgttggactttggggtatatacgcctcagttttagaaatctctgagtcctattgaatctctaaatcaatgtgtttcaattcaattatttgttacagatgtgagagaaggcaaggttttctctctctctttgttgtatccactcgcaatgataaaacagcaaacagttctgcctcctcag

SEQ ID NO: 508148 - DNA, 122 bp, Homo sapiens
ctgtatttttatggcagaagggagaaaaagtgtttcaacggtttctaatgaagtccggtatttaaatgataaatgagtgatgtgtttagtagaggcaaaataaaccaataaatgatataaaa

SEQ ID NO: 508149 - DNA, 1665 bp, Homo sapiens
  misc_feature (384)..(384): n is a, c, g, or t
  misc_feature (458)..(458): n is a, c, g, or t
  misc_feature (1072)..(1072): n is a, c, g, or t
  misc_feature (1228)..(1228): n is a, c, g, or t
acccgggggtgtgcgtctcccgggttgtagccttgcgcacgggggggaggccaacttgtcagcccggggactcgcgttttgtgccccgttggcccctctttttgtggaagctacctatttggcacccacagtgtgtgtgttcccgaacacacgacgccgggggttaccccgtgtgtcgccggggtttccccggggggagattgtggtgcggccaccaaacgtgggttcgctcatcaacaagggtgcttcctcgtggccatcacggggcgttcccaactttcggcaatattttgtgtgggcagggcgccgctcaggagatgccccgccgttatatagggtaaagggcccttttccccctcccgcggggtacccacttacaagagngtggcgttccatattcccttgtgtggccacgaggggcataaaccacacaagttgtgtggaaaaacgaatggggngcacgacgaagactcttcttgtttgccgacgactttgccacaccacattttcccagcagaagaggggacttttcgtaagacccccttgagacaccaccactggggttccctcgcgccgtttctcttgtaaggaaaggggttggggttaattccccgccacgagatgttcgtttgctgtgtgacgacgggagaccctctcgtggccccgcgggcctcatggagtctgctctctcccccccccctgggagaaggtgtgtgaaggccgcacacagggggagacacccccacctcctgggaagaatattggtgggaaacagcgcgccacaaagaggttcccaccgggagatataatgagaagggcaacatctcccctccctcggagccacctcggtcacagagaggcagctacacaatgactgctgtgtgaccacaggggcacaaccgacacagctctcgtgagaaagaatgggcccggccacactctctgtgtgtctccgagtctctatacgccacacactcttctcacagagagagagagagtttccgagccccctctcgccacacctgcgggtgtctctcgggctgttttctcgagagagagtgtgggtgatatngccagcagagtgttcttttctgtggagagagagagcccctctgaggccccgggcaacaagagaccactctcacactctctcggagagagagtgtgggagagtcccaacagtggacggacacccgcgactctcggagaaaatatgttgggagagagngccgccacacagagtctccccacagcagagtaaagaggagagagggcgactctcccccaccccgcgacaccacacgagagagagcgtctcatatttttgccaagagccacagacacagacgtgtggaagaattgggcgccccgacacatcttttttctctgtgacgatcaccacacacactctcgcagagaaagagagatctggaccacctgccaccgctggttctcctgcggccctgtgagagggtggctgtttaatattttccagtccatggcgcatattcgccagtggccccagtggatggcgcatttacatttgccacatatatagcccatttgcccccacacatttaagattttagaaaattcacacaagatttccagttaatatagctgaacctgtttccaaatgttaataaaggtttccttgcatggtta

SEQ ID NO: 508150 - DNA, 322 bp, Homo sapiens
  misc_feature (30)..(30): n is a, c, g, or t
aaatttctttgagaaatggatttcccaggnaagtgtccatgggtgaggagcagcatcagtatctaggggtgcactttgggaggccgaggagggaggatcacttgagctcaggagttcaagaccagcctggccaacatggcgaaaccccacctctactaaaagtacaaaaattagccgggcgtggtggcaggtgcctgtaatgccaggtactcaaaagcctgaggcagaagaatttcttgaacccaggaggtggaggctgcagttagccgagattgtgccactacactctagcctgggtgacagagccagattcctccccccc

SEQ ID NO: 508151 - DNA, 240 bp, Homo sapiens
tctgagccgtcgcgaaaacgtggtggatagtacgtcggacacccactgtaacgctctcccgtcatcgcatggcgtgacgtgccacctcttcattccagatattcagtcccttcttccattgcggaccggtttcatcccctttccaggcttgctcgtaaggcgcaaaacgcccgccacgcgccaacatataacctacccgcagccgttcatcagctttcagcaccgtgtctagcgccggtt

SEQ ID NO: 508152 - DNA, 203 bp, Homo sapiens
gcccacgccgagcttcccccgcgccgccccaggccctcccgcgcctctcccatcatcgcgtctcccctgagcaccccccatctaaccctctaccttccccaggccctccgcaatctccccaaccatcgcctcatcccgctgaggaccccatatttccacccacgcgagcgagccagcggtagacagcggagctcatgagtcta

SEQ ID NO: 508153 - DNA, 552 bp, Homo sapiens
  misc_feature (334)..(334): n is a, c, g, or t
agaggttcccccctcacggatactcacacgtcaaaaataagagatgctggcaggttacagagacaaaggcaatgcttatacactgttgatgggagtgaaaattagttcattgtggaaagcagtatggcgattcctcaacgagctaaaagcagaactacctattcaacccagcaatcccattactgggtatataccctaaggactataaatcattctactataaagacacatgtatgtcaatgttgactgttgcaccattcgcaatagcagagacatggaatcaatgttaatgcccatcaatgacgaactgggtaaagaaaatgttgcacacatnaaccatggaatactatgcagcctttaaaaagaatgagatcatttcctttgcaggaatacgaatggagctggaggctattacccctattcaggaacagaaaacctaacactgcatgttctcaactataaataggagctaaatcatgagaactcatgaacacaaagaaaggaacagcaggctgagcatggtgactcatgcctgaaatctcagcactttgg

SEQ ID NO: 508154 - DNA, 108 bp, Homo sapiens
gcacacctgtgagacagaggcctgacctgggctctgcacagaagggcctgcaagtggatctgcagtctgacggggcagcagcagaagatatagtggcaagtgagcagt

SEQ ID NO: 508155 - DNA, 166 bp, Homo sapiens
gagcggtgttcttgctcatgccgggacagggctggggcgtttcccgtaccggctcggctgggcaacagctgtgagacaggcgtgtgtcggtcacggcctttggagtggtgacctggagccgtgctgggtcttgaggcgtcttgggaccgacggcgtggctggcttg

SEQ ID NO: 508156 - DNA, 140 bp, Homo sapiens
accgatgctccaccctgaatgctccatcctgatgctccaccctgatgctccaccctgatgctccaccctgatgctccaccctgatgctccaccctgatgctccaccctgatgctccaggctgggtacctgtgctctgaat

SEQ ID NO: 508157 - DNA, 170 bp, Homo sapiens
atctgtgtcatggagttccgggaagacctcctcgagttgattagtcgtcagcatgcccttgtagacgagcgtgcgcgaagagagcgaagcaaagtacaccccagcttcatgctgggcacgccgccgcagcacgaacgctaaacgttccaggtccatgccaacacgaccat

SEQ ID NO: 508158 - DNA, 305 bp, Homo sapiens
  misc_feature (47)..(47): n is a, c, g, or t
aaaaatccggctgcccctgggccagtcccaggacctttgcacaaganttatgggtataacttacccccacaaggaagcaggaaaacaaccaaaaacccccttgacacttttgaacatttccagttttgtaaagtttattgtcaattgcttttcaagtttaaccaacctcaacagtgtgcaaaaaccatttccaggagggtttgtccccaaaaggtttgcctcccgtttcaaaaaccacttatcctcagcttgcacaaactggttgaacggcaggaattaaaaaaaaaaaaaaatggcttttttta

SEQ ID NO: 508159 - DNA, 159 bp, Homo sapiens
gcaccgagatgacggagtttgtcgtttacgcaaaaggcgcgggcttcgcctcagccgtctaaggcaaagcgatagtgccaatcgccgttgccgcaggcttcggggcgcgcggtatgcggttgaatgttgttttcgctccggtggatttcgcagaccacg

SEQ ID NO: 508160 - DNA, 486 bp, Homo sapiens
ggcccccaaatggatccacagcggatagtcaccaaacttctttaccagcccggcctgagtggactggctacgatgtaacgtgcaatcccctcaaggctttcctctcgacgcacggcatagtcatgaaagcccggttgccagaggcgaccttgacggccagccaccgcattcaccactcgggtgctcttggatttaacttgtcgcatcaagtcggcaagtgaacctttctccagagaaacaagccaatggaaatggtcaggcattaccacccaggccaatgatgttgcgagccctttatattgggcgatcctgaattgttgtacgaccaggcggccgagtctgaagtcgctgaagatgggcccgcgttcaagggtgttggtggtgagcaggtaaatgcggttggactcgttatagcggccgatgcgcaggcgttttgaagcaggtaaatcaggcattccgtggcctctcttcagatggtgtcctgag

SEQ ID NO: 508161 - DNA, 337 bp, Homo sapiens
aactatatatccttccggggcctcggtttcaaaaccaccttctgcaacttcggtcagtggccactacagcttcctggcgttgctgacagcctggctagaagcgagcgtgattcccatagcgccaaaatgctcatcctcaggcccaattcccaccattgtttcactccatttcccttcataaggcccatcacagacagctttgcagccttcttcaaattcctcatgccgcagacccttcatcccgagaacgtccctatagacgcgcgccgtctgaaagcgtgtttcacactttgaatacagagtgcagagctgtgcctcgtgccgtactcggcgagag

SEQ ID NO: 508162 - DNA, 149 bp, Homo sapiens
ctggcaaatgcacacacctcagctagcctcacgaaacgggaataagccttcgaaaagaaatggtccttgaagctggtatctgatatcagcacgggatggtagaactggtggctgattttgaccttgtatggaagtgatggttccccgct

SEQ ID NO: 508163 - DNA, 1818 bp, Homo sapiens
  misc_feature (286)..(286): n is a, c, g, or t
  misc_feature (298)..(298): n is a, c, g, or t
  misc_feature (453)..(453): n is a, c, g, or t
  misc_feature (579)..(579): n is a, c, g, or t
  misc_feature (762)..(762): n is a, c, g, or t
  misc_feature (770)..(770): n is a, c, g, or t
  misc_feature (960)..(960): n is a, c, g, or t
  misc_feature (1811)..(1811): n is a, c, g, or t
ggcgcattcgcgatggcttccagtcctgggaactgtggataaacatcattctactctcatttagtgcttggccccactacagtacacgtctgcagagcgagcaagataattggggaattgttaagccaatggagcgtgaaattcgtgctagcgttgcacatggactgtgctcaaggatgttgggtcgataccgagaatcagagtgccaaacgtttcgttggcgaagggtgtattcgatggtgaaatgatagctataggggaatcggaagctcgctcgaacccgggncatcgcgtgacnccatcggggcggtagcgaagccggaacacttgtcgacgacatggagaacctcagtcaattccatcttcgatggttaatcctcatcgacaaatagtataggctcaatcccacgaggtagtggccactagaattagtcgttctactcgtccggtggnactccaatgccatagcgctcgagagtgcataagtaatcgcttggcgggcatcgcgatttggggagctttccttggtttgcagtcgtacgaggtggtaacccatgtatgtgtggccccacgaaatcnctttaagtaactcgaggtacacacgttctagtcagtttgtgggggtcacgatctaggtggtcatgcgtaaagcgaaacgtggtgggaccccatagagtgggcgccaactataccatctaaagaatagagtgcctagcccgaggaggcctctgcggtgtcagaacatattcgttctgtttcacnttgtgganttgattggttaaccggggacaaatgggaaggggccatagaagtagggctttggattggaaccgattggcccgtatggcaaggggggcttgttccccaagactaagaagcgacagcagcgttgccaaccttggggggaccaggggcgggggcctaaccaacggacattccttccgtgaaaatgagtgggcnaacctttcgttccgctttcaaatcccagggtcttagacggaatacccgtgacaggaaaaggaaattagcccccttaggaaatgccggccattccagtgctgagagtaagcgcctttccaggtatcagaggggtcgcccttttacacccccaagaaacgcgtggttctatgaatcaggccggggagaggtgccaggaagagcccctttgacagacattggcgctagtgcggctaccttacatgagttccgcaatcccacgcttatggcgtcatcgaaggcaaataaccgtggcatttgacgaagcgccttactttgggcatttttgagacacaactctgaatgtggcaccttccttaaatggaataattacttgggttcacctgggccacatcctgggaatgcattggacacaaacatagcaaagccgtaaaggggggatttctggaaaccacgcgtggaattcaagcgcaaccacttgacgtggggggtcacccagagctgggcccttccggaatcacccgtggggcacggtctcaagtggtgaacctcgtaccaagtatgggtgtgtcaacactgggttgccgtatcacagagatatccaataattaaatgcacagaggattggccgcttaacgacgtcggtaaacctcgagaggtcataggacatcacgggcgggaccaccacagaggtttgtgcgacaactagtgtggcgtcacgccacgcgcagaaaacgagcgatggtagctgagtagcaatcagcatgacgacagtggtagagacgactgatgttcacacagcgcataccaccgatccagacgtacatcgctgtcctcgggctgaacgtgtcgcntcggcac

SEQ ID NO: 508164 - DNA, 601 bp, Homo sapiens
  misc_feature (178)..(178): n is a, c, g, or t
cctttccaaacccctaaagagcaggatgaaggctggctcatgggcgtgaaggagagcgcctgacccagcccaaggagctggaaaagtgccgtggcgtcttcccccaaaacttcactaaaagggtcccataacggcggggcccaggcagcctccgggggtgtaaaaaaccctcctcccnaaaaatgtgtggttcttttttttgtttggttttcgtttttcttcttttgaaaagcaaagggaaatcaaaaggagcccccccggcaaaggggcgttctcccaaaaattaggtcgttttccaaaaaaccgggtcccggcaagtccgggggaattccccagtgttcctgaagctgctgggtcctctagttgagtttctggcgcccccgcctgggcccccatgtgtgcctggccccaggggggggttgggggctcccaaccccccatgcttgcctaaagcttcggccgccccccccgggcaagggtcctcttttcctggcagctgctggggggggggcccaaacccccccctagcctggctttcccccccaaccggtttgtgtgctgtttgaaaataaattttagggttccaacccaaatggaccca

SEQ ID NO: 508165 - DNA, 676 bp, Homo sapiens
  misc_feature (88)..(88): n is a, c, g, or t
gaagggaggcacactttctggcaaactgttttaaaatctgctttatcaaatgtgaagttcatcttgcaacatttactatgcacaaagnaataactattgaaatgacggtgttaattttgctaactgggttaaatattttgctaactggttaaatgttaatatgttaccaaagtagagctctaaagaggatgagaaggctccactgatttgacttttaagacttggtgtttggttcttcattcttttactcagatttaagccttacaaagggaatctctggtccagacccttgggcctggcaagggtggctgatggttaggctgcacacttaagaagcaaacgggagcagggaaggcttgccacacaggcacgcacagggtcaacctctggacacttggcttgggctacctggcctgggggggctgaactctggcatctggctgggtacacacccccccatatttctgtgctctgccacccgtgagctgccactttcctaaatagaaaatggcattatttttatttacttttttgtaaagtgatttccagtcttgtgttggcgttcagggtggccctgtctctgcactgtgtacaataatagattcacactgctgacgtgtcttgcagcgtaggtgggttgtacactgggcatcagctcacgtaatgcattgcctgt

SEQ ID NO: 508166 - DNA, 934 bp, Homo sapiens
ggacgcgtgggtcgacccacgcgtccgaatccatcacagaatgaggataacgtgaaaagcgcgcctccacagtcccggtctcccggatgccgagcggcgggttgattctttcatgtttctctgccttgttgtggtgtcgtcggtctcattcgtcgatcccgtgtccagtaccggccggtcgtcaactagcgaatgtggaggatagactacagtagccgcttgtgatctatgactttctggctgtggatgatatacccggggacaggatccaggatgttctttttctttatagaaacaccaacagcagcaacaatgttcacgcccgatcctgtgtggacggaccggcttagacctctccctgcaccttgtgcaagctgctgtgtcagggggccaagcggcagcacgctctgggagagacctgtggcccaagacgtggacctcgtggagtgtgctgtgacccaggccaagaggcagtgagggcatcttctgcctgcttcctggtgtggcagacccaggttctttcattgcaggacaacttgttcacagggagactaccctgtggaacacagcatgatgatgtttcagctgggaatgctgtccatcctgagcctctgctgcaggtgccctgatgttggactgagaattcggtgcccagatctgtgtggttctcagccaggatcggggaggaccgtgttcgaggcgcaactcataccttcgtgctgggaccggaacccccaagattggtaccccggagtcaccctggggtggacgtggaacgggggtgtcccccctttaacgcttccgtggtcggtgtccgctacttttctctttcccgtggaatgtcccctgaaggttcacttctcagggtccttaaaagcggtcctgcatgtgtcccttagaatgtaccccgttgtattcccatcgcccaccatgt

SEQ ID NO: 508167 - DNA, 83 bp, Homo sapiens
ggatttgctggtgcagtacaactaggcttaatagggacatgtttgtgcactgttaaaaaaaaaacgttagaagcttgaattcg

SEQ ID NO: 508168 - DNA, 1299 bp, Homo sapiens
  misc_feature (343)..(344): n is a, c, g, or t
  misc_feature (356)..(356): n is a, c, g, or t
  misc_feature (416)..(416): n is a, c, g, or t
  misc_feature (418)..(418): n is a, c, g, or t
  misc_feature (439)..(439): n is a, c, g, or t
  misc_feature (442)..(442): n is a, c, g, or t
  misc_feature (576)..(576): n is a, c, g, or t
  misc_feature (758)..(758): n is a, c, g, or t
  misc_feature (919)..(919): n is a, c, g, or t
  misc_feature (931)..(931): n is a, c, g, or t
  misc_feature (933)..(933): n is a, c, g, or t
gacacaggagtaatgctggtggctcttcctgaagaactagacctttggtggcccactcgtctgtccattatcgagggaaaccgttcagtaaactacaattagagtgaagcaagatattagctagacgttaagtatagaatatattagtcactctccacgtgtatctcgtacgttgcaaagcccattcagacgagaaggagctgtggttccgattgactacttcaaaagcatcttgaaggttcccttatttccaggttctctttcccgcccttctactatcctttccacagatcgcaggtcttctctcatctttttgtgtcttggggattggtcgctcctcccnntcttcacttggnagacatccataggcaaatataattgatcctaataggccttccttagatttccgtaccttntngtgatctcctttgttctcatnctnattgtccattctcgccgctcctgttatgatttcgcccgatggcctcactccctttatttgggttgggtttaccacggtaacatttgctatgaggtaaacccccagcttccagctctcctcggttcgttcccagnacttaacacacttaccattgattaagttacaggtccttagcataaaataacaacatgatattcttgttatcctttggtaaaccaatatacataggccgattaagagtgaacgtctatcctgctgcgtgatcgatatttggctagactaacatataatttggtgcgtggcagaaggagaactntcattacaagatgtcttcatgacatgtaggacatttggaaacacctctataatcccaaattgactgtgacacaactgtgcatcttggcaggattagaaaccaatccattcaatttaagcctgcacgggagacgaaacgcgacgtggctcttcactatatgnggctctcatagngnaccatttctgcttcagataactagtgagcagcacctttggcattcagaagcttgcacaatacccaggtgcttcaatttataggtacccccccatcgggagggttgaaactataagtttcctgggtcagcatagtcaaaggccccaggggtttgctcgcggactttgcgcacacactcggggacatttctttaaaaccacgagatggtgaactttggtcctctgaatttcattttctcatagatcctcccaaaattgatcatcagaagtttgtccatcaacgccgtttggggatgcgatctttggaacacaccttggctcgcgcgaaacacagatgccactcccatacgatgaaccggaataggtcc

SEQ ID NO: 508169 - DNA, 123 bp, Homo sapiens
gggtgacagagtgagactctgtcaaaaacaaaaaacaaaaacaatgatattttatccagactttatcttttggttaaatcttgtgcactctagaagatatattcaagatagttgtaaatggcg

SEQ ID NO: 508170 - DNA, 201 bp, Homo sapiens
ccatgttatcagaatggatcagagtcaggtacgattgtgctgcccagtgactaacagccgcttttctgtctggttccatggacatgtccaactccatcaggagtcgagcattgagtagccattgtccacgctggattttcaaaacagttgtatggtatacttcaaataccctcaggggaacagccatgcatggattgccag

SEQ ID NO: 508171 - DNA, 160 bp, Homo sapiens
tctgagcagctgggaactgctgagggttgtaggggatagtaggagacagggcgtggcagccatcagaggcgggccagcagtcgaggagcgctgcatccatcggcggggctgaggctggctggtgttgtccggagcgctgggatgacgggagccttttgct

SEQ ID NO: 508172 - DNA, 104 bp, Homo sapiens
gtggatgcataggtacgttttctgccatgaatttgcattcaggactcagggaggacacacttgccaggtgaagaccaatttttgttacctgtgcttttacatta

SEQ ID NO: 508173 - DNA, 352 bp, Homo sapiens
cagaacatctgttgagaccgacccctagtcattggttaccagtgtatcaggcaatctggactttcagtgatgcccactgagatgggcacctgtcaaaagagcagtggtccatttctagatagtggatcttcagataaatttctgccattttcatttcacttcctgaaagtcagggtcggcttgtgaaaaagttgttaaacaacatgctaaatgtgaaatgtcaaccctcactctatactttccctgttcagagcatcagatgaagacttcattgggttttataagtggcttactgatttttggtagtccattgaagaagggagtttgaaagttggtgtatactggtaacgat

SEQ ID NO: 508174 - DNA, 645 bp, Homo sapiens
ggatcgaccctgcttctgtcacggacaaggacacactcacgcattcactacctcatgctgccccgggttcgagaagaattgattgacaagaaaacagagagagcagtatctcagatgcagtctgtgattgaactggaagagtgagtcagagcaccgaaaaagctattcccatagaagtatccttgggaaagaaattgtggttagtccagtcaagcatccagaaaggcgtcttgaaagatatcaagtctgtggaggaagctagtatcacttgaggaactcaatgttcgaaaagttacactgtctacagataaaaacaagtatggcattcggctaagggcagaaccagatcacatggtcctggggaagcgtctagaagggagccttctaaggcagtgatgacgtccatcaagcagttgagcagtcgaggagctggagcagttccagaagactgggaccactggttgtggaaggccatgaatggcacgatgaagacatccgccacatgtacaccttcgatcacggacacaggtgggactgcgcacacctgacagcacactcagatgctcaggctcaaggcctcttagatgtacactccatgaccagtcaaaggtagatgacggcaatggccgcggacgtcacaccgca

SEQ ID NO: 508175 - DNA, 472 bp, Homo sapiens
accgtttgatctggggtaaatcgatacaacatgattctaaagaatcctgaatccataaattacacttttatttttcaaattcacaaaattcacagtggtgctgactgtgtaataaccactatgggaaaacatcccgtaaacctgcctgttgccatgccaatggagtgactgaacggttgacatctgtttgagcatgcttggtgtggctggtagaatgccaccgtagtgcatacacttggtacatcaggggtgaagggagggtttactaaataatggggggagggtaaaatggggatttttttgttgtcccttatttgatgagggtgtggaggtatagtcctcagcttatgccctaaaataacatgtataaaaacccctgaagtctggtgtgggtgtgtacgtgtgagtgtgtgtaggtatccgtcgggcaattaacgcttagtcttctggacatacatgaactctttcctct

SEQ ID NO: 508176 - DNA, 1040 bp, Homo sapiens
gagacaggaagattgtcttcaaaacaaaacaaaacaaaacaaaaaccttgctaagaagcggaggtacagaaagatacgaagaatgacagagacagacatacatagattgagtgatagatagaaagagagaaggattattcacatagaggtgacagaggcaaagaaggatggagggcaaaagagacaggccctagcagaaatatggagaaaggctgtcatagatcctgagagacaccaaagtcacagaactgataaaagggttataaacaaaaaggaccagaaaaatagaaatgaaggccgacaagaagagaccccaaggctgaaaggcacagagagtctagacagtgaaatagagtgagtgacaaggagaaacacccaggctcaggagtgatggaggaaatactggcagatagagagatcagaagagcaagaggagaggtgggaacagagaagagcggggacgagtccggggagctgagaagcagaaggcggaggaggcagtcagtgggaagattcactgacagaagagaccaggagatatggggacttggaggcaggcagaaagacaaaggacaaacagctgcagcgcaaaccctaaagacaggctgacagtaaccggtcggcagagactggtaggaagataaggacaagtcagaatcaggggtgtcaactgagatgcaaatataggcaaaggagctgacaaagagaatcacagagagaaaaaaaaggaggagagcacagaacaatttaaatatccaggctgggcatggtgggtcacgcctgtaatcccagcattttgggaggccgaggcgggcggatcacgaggtcaggagatgaccatcctggctaacatggtgaaacaccatctctactaaaaatgcaaaaaattggccgggcgtggtggcaggcgcccgtagtcccggctactgaggaggctgaggcgggagaatcgtttgaacctgggaggccgaggttgttataatgagccgagatagtgccactgcagtccagcaggggtgacagagtgagactccgtctca

SEQ ID NO: 508177 - DNA, 133 bp, Homo sapiens
ccccccccccgtttttgggggcaggaaaaaccccttttttagggtgggttttgtttttgtataggggcccccggccgggctaggacccgttttttaataaaaggcccccgggcctgttccattttttccccca

SEQ ID NO: 508178 - DNA, 193 bp, Homo sapiens
taaattcgcggccgcgtcgaccccaggaaaccagatctatttttacttttatggcaaggaaaagggacagagaaaaccataaggaaaaaacagctcacacattgaccatttaaaaaaatcacttaggggcccagcacagtggctcatacctgtaatcccagcactttgggagcccaagacaggtgaattactt

SEQ ID NO: 508179 - DNA, 244 bp, Homo sapiens
ccctttttggaatttttaaattttggttttaaaagcaaaacccccccttgttcctttatgggtccgggggaagccttttaaaccgacttttttttaaaaaccgaaaattttttaagcggtttggggccgattttatggtatctttataaggatggttttttaaaaaaaaccaaagccttagtttgtttgcccttaacctggagactaaacccaggtttgttaaattaaccccggttcccgttga

SEQ ID NO: 508180 - DNA, 623 bp, Homo sapiens
ggctggtccgatggtagtgggttatcagaacttatgtcttttcttttttgggtaaatttttgaaaaatatgctaaaagtgcatttaaggagatgggagacaattagcagaatggagaaagtaagtctttttttttcccaaattattaattggtcctggtgtctatgtacctctagctgttcttttgtgtacttttctgggttccaaaccagtttatcctgtggtcctatacataagtttggatataatctgggttcttaaaaacgtgtggtactcattaacaatatattgttctggcaagatttaaaacctggagtccatgaaaataccataggaaggacattaaaacttttaaaaggcaacctcaaagatgatggaaacgcatttacaagtgcggtgaccaaaattttaaggtgaagtcgagcactctaattagagaactgggagggaccacattataacacttaaattcccttacctggccttccccaaaagaagacatgaaaacctagttttaaaacactatttaagacagagattgacgtgtgggaatttatggcagcaaggaatgtgtccaagaccattgctgaggttttgaatacacacgtgacttgtgtaactggg

SEQ ID NO: 508181 - DNA, 119 bp, Homo sapiens
tgaaggctttcccgcattgcttacactcatagggtttctctccagtgtgagtcctttcatgatatcgaaaggaaccggaacgagtgaaggctttaccacattgcttgcatttatacgtt

SEQ ID NO: 508182 - DNA, 2005 bp, Homo sapiens
tggcacgagggccggagccccgccagagcccgacttcagccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgtagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacctaaaaaaaaaa

SEQ ID NO: 508183 - DNA, 2541 bp, Homo sapiens
tggcacgagggccggagccccgccagagcccgacttcagccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatggtgagcagtggctgttctgggctgtcctcccgctctctgtgggatggaggggcatagtgtgtacatgactagatctgacctcccctctcctgcagggtcctggaccaaattgccccgcagcctgcgcatgagggataagagggcagactttgtggttgggtcccttgggggccacattgtggccattgggggccttggtaagtctctatggggctggggagaggagggagtcccaagacaggaaagactagcccccagcatgtgtgtcaccttctgcccatctccaggcactccaggggtcagggctttgtgagctcttttccctatctatgaagtaggcaggatgtggtctgcctggcccagcactcagggtgttcctcagtgactgggggctctgtcaagcaccagcaagggtctacgagacagcagcaggacaaatgaccactgtatgcacagtcaagagaacatatagaaacataaatgaatgaacaaatgatgaacataggcaatgaggagcaaggccctgatagctcatcctggggtgataactactgggctattctctgggcttagggagcagaagggcctggagtccctacggcctgtgcctctcacagccttctctctccttcttgcaggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgtagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacctaaaaaaaaaa

SEQ ID NO: 508184 - DNA, 928 bp, Homo sapiens
  misc_feature (724)..(724): n is a, c, g, or t
gtgcacgccggtctgggcgagctgctgcgctcactcagggagctccacggcgcgcaacgtgacctggaagctgggcagccgacggtacggacccagctcagtgagcttcgctgatgactgtcgtgcgcaggcagcaagcagcactacaactgcgagcactccaagatcaacttccgcgacaagcgcagggcgctggagtccatcaacgagtgggtgcgcgcagaccaccgtacggcgtaggctgcccgaggtcaccaaggacgtggagcgcacggacgggccctgctagtcaacgccatgttcttcaagccacactgggatgagaaattccagccacaagatggtggacaatcgtggacttcatggtgactcggtcctataccgtgggtgtctatgatgatgcaccggactaggcctctatcgaactatctacgatggacagatggaaggataagctgcaaatcgtggaggatgcccctggccctcaagctctccaggctcgtcatcctcatgccccatcgacgtggagcctcttcgagcgccttgaaaagctagtgagccaaagagcagctgaagatctggatggggaagatgcaggaagaaggtgttgccatctccttggccaagggtgtggtggaggtgacccatgactggagaaaacctgttgtgtggcgctgactgagcattgacagaacagggccgacttgttggcatgtcgccaaangcctgttcctggcacgggtcccagccccgctttgaatggacgaatgggaccctttgcgggcactgggggaggaatgggagcccagtggtgtacgcacccttttctatggtgacccaaggcctcgattatggggcggcgcccagtggaatacaccaattgtgggcagaaagaggacatccaagataagggggacccacagggaaa

SEQ ID NO: 508185 - DNA, 1661 bp, Homo sapiens
tggcacgagggccggagccccgccagagcccgacttcagccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttgatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgtagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacctaaaaaaaaaa

SEQ ID NO: 508186 - DNA, 1496 bp, Homo sapiens
tggcacgagggccggagccccgccagagcccgacttcagccccagccagatcccgcgtcaacggaggcggaacggcggaccccgtaccctggcagcatcggagcaccggcgggatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgtagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacctaaaaaaaaaa

SEQ ID NO: 508187 - DNA, 2026 bp, Homo sapiens
tggcacgagggccggagccccgccagagcccgacttcagccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctgggtaccccaattccattgacagggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgtagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacctaaaaaaaaaa

SEQ ID NO: 508188 - DNA, 275 bp, Homo sapiens
  misc_feature (42)..(42): n is a, c, g, or t
  misc_feature (125)..(125): n is a, c, g, or t
  misc_feature (138)..(138): n is a, c, g, or t
  misc_feature (144)..(144): n is a, c, g, or t
  misc_feature (218)..(218): n is a, c, g, or t
  misc_feature (225)..(225): n is a, c, g, or t
  misc_feature (233)..(233): n is a, c, g, or t
  misc_feature (235)..(235): n is a, c, g, or t
  misc_feature (240)..(240): n is a, c, g, or t
  misc_feature (253)..(253): n is a, c, g, or t
  misc_feature (255)..(255): n is a, c, g, or t
gtgtttaaaaaaaaccaaaattaaaaaaaaagattgtggccnggttttgtaaaagttttaggtaaaattccaattgattgttttaggaatcattattaaaaattttttgcaaatcataaagctanatcgaggggttgngcttancccctatgcccattgtaattattcattggggctgtccagttttataatgcattttggccttttgtaagctgctntgactancaaaaaananattcntttaatgtgttancnttggttaataaatgttttta

SEQ ID NO: 508189 - DNA, 1951 bp, Homo sapiens
tggcacgagggccggagccccgccagagcccgacttcagccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatgggtcctggaccaaattgccccgcagcctgcgcatgagggataagagggcagactttgtggttgggtcccttgggggccacattgtggccattgggggccttggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacctaaaaaaaaaa

SEQ ID NO: 508190 - DNA, 752 bp, Homo sapiens
taaggtgggaccaaattttcagaggtagtttccggaggttgtggttgtgaatattggaaactaaaaattgggcctatatacagacacacatatatacatatatattatacatatatggctaaaatgtggattatatgaaacttttatttgggaatactatgcccgccggttttcaggttggcttagggccggccgcactcacggtatttgaggggctactataaagaacaccacttattggtatacttggcggcctctattcttaactcaccaggcaccgtatgaagaatggattattaataatttaacaatctgggaacttctggggttggtgaagtatattttatattcatggccttctggttaggtaattaatctggtggtttattactaagtttataggtaaaggttaatactggggatatgggttcactttaagtatgggtttggcctaatggggaccatccggaaaaaattcctcttaagcaaagcatctccatgggtttccaccattcctggtaacccaaagggccggccggattttctaatatacctatattcctggttcctggtatatttcaaccgctgtggaccactggggaagcttctgggaggtccttagaggcccagtacatccttcccaatgaccctagaacttgttctggcaggaggtttccctggtcccccccgggttatcctgggaacgggggcccacaaagattgccccaggcggggcacgcgcatacctcgag

SEQ ID NO: 508191 - DNA, 1818 bp, Homo sapiens
tggcacgagggccggagccccgccagagcccgacttcagccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatggaaaccagccatgtcctttgggctctgtggagagctttagccttgcacggcggcgctgggaggcattgcctgccatgcccactgcccgctgctcctgctctagtctgcaggctgggccccggctgtttgttattgggggtgtggcccagggccccagtcaagccgtggaggcactgtgtctgcgtgatggggtctgaaggcttggtgggagctgtccactggagcagctcattgccagaggcagctatttctatggctccttttgctgctgaggacactcactgtggctctgtgggatgagagaggcatgggggtgagcacttgaaacactgccttggggccttgggttaggggagcctttgtctttagtgcaggacacacatatgcttacacctacctttatcaccattcgttcatgaatcatgcctagctccatccttgccctgggacctactaggccttccatccaactgggaaatggggagaagcaaagctggcctcatgctcttcagggtcagttcctatctggagttgaccaggcctaccccagttgccattcctgaaaaatctcagctgccaggctgcctttagggtccctgtagacccaggagagttgagaggggttgggggaccaccgcgacgaatcacgacgagggtgtggggacatgccttaggggccggagccgcaggagttccacgtcggggactgctgggtttggagccttctaattggttggttgttgacctgggcacgtccttcactttctgtggctcagtcctcctttttatggggttctgaacttcta

SEQ ID NO: 508192 - DNA, 1175 bp, Homo sapiens
tttttgatactgcgggtgttttgcccttcctgtgtaatgtttgacgcccgttgagtgttccggagtttttcgggctggttgtgggtttctatattcctagtgttcgaatcccggctctttatgaggccaagcgaggcgctgtggttataggagagaatgtgtaaaaagtttggttttcaacgccgcggtgaagtggcgagcctccctgagcgaccggtgctttaccccgtctggaagaaagggaaaataagggtaataccgcccccctggggatttaaggtaagcttggtatatggtccgcctggcccttcttggtcatccgcttatagtctaagtgctaagtagtgccacttaggtgttccagaaattatggataacccttattttttttaaaaggttatattaaactctggagttattgagaaattaagtattccccggtattattaacggggaaagccttttgcccagattgtggtctttccaaaatgtatagtgttacatcgtgtccctatatggcccacgaaatatagagtgctctatatttacaggagtgtaaaccccaaggggatattaagcccagagagagggagatcccccttataaacccccacagagatggcaccacgccattagaccccttggggatatagcccacggattaaccccactctctcttgtattattaagagaaaataggttttcctctgtctcctctagatggtgtagagggtgtggtgataactcgttggaaagagagactctttatatatatcttggttctcatatccactaggttatttataagagctcggtataatattcccccgcggatgaataagctctgagattgagaatcctcgtatatttatgtcaataataattaatttgcgctggcttcacatttgtgaatcacatgggcacaatctttatgagcccacccctatatttttaaaacttctgggacacgcactcacttttggacactatttcccacgctgcacgagaactagtaatcaccttattctcacgccaaagaggagttgtgttgcactggagaagagttatatagcacctgagattagagtttctaatattttgcacatttttgagaaatgtttgttttttacgtgattatattttaaactttagtaaatacttaccctgaaacccca

SEQ ID NO: 508193 - DNA, 630 bp, Homo sapiens
catattctatattttattctcacactttttttcactcaacattctaggctaaattacgggttaactttacacacacataacctaatatcaatatcatctcacttaataatacttaatttctctttaactaactatctcattctaataatacattatatctaccaaaaaattaactatccaattcatatactataaatctatattcttcaaattatatcatctttactaaaaaatcacatcctacactcctttatttctaaacactatatataccaataaataactaaatatatttccatactattataatacacaatatactattctaaattctcctccacatatataatttatctttaataatcttatatttcttattatccattatatcattcttactatacataactcttattaatatcacacctcaatatatacaaataacattttatcttctaaaatatcatcttatttatatcattactacacaacttctattatcatctacatattaacattcttaatatatcttcatactatcacctattccccaatctcctatttccatcttaacaatccttattttcatattatataatattattaactcacaataataatatattatcc

SEQ ID NO: 508194 - DNA, 1389 bp, Homo sapiens
  misc_feature (1352)..(1352): n is a, c, g, or t
  misc_feature (1383)..(1383): n is a, c, g, or t
tggcacgagggccggagccccgccagagcccgacttcagccccagccagatcccgcgtcaacggaggcggaacggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacaccatgtctgcaggaggtggccgggcctttgcttggcaagtgttcccccccatgcccacttgccgggtctatggcacagtggcacaccaagatgggcacctgctggtgttggggggttgtggccgggctggactgcccctggacactgctgagacactggacatggcctcgcacacatggctggcactggcacccctgcccactgcccgggctggtgcagctgcggtagttctgggcaagcaggtgctagtggtgggtggtgtggatgaggtccagagcccggtagctgctgtagaggccttcctgatggatgagggccgctgggagcgtcgggccaccctccctcaagcagccatgggggttgcaactgtggagagagatggtatggtgtatgctctggggggaatgggccctgacacggccccccaggcccaggtacgtgtgtatgagccccgtcgggactgctggctttcgctaccctccatgcccacaccctgctatggggcctccaccttcctgcacgggaacaagatctatgtcctggggggccgccagggcaagctcccggtgactgcttttgaagcctttgatctggaggcccgtacatggacccggcatccaagcctacccagccgtcgggcctttgctggctgcgccatggctgaaggcagcgtctttagcctgggtggcctgcagcagcctgggccccacaacttctactctcgcccacactttgtcaacactgtggagatgtttgacctggagcatggtgagcagtggctgttctgggctgtcctcccgctctctgtgggatggaggggcatagtgtgtacatgactagatctgacctcccctctcctgcagggtcctggaccaaattgccccgcagcctgcgcatgagggataagagggcagactttgtggttgggtcccttgggggccacattgtggccattgggggccttggtaagtctctatggggctggggagaggagggagtcccaagacaggaaagactagcccccagcatgtgtgtcaccttctgcccatctccaggcactccaggggtcagggctttgtgagctcttttcccctaatccaatgaaagntagggcaagggatggtgggtcctgccctttngggggg

SEQ ID NO: 508195 - DNA, 442 bp, Homo sapiens
  misc_feature (1)..(1): n is a, c, g, or t
ngacgacacggcacacacggctgggcctacactaggctgcatgcacgggtgcacgttcgcctactgctgtgaggaccagcgcgcgctagcgcgcgcagttgcgcgcattcctgaaaaatctcagctgccaggctgcctttagggtccctgtagacccaggagagttgagagggtgggggacacagagagaatagagaggatgtgggaactgccagagggccggagcgcaggagttcaagtggaggaatgctggctttgagccctctacactgctggttgtatgaccttggacaagtcacttcacctctctgtgcctcagcatcctcatctataaatggggatctctgaaaccttcctaccctacctacctcacagggctgttgtgaggacccagggagtttggatgtggaagtaaaagtgctgctaaaacctaaaaaaaaaa

SEQ ID NO: 508196 - DNA, 120 bp, Homo sapiens
tctatcacaggtgaattatcacactcgcagaatttgcagaataatttcattggtattatccctcttcctacaaacacatgtcgcagagcactctccattgttactgcagattctgaactg

SEQ ID NO: 508197 - DNA, 489 bp, Homo sapiens
gtggggctttttgtcttgtttttgtattttggttggtaggctatttattactgattctaattcagagctgattattggtccacttaaggattcagtctcttcctggttcagtcttaagggggatgtatgtgtctgggaatttatctgtttcttgtagattttctagtttatgtgcatagagttgttcatagtagtctctgacagttacttgtatttctgtgggatcaatggtaatgtcctctttgtcatttctaattgtgtttatttgaatcttctctgtttggttttgaatcttctctatatggttcaacatatgcaaattgataaatgtgattcatcacataaacagaactaaagataaaaactacctgattatctcaatagatgcaggaaagacttttgatagaattcaacatccttcattttaacaaccctcaataaactacacattgaaggaacatactccaaaataataagagccatctatta

SEQ ID NO: 508198 - DNA, 1885 bp, Homo sapiens
gcaaaatgcaaaaaaaaaaaaaaacctgctttcttcaaacaaaaaaaaattgcagggggaaaaatagacagaatgaggaagcagtatatgaaataatcaaattaaaaactgagggcagaggtgtggtaacacaggtctataatcctggggctttgggaggctgaggcaggaggatttcttgagcccaggagttgaaggctgaagtaagccacaatcatgccactgcactccagcctggatgacccagtcagactcttgtctctgcagaatataataataattttcatttaaaaactaactgggagcttttaaaaaaattgcaaatgggaggcaggactagcttgtggctccactcagagcagcatatggagacttgtaaacttttgctccaagaatgaccacagaaacataccaggaaagctcagagaatctacagaccctttgaaggaagcagcttgctgctgcagactccataagacagttgaaaagctgtaagtgcccaaagtgcaaaaggggaaacatccacccccctcccaatacacatcctcactggggtacctgaaggtccagatcatgggagaaggatttaacctttcctggagctgagacaaatataagagatgagcgaaatataggaatagaggaagcagaggaaagagccccgtgggcactcttggtccccagggaagccattgttgactttgtctcagaggggtccatggggagagatgccactagaattggggaaagactacagggagaaggaaacttccagctgaactttgtaacaatttcaagtaaactcaaagtttcctggacagaatctgggaaaggggtgacccaggagagaagatacagcacagaaactggggcaggtggggaggcacaaatcctgaaagctgcttgctttctcagtggagaggcttggagcctgagacaagttttcagccctgctcaccggctgcctggaaataaactcagtgctattggggtgcacagtgaaagtgagaccagcctttcaggctgcgttggagctggatgaggcctgtcactgcggcctttcccacttccctggccacctgtatgatgcagaagaggcagccataatccccctgagaacacaactccactgggctgagaaccacaaccccataccccacaggggctgaagcaggccctgcccaagaagagtctgagctaaaacatgcctaaccctgccctcacctgaaggtctctctctacctgccctggtagccaaagacaaagaacatagtctcttgggaactctatgccccaaaccacagcctgagacacccaaatacttatccaagcaaccctagggcaagcttgtattctccctatactactgcagctgatgctctcttgaaagcaccacttcctggctggaggccaaccaacagaaaacgagtatgctaaataaaaatacaaccaaggaccctcacagagtccacttcactcccctgctacctgcaccagagcaggtgctggtatccactgctgagagtcctgaaaatggatcacatcacaggaaatggatcatatcacaggactctttgcagacactccccagtaccagcccagagcccagtatctccactaggtggctagactgagaagagcagtaacaatcactgcagtccagctctcaggaagccctatccctaggggaagagggagagcaccacatcaaaggagcaccctatgggacacaagaatgtgaacagcagcccttaagtcaaatatcttccccctgacataatctacccaaatgagaaggaaccagaaaaaacagttctggtaatatgacaaaacaagattctttaacacccccaaaaaaatcacattagcttaccagcaatggatc

SEQ ID NO: 508199 - DNA, 376 bp, Homo sapiens
tctacacctgatggtgacagaagggatttaatagctgggaagtgatgcgataatacggggggataatccaggtgagtgaccctggaacggacaggatcggtcagctgaagctcactcaccagctcttctagcaacggcatggtttaatctctacctaaatatacaaggaccttcttcaccggtcacaaaagaaatcgtccaaaaaagaaaaagcaaagttttaatctcataaatttctccggagacaaacttaatcagagtaagtccaactttagggggtagatgaataaacacaatctaaatcaaaattagcacggatcaacaataagacattaatcagctttatcaatactggtcctcactacatgccaggggt

SEQ ID NO: 508200 - DNA, 127 bp, Homo sapiens
  misc_feature (18)..(18): n is a, c, g, or t
  misc_feature (21)..(21): n is a, c, g, or t
  misc_feature (26)..(26): n is a, c, g, or t
aggtccctgatgctaggnctngggtnggtggagtttgaagactcttgggaaagcctgtactggggccactgttgggggtgggagtgagcccacacagaggccacaggaggcccccacttcaggccca

SEQ ID NO: 508201 - DNA, 188 bp, Homo sapiens
  misc_feature (161)..(161): n is a, c, g, or t
ctagaggatcccttggtagcgcgagggcgcactaaggagcagttatgcttctcatcgatatcgagctggcttacatgaacaccataccatgaggacttcataggctttgccaatgctcagagaggagcaaccagatgaacaagaagaagacttcagggaanccaggatgagattctggtgagtaccca

SEQ ID NO: 508202 - DNA, 283 bp, Homo sapiens
ggaccggaggaccgaggacagaaagattggtggacaggagcagcggccggtggggagggcgctcggcggcggcctgcggccatggccaccgtgatggcagcgacggcggcggagcgggcggtgctggaggaggagttccgttggttgttgaccaacaggggcacgctgtgttgaaacaactggaggacattcctaagggaggcctttttgcgcttaattctgccgggctccggcactgaggggcccgccaagcaagagaacttcatcctaggcagctgtggca

SEQ ID NO: 508203 - DNA, 161 bp, Homo sapiens
ctcgacagtggtgcccccaattcaacagaatacacattcttctcagcaccacatagcacttattataaaatcgaccacataattggaaatgaaacaaaggttctattaagttaaactttataataataaacacatacaaattggcacaactggtcgagatt

SEQ ID NO: 508204 - DNA, 175 bp, Homo sapiens
  misc_feature (57)..(57): n is a, c, g, or t
  misc_feature (90)..(90): n is a, c, g, or t
  misc_feature (94)..(94): n is a, c, g, or t
  misc_feature (130)..(130): n is a, c, g, or t
  misc_feature (137)..(137): n is a, c, g, or t
ctccagcctgggcaacaggtaagactctgtctcaaaaaaaaacaaaaaagaagaagnaaagtacttctacagccatgtcctattccttgntcanccaaagcacctgcagagtccagtgaaatgatatatnctggctnggcacagtggctcacacctgtaatcctagcactttggg

SEQ ID NO: 508205 - DNA, 833 bp, Homo sapiens
  misc_feature (447)..(447): n is a, c, g, or t
  misc_feature (476)..(476): n is a, c, g, or t
  misc_feature (501)..(501): n is a, c, g, or t
  misc_feature (503)..(503): n is a, c, g, or t
  misc_feature (509)..(509): n is a, c, g, or t
  misc_feature (512)..(512): n is a, c, g, or t
  misc_feature (516)..(516): n is a, c, g, or t
  misc_feature (534)..(534): n is a, c, g, or t
  misc_feature (536)..(536): n is a, c, g, or t
  misc_feature (539)..(539): n is a, c, g, or t
  misc_feature (546)..(547): n is a, c, g, or t
  misc_feature (559)..(559): n is a, c, g, or t
  misc_feature (563)..(563): n is a, c, g, or t
  misc_feature (696)..(696): n is a, c, g, or t
ggtcttcaccggcacacccgctgaaccgcggccacttatcctcacctctgcgccaggctgcggatgaggatgacaaggggatgaggagcgagactcctccagtacctcgccccaccaccctatctggtccaggttatccaggcttgcctgagaatggagcccctgggtcgccccaatctctcgctgtgcctctggaggaaccagggcctccgtacgcactcctccgtggccccgcaggctagtgatgagagtgtgcaagatagcaaactccaccaaccaagaaggagccccctaaggaggagacgtgcgacatgctgactggggccagaagcaggccagaaagcctgcccgcggagtcgggagtggaggccagggccccccagcaccacgcagagagagtcgcacagagacccgctggggccctcgtccagggagcagtcgtcgtgnaatccctccagaggagccaggggccccancccgccgggctgggcctataaagananctccancanctanaaaagtagaagagctgcntnccnaagcccnncgacagggggangaanccccaaagccccgaagccagacccactcaagataaccaaggggaagctagggggccccaaggagacccagccaatggacactctttgcccctgtcccaaggcttcggagggactattccgtatgaaagagtgngtcctacctcttgccgggtccggggccgaggcgagtatctggccagagggaggggctaacggaggactatgggggacgagagcgggaaccgaagccgggaatacgaaggaaacgacacgtgcgacggcacatgatgc

SEQ ID NO: 508206 - DNA, 208 bp, Homo sapiens
gagaagcattcacgcagacggttagtctgaaacagcgtggggcacttagcaggtgttcaatgaaatatgtgttgcattaatacacaaacgaatgaaccatcaatgctaactgatgacacacataatgcaatcccattgtgataaacaccattgacatggggaactctggtcagagtgtggggtacctgagctctgaattctgtaatca

SEQ ID NO: 508207 - DNA, 217 bp, Homo sapiens
ccaggtagacctaacccagttagacctaacccaggtagcctcggacacacatctccatgaagccacttgagagggtgtggcctccatcttgtccccccatgatcatcaccatctcatctcgtcagcttgatgtaggggttcccagtccgagattgccgcccggctgagctttcaaagcatgaacgccaaagctcaatggtggtatgagtatggccct

SEQ ID NO: 508208 - DNA, 252 bp, Homo sapiens
agatgacatagcatcatacagaaataccactggataggaatgctataataatgctaaaactaaatctgaggatagggaatccatcgatcgatccaagagatattcattaagttctattatgtactggcatgcttttaggtactaaggcagaagatatggatgagtgtgtcagcagtccctgaccctggggtaggtcatgtccagcagatgtatgtgctacttgaaaccttctaagaagtagggggggatcct

SEQ ID NO: 508209 - DNA, 1026 bp, Homo sapiens
ttttggtgaatgatgttgaatggtgtcccgatggctcagagtagtggggtgggttttcagtgctggggtgcctccctatgtgccagcaggtgctgtgtggagtgggtgaatgctgctgctgtagaggagagtgcccacgggcagctctggccccccccagtgtggtaggtgaactgcctggaagctgggctgcccccaaggtcttctacatctgctggctggacatggcctccccgtgaggtgctggcccttgagcagtcgatgtgtgctatgttatgctgcttgtgacaagcttgggttgagtggtgctggtgcctgaagcctggagtcctgggaccgtggcctagtgccttagtggacagtgaccagaattgggcttgtggtgtgtggccacatgtaacagtgtgtctcagtggctggagacaaatgggtgactggtggtgcgtgggctggggtggatgtctcatttgcgtctgggggaagagctctgaactggggcctcgtaagaatgggaaccaaaccttgctagatccagggtgtaaggccaaggctgggtgtctttagatcgtagttgggagttacctggggctggagctcgctggaaccagcgctctggtgtggagctaaagctcggggggcgggggtattgatcagtattcctatgggggagtgggccatccgagaggcatgacacggcaggtataactggtgcccagtgcgggactggtattacctcgatgactgaacccaccagtctggctggctgacccccggggcgcaggcaagaggacaaagacccccggaaaggcgcgcccacaaaaggcaaaacaatcggcttgggactacaactgcaaaggggttggctacgaggactacccatccggccaagagaccaccgcagaccgcagcaccctatagaaagcgtacaagggaacgccagaaatggaagacgagagacgccgaacaggagagagacaccggcggaacaatggactacagcaacagagcaagtgggcgcaacacacc

SEQ ID NO: 508210 - DNA, 289 bp, Homo sapiens
gacaagaaaggtttctttcacttggtggcgtgatctattctcggaggccagtgtttgatatacctggccttgtggcctgaggagctgctgcctgtcttttttcccgttttaaagaatgcaggaatcaggcccggcgcagtggctcacacctgtaatcccagcactttgggaggccggatcacgaggacaggagactgagaccatcctggacaacatggtgaaacgctgtctctactaaaatccaaaaaattagccgggcgtggcggtgtgtgcctgtagtcccagctac

SEQ ID NO: 508211 - DNA, 708 bp, Homo sapiens
  misc_feature (126)..(126): n is a, c, g, or t
  misc_feature (154)..(154): n is a, c, g, or t
  misc_feature (170)..(170): n is a, c, g, or t
  misc_feature (325)..(325): n is a, c, g, or t
  misc_feature (361)..(361): n is a, c, g, or t
  misc_feature (368)..(368): n is a, c, g, or t
  misc_feature (394)..(394): n is a, c, g, or t
  misc_feature (424)..(424): n is a, c, g, or t
  misc_feature (431)..(431): n is a, c, g, or t
  misc_feature (445)..(445): n is a, c, g, or t
  misc_feature (491)..(491): n is a, c, g, or t
  misc_feature (497)..(497): n is a, c, g, or t
  misc_feature (505)..(505): n is a, c, g, or t
  misc_feature (529)..(529): n is a, c, g, or t
  misc_feature (557)..(557): n is a, c, g, or t
  misc_feature (603)..(603): n is a, c, g, or t
  misc_feature (613)..(613): n is a, c, g, or t
  misc_feature (620)..(620): n is a, c, g, or t
  misc_feature (627)..(627): n is a, c, g, or t
  misc_feature (633)..(633): n is a, c, g, or t
  misc_feature (638)..(638): n is a, c, g, or t
  misc_feature (653)..(653): n is a, c, g, or t
  misc_feature (657)..(657): n is a, c, g, or t
  misc_feature (659)..(659): n is a, c, g, or t
  misc_feature (661)..(662): n is a, c, g, or t
  misc_feature (675)..(675): n is a, c, g, or t
  misc_feature (677)..(677): n is a, c, g, or t
ggagccttggtcctgagcagccaacacaccagcccagacagctgcaagtcaccatggacgctgaaggcctggcgctgctgctgccgcccgtcaccctgtgcagccctgtgtggacagctggctccngagaggactgcccatgggctcaactacngcagccttggtcagcnggggcaggcccctcgcaggcggcgctgtgggccaaatcccctggggtactggcagggcagcctttcttcgatgccatatttacccaactcaactgccaagtctcctggttcctccccgagggatcgaagctggtgccggtgtgccagagtggccngaggtcctggggccctgcccactgcctgctgctggngggaacngggtggccctcaacactgctggcccngctgcagtggcattgccagtgctgccgccngctgcangtggaggccgccanggggggccggctggactgggcacgtggcaggcacgaggaagaccancgccanggcttccnggctggtggagaagtatgggctcnctggtgggcggggccgcctcgacaccgntacgacctgggagggctggtgatggtgacaggataaccatgtggtnggacgacggnggcgtgnagaaggnggtgcngggcnggacagacaggcggntgantncnnctctgaaggtggnangtggaaatggcagagagacctggaaggaagg

SEQ ID NO: 508212 - DNA, 906 bp, Homo sapiens
tacgtccgagacgcctcgaggccgccgctcgccgtggtgggatcgccggcgcccaaggccgccgcccagggcagcccgcccgcaatcgcccaggggggggactatcacagggccaaaaaaaccacgggatcctctggggcgctcgcccgccgcacgagtgtgaccccggcgcacattcagagggtggggtcggcaaccaccaaagagtccaacgccgttttgggcgccacacaaggaccaagctggcgcacctgagtagtcgattattggcaaatctctgcgtgtaccaagaacgcgcgcgtccccccacaaggagttgagaaaaccaccccaccggggcggaccacacaaaaagcgacttgcttgaggcgcacccgaagaatccccaccagggggcaccaactggggtccactacatccacacagaagggaggggacggcactctggtgcacatcaggaaacgtgcatcatcacgcacccaactgggagcataataaaactgcgccgaccccccgccgcgaggcggagacctgtggtaggcgcgccgcccgcacaccaaagcatgaccggccgaatgatgacaccctgctccccgggtaagatcacaacaccagggaagattcgccgtggatatatcgacctgccaaaagacgaccctctttttctcattgacatgacgtcgacagcgtgtttgggagcacaccagtcacaatactgtgctaggagccaccccggcagcccacgagctgtttggtggcaggcctctcctctccacgttgaagaaattccaggggcttttgaagcaatggctcacaactccttttggtaccctcaacattctctgactgtcgaccaccgcgcagacactggcaacgatcgcccccaatgaaaaacgcccccaaaca

SEQ ID NO: 508213 - DNA, 336 bp, Homo sapiens
tctcccgattagatgtgcgccgcgcaggctgctgttccagtagctgggatgctgggtgtggtgctggctcctgccatcagtgcgcacgtggtggcttcatgcatgaacagccgttgcggtatttgcttgggcgtgaagcttgtgttgccagcctgcgcatgctggccaggttccgttggaagcccgccagttcagcgcctgacgcgtggtaggtctcccccacaggctgtgctggcaatgggctgttttttggcagagcgctttccgtagcgacagtagcaggttacaggttgatcagcttggaacaacgttggttgaaggggcagggtccagaag

SEQ ID NO: 508214 - DNA, 181 bp, Homo sapiens
gctgtagaggatcgctctcgaatctatcagtcatcctttaaaattcatttcaaggctcggaaaaggatattttttggtgacatgggcaatttactttaagtacagtaaaaggttatgtgaatttctacagtatgttggccaaaatgaattatatccagaatacgcttaacaacatattctg

SEQ ID NO: 508215 - DNA, 194 bp, Homo sapiens
cacagggcctcagatagagagaatcagcatcaacaagaactcagcgccagagagtactctagaaggaaagatgtgagttaaccggagccaaaccagagatctgatgatagtggggggttccaagctagaatggttgtgtggtattctgtcctcaggggctttgaaatctgtgtgctaatgaggcctcaaattct

SEQ ID NO: 508216 - DNA, 248 bp, Homo sapiens
tggtgctgaggtcgatctagagatccctgcgggtctcttcctggacctctatccacctggcttgggcctcccaaagggctggggattacaggcatgagccaccgtgcccagccgggatttggcttttcaattggatgactatgtggcatagacagtggctgataagtggattaatttaaaaattcagaattgggtgggacatttccatggtagcattggtatgtagaaggtggatgggttaaagtcag

SEQ ID NO: 508217 - DNA, 865 bp, Homo sapiens
ggcccgggtcgcagccgccaccgcccgccccgactcccggacgccgcgggccacgggccgagccccggattcgcgctcggattcgcctcggtcggccgcgcgtatatttgccttccctccatgatctccaacactatccgataaagtagaagcaactgaggtaccgtgaaagagaaaggagctggaactgagaaaaagcagagccaaaccgtgtactctactgacccatgatcagtggctgttctcccaaacagcagcccatccatgtggcctccctaaacttagctgtggtgcttggatgcattaccttatcgtgatgtatgatggatgtatagtatcaagaaccaagttggagtgggattcccttaactcagctccaaggattcggacgggagagcgcgaggactcggcggctgagcgcgcccggaacagcagctagaggcgctgtcaaacaggactatgcgcattcggtgacagatggaccggacactggtcggctgcttcctctgcactgacgtgacttgcaatgtcatcctgggcctcggcgaaggagtccctccaaagcgcggaattccttctctgccggggagcccccgtgttgcggggctgggccatggtacccggaacaccacatcgttttccatgtgaggtgcagagggagagtctgaccgggcctcgtatctctgaccacgaaggccgttactttcagacttcattaactctgaccggaaaaaaaaaaaaaaaaaaaatttttggcgctcggcccggagaagtttaaacactgtgggggcgcccaagtaagacactgcaagcgccgaacacggtgaaggtggtcccaaaacgggggcggcggtgaaccgggtgc

SEQ ID NO: 508218 - DNA, 324 bp, Homo sapiens
ctagcgagagacaggatttcactacattggctaggctggtctcaaactcctggcctcagttgatccacctgccttggcctcccagagtactagggtagcgagtgtcagccaacgtgcccagctgagatctgatggtaatatacttgtttagacagttgctccttcacatagttcccactactctagtgcggccaccatgtaagtcggacctgcccttctgccatgattgtaagtatcctgaaggactaccccctctgccatgatagtaagtatcctgaggcctccccagccatgtgaaactgagtcagataaacctctaaccat

SEQ ID NO: 508219 - DNA, 384 bp, Homo sapiens
  misc_feature (69)..(69): n is a, c, g, or t
  misc_feature (130)..(130): n is a, c, g, or t
  misc_feature (138)..(138): n is a, c, g, or t
  misc_feature (288)..(288): n is a, c, g, or t
  misc_feature (331)..(332): n is a, c, g, or t
  misc_feature (337)..(337): n is a, c, g, or t
aaaggaaaagggccccacaggccaaagaaaacggcacgaggaaataacccaaaaaagttacaacttccnaaaaaaagggacagctcagccggtggggaagactcttacttttaaaaatcttttcaaatgnccctcggnggggcagagccctccaacccccagggttgaggggaccaaggtggcacggtggcactgggggtgcggcagggacacccgaccacaccagagcgtggcagccggagaaaattgtcccctgcctgagccagcctgggagttttggattcatcntggggaaagatgtggacatttaagacagtctttggggacccannttcantggaaaactatctgaaccattaaagtcgagcttttctaaacccacca

SEQ ID NO: 508220 - DNA, 121 bp, Homo sapiens
cgaggactcattcctcctcctcctccaagaaggtcattccatttgctgctgactgtgacctggatgatgtgcacctgccgggacccaatggcagaagaaaatcagtaactgtgggaacaag

SEQ ID NO: 508221 - DNA, 164 bp, Homo sapiens
actctgacacacaggcagacagagtgtgacattaaccaatgtgggacatgcaatgaattcaaagagtgccacgccatcctggaactacaccctctggagggtgggagactacgtgctcccttctctcggacgggagaatgatgagtggcagaatatctactgca

SEQ ID NO: 508222 - DNA, 200 bp, Homo sapiens
ctaattggttcttcgatgacgcttccttctaacctttgtataattggctccttagaatcattcacatctctactcaaaagcaatttccttagaaggtgtttatttgttgatttgtttggctgccccatggcatatggagttcccgggccagggatcaagtccaggctgcagttgtgacccgtcatcgaagaaccaattag

SEQ ID NO: 508223 - DNA, 275 bp, Homo sapiens
ttaaacttgaggaaaggcaaaaaaaggtttgggaactcccccacctgggggcatggggtggaaaaccctgggcaaagttggcccctttttggccagcttggccctcagcccaccaaaaagggcatcaaccaaggaaggggccatgttggggtgttgttcagttgttacaaaggcagggtccaccctccaggggggccccaggaggggttttggccagtcaagggtccccagggggccaccctttccccctcaaaataaagacctccccccttcca

SEQ ID NO: 508224 - DNA, 207 bp, Homo sapiens
atggctgtagagcgggtagtttaggtgctatagtggtaaatacgggccctaattcaaagatttttaggggaattcaattctagtgacgatgggccatgaaacttgtggtttgctccaccagatttcagcagcattgacctgtagtatacccccgtgtcgtgtagctggtgaaagtggtttggatcagacgtccgggcaatgcatctg

SEQ ID NO: 508225 - DNA, 682 bp, Homo sapiens
  misc_feature (610)..(610): n is a, c, g, or t
gctatgccaaagactggtctatggtggcttcagacatgatggttctccatgaacaccttcttcagttgccacaaagaattccacgacaagttccatctctacagttttctcaggagtcctatgcgagcgaaaaactggcagctgtgcattgtgtctaagagctttataacggccacttcagtagatgggagcatctaagtgcaaactttgcaggagggtatgccttgaggctgattccatgggatctccccttgttgattcagatgctctcctgtgggaccttatccgtgtacagcgatgatcttcttctcgaaagacgaaagtgtctggcagtagagtgatctaagcgttgcagagcaagtactgaatgctcgtaaataagagggctctacagatgaggcacacagagctgtgggggataacgcagaaatgatctagttgacaccagagacacaggatgggggtgaatctcttgtataagcactctatagactagagagagacgagctgcccgagcgtcgtacaactggaggtcgagctctaggaattcacaacagagagcacctagatttgtctgttgtccaggggcgcacggtgaggacacctacanacgagtatgccttacagccagcgtcatgaatggcgcccatcagaaagaagctcaaaattattcctgaggatc

SEQ ID NO: 508226 - DNA, 1083 bp, Homo sapiens
gactgcatgtcaatccgagcacagcttcttctatgatcccattgtgacttcacttgccatcacgttcgctacagacattcgcccagttgaacgcaacgaatgactgcggagcacatagctccttctgttaccgatagctagcaatattcccgagtgctcaatgaagcagtcgcagtcttaaaagtcttacgtggctaccatgagttggttcagactgttcggtggtcacagtaggatgtggacgcgcaagttgacgcctgggagttctaacgcctaggtccgacttgctagtaggaagagagcagcccacttttgacttcagggtactgtacttctttcatactattcacgggcttcgatctctgtatgtgcttgtcgtgcacacacggctatatagggtacacgacggaaagtggggaggcctggtgtgcactgctccttgggggagggctctacagtgattcgtacaggagcaacggctgttgttgatactggcatatgcagtgtgaatcctagatctgcacaagtgactaggtaccaggtgggagtattggggttcacatgattagcgcaattaagctgcctctaaatacatgctttgtggctttacctcttctttccaagagggccaaaacgtaagagagtgaaactacgagctgttctcaggactaaggttcacgcatcatgtactgcctgctacaggtttgaaccgaatcaagggtcctaagcacttactggctcagtgccttgctcattgctgtttaggacataaattaggggatcaaggtttctaaaaatccttccatccgtttccccttttctttatcctgggaacgttctttggaaggcgccccaagagatatagtcggaggaagaatgggttgatacaggaacggagtattggttacccgtggctattgtcgataccgagaattcaggcgaggtgtttgcacaaaacggtggcgttttaaaagccctgtgaggaaccttaatcttttgacgccaacttacactttcacacggatctctggttcggcctgtttcacaatttttggtgccacagggaacatgttgggcttccca

SEQ ID NO: 508227 - DNA, 546 bp, Homo sapiens
  misc_feature (6)..(6): n is a, c, g, or t
  misc_feature (77)..(78): n is a, c, g, or t
  misc_feature (95)..(95): n is a, c, g, or t
  misc_feature (102)..(102): n is a, c, g, or t
  misc_feature (109)..(110): n is a, c, g, or t
  misc_feature (139)..(139): n is a, c, g, or t
  misc_feature (141)..(141): n is a, c, g, or t
  misc_feature (176)..(177): n is a, c, g, or t
  misc_feature (191)..(191): n is a, c, g, or t
  misc_feature (217)..(219): n is a, c, g, or t
  misc_feature (222)..(222): n is a, c, g, or t
  misc_feature (226)..(226): n is a, c, g, or t
  misc_feature (231)..(232): n is a, c, g, or t
  misc_feature (246)..(246): n is a, c, g, or t
  misc_feature (248)..(248): n is a, c, g, or t
  misc_feature (255)..(257): n is a, c, g, or t
  misc_feature (261)..(261): n is a, c, g, or t
  misc_feature (277)..(278): n is a, c, g, or t
  misc_feature (280)..(280): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (301)..(301): n is a, c, g, or t
  misc_feature (308)..(309): n is a, c, g, or t
  misc_feature (316)..(317): n is a, c, g, or t
  misc_feature (325)..(325): n is a, c, g, or t
  misc_feature (351)..(351): n is a, c, g, or t
  misc_feature (360)..(360): n is a, c, g, or t
  misc_feature (367)..(367): n is a, c, g, or t
  misc_feature (381)..(381): n is a, c, g, or t
  misc_feature (411)..(411): n is a, c, g, or t
  misc_feature (426)..(426): n is a, c, g, or t
  misc_feature (430)..(430): n is a, c, g, or t
  misc_feature (463)..(463): n is a, c, g, or t
  misc_feature (512)..(512): n is a, c, g, or t
gaacanacttttagtaccatagaaacctttcaacatgtacaatgacatattattactatgtacaacttcaaaaacanncccctccagctgcaagncaactcntgttgannatcctgcctatatttcacctgtacgaaantncctggatggccaatggtctccttggcttggaaaannttatataaataagnccttcaatgagttgggaatcataaannnggnatcnggggnngggtgatctgggtntnggggggnnngggntggctctgggggttcnncnggcaaaatngnancctgtggntatttanncttcggnngtgcaggnggtcttgttggttcacggttggtctntcaaaaatnaaagctnttcctatggtggcnaacaaaacttggtatctggttccaataccntttttcaccagctcntganctccattctcatcggtgattagaggtgcatggnattctttatctgccacataactttctaatccttctccagcataggaganaggaggagagatttcacattggattggtaacatc

SEQ ID NO: 508228 - DNA, 163 bp, Homo sapiens
ccatcaggtgcagaatgataggtcaggagtgaatatcactgggatacagatttcttacctgtacacagacttccaaggatgcttccaatcatcaagaatctctgatactaagaaaaatggcggagatctatgatgaggaataacgcgaaatttataatcatga

SEQ ID NO: 508229 - DNA, 307 bp, Homo sapiens
ccgaccttagcctcccaaattgctgggattacaggaatgcgccattgtgcctggctctcaattttgtttttctacaaacccgtatttgtccactctaataaagaactaggattggaggagaaatggacaagagaaacaggtagagggaggtacagaagggaacatccagcatgtgtgtagatatttgaagttatttatcttgagttaatccaaggcaaatcttcaattttggtattacaatttataaaatgcatctttctcctaaaagaaatgttcccctacttttctttgatgaggatcacttgag

SEQ ID NO: 508230 - DNA, 277 bp, Homo sapiens
tttaaaaaaaaaaaaaaacccccccctttttggggcccctaaaacaaacttttttggtttaacaaaattgggtttttttttgccctcccccccccccggtttttttaaaaaaccccccccctggggggaatttttccggcccaaaggggattccccccttagggttgggggttttttttttaaaaggttttttttccccccccaaaaaaggggtttaaccccccgggccccccctttttttaaaccccttttaaaaaaaaaaaggggccccttttta

SEQ ID NO: 508231 - DNA, 135 bp, Homo sapiens
attcgagctcggcacccaatttccagtgaaatatgttgaagattctcgacttggagaactcaccagcggcatgtaaaattaaatataaatatttaatatgccacgacgaaatttaattttccttccgacagcgga

SEQ ID NO: 508232 - DNA, 378 bp, Homo sapiens
caggacacagtcccccaaaacaatagcaattcaaaaaattggaacaaacaactgatataacagatgttcagatatcaatgtaaggacaaagaaaaaatgaaaagcaagaaaatatgacacctccaaaggaacaaaataatcctccagaaacagatcccaatcaaaaacaaagtcatgaaatctcagaaaaagaatttaaattattgattctaaagacactcagtgagatacaaggcattctgaaaaacaatataaaagaatcagaaaaataatgcaggacgtgaatgaaacttttacgaaggagatatatatcacaagaaaaagaaccaaacagaaattctggagatgaattaattgactgaactacaaaatacattt

SEQ ID NO: 508233 - DNA, 111 bp, Homo sapiens
tttcaatccttcagacttgacagtatgaggctggggttggcagtctgcttaacaagatgctgggacacctctgaattagtgaatcaggagccgctgtgtattccgcgctgt

SEQ ID NO: 508234 - DNA, 100 bp, Homo sapiens
ggagaccccagtttctcaagaattcagctctgctcttgagcgtcctcggagcctttggggatgcagccaacctggccctgcactcgggtgttggagagga

SEQ ID NO: 508235 - DNA, 400 bp, Homo sapiens
  misc_feature (24)..(24): n is a, c, g, or t
  misc_feature (33)..(33): n is a, c, g, or t
  misc_feature (121)..(121): n is a, c, g, or t
  misc_feature (214)..(214): n is a, c, g, or t
  misc_feature (348)..(348): n is a, c, g, or t
gcacaagtcctcgctgcccgaggnatccgcctnggcacggtgctgagaattcgcggcttggttcctcccaatgccagcaggttccatgtaaacctgctgtgcggggaggagcagggctcantcgccgccctgcatttcaacccccggctggacacgtcggaggtggtcttcaacagcaaggagcaaggctctgggcggccgcgagagccggccngcgccgttcctttccagcgcgggcagccttcgaggtgctcatcatcgcgtcagacgacggcttcaaggccgtggtttggggacgcccagtaccaccactttccgccaccgcctgccgctgggcgccgtgcttgngttggaaggtgggcggggacgttgcagctggactccgtgagattcttctgag

SEQ ID NO: 508236 - DNA, 627 bp, Homo sapiens
ttggcaatgtgttcaggtggaattttcacccaacctgcgccccccggtgtattaggaaattctgtgttttcccactcaagggagggtggtgcatcccaaccttcctttaaagccacggatgaactgtcctctctttttcaagtccccccttgtgggggggctgttaacccaggcaattaggtgatttcttttgggatggtggtgaataactggtgtgccttttttgtgcctgggccccccccccccaaaactttccttggtggagagtttttttcaatttaattaagccccccctagccccctttccccccgcatggggggtttcctcttttacagcctccccttagtccccttcccagttgttccctggggtcctgggtttgggatttgggcccccttttccccctttcccccccttttttccggatttttgccgggggggtgcaaaaaaccctctttggtttatggggtgtggccccccacccttttcccctgtgtgttttttgccggggtttttcttttctgcaaaaaccttctttttttttttggctggccggccccttggtttctggctgagggttttttttttcttttcccccccctttaagtgccgttcccccccggcca

SEQ ID NO: 508237 - DNA, 320 bp, Homo sapiens
  misc_feature (45)..(45): n is a, c, g, or t
  misc_feature (168)..(168): n is a, c, g, or t
  misc_feature (173)..(174): n is a, c, g, or t
  misc_feature (243)..(243): n is a, c, g, or t
ggccaggcgacgggtccaggtaagtcggcgggtcgggagcagggnaacgtcttgccactgtacacagggcacctcaaccttcagcaaccaccactgttgaaggcaacatccttcagcagcagaaggattgactctctggggggggggacatggggcctcactatgttncacannctggtctaaaactcctgagctccagggatctgcctgcctccgcttcccaaagtggtgggattgtaggcntgagccatcatgcctggcctgctgtgagttttaaataaaaatgtgaatgctgtggggggggtcttacctgtgctttt

SEQ ID NO: 508238 - DNA, 960 bp, Homo sapiens
  misc_feature (17)..(17): n is a, c, g, or t
aagtggggagcataatntggtgggggcgtgtaccgagtcaagtccttaaacgatgtgcagacctttgagcttatgtggcagaagtgcatggaatagtgcttgataaatccattaattgaatatgtggagagaggcctgttgaatgtatgtgaagtcattcaagaatgaacgtccttgggcctctcttaacggagattctatccagagaaaagagatcgattgcagcgcgcgggtatcagattgaaagttccttctcagggtgcctgaaagccatgacattctaaatgaaaagactgattgggaagcaaccactttaaggaagcgggagtgggtaactcatctgtaagaattgcttttgtgccactatttaaggaccacccatgtgacaacagattactttgtgaaaatgcgaatctttcctgcatggaattggacggatttctgaacagaaggaacctattctaaaaccgacttagacaccttcaaaagtgtaaaacctagctttagaaaccatcttcttagaacagagagactacaaaccaaacaaggcgacaatttatccaggacaatgtgctagaacactctacctgataatgaccccgtgaaatactactcttaagacgaaggtattgaccaggacgcccatattccaagaactttctgggtttgtacagagtggacaggcaatccttggaaggcaaccgttttccaattagtaacgtgttatgagactacggatcaatctaaaggagcggaaacgaaagttgacaatgttaggcttgaacccgatatccagtgactggatcagatgcacaagggcttcgggtcaaaccagatgcaaatcggttaaggtcacgtaacaagcggcttgtgctgtacatctccagaggacgttaaccgcgcatgaatcaacggccaacatcacgacgaatacttgaatagtgaatatataaggtattt

SEQ ID NO: 508239 - DNA, 932 bp, Homo sapiens
gaccttcgccggttatgcctcgctccggatgttcctgcgctcttggctctgctttgggctctttgcccctcgcctcgctgagccgttgagatatgcgcccctctcttttggtccttcctcgtgttggccgcgcatttcgacagtgccctcctttcgagtgactctctggggccccgcgctaaggtctgtttgcacacgtcgcctggcgtttcccccacggccgggggctcctaagagtatggcgccgtcctcgcgtgctgtgcacgcttagggccacccttgggtgggttgggcgctgctagggccccttctactggttgtggaccccgccactcaccccagtttattgccgcggggttggttgttccatgagatttgggggggcgattctccacacagagggtcgccccacgcgcctcccccgcagtcggcggacaagcttcttgggagcgggctctggtttttcatacagtcgcatgtcggatgctcagtgggtctgctgttgttattctagtgtgggcccccccccctgttgaggaccccccccctgcctcctcccgcagttctcgcgcagtatgctcccaccctcgtcggtcactctcggtaggggcctctcctcccacctccggccctccgcggccccagtagctttctggcggtcctccacgccagggggctatcccttgcgctagcatcttccgcctcctctgcccctctggacaggccgcgctagcttctatgggccgtgtaggtgcaggcgattggctctgcctctccacaaggggtgttggagccccgcggcacccccgcaccaggtgggcccccccccgtgtgctccccgctctgtcccccacgcgcgcttgtccattatctcttctcgtgaagcccacccccaatcaaaaaaagcaaactttgggaaccccgacatgaca

SEQ ID NO: 508240 - DNA, 346 bp, Homo sapiens
caggtagatctagaggtccccgcacgtagtcgtggaaggaagggagaagtttggagcagtctacctctgggatagtggctcttctgtgggcgagagtacgggacacaacaaagtcatcaacagcgtgtacatcaagcagagccggccataccggttggccacgggaagcgatgaaaactgcgcggcattctattgaggtacccccattcaagttcacgttcacagttggcgaccacagccgcttggtcaactgtgtgcgatactctcctgatgggaacagatttgccacagcccagtgctgacggccagatatacatctatgacgggaagactgggcagaaggtgt

SEQ ID NO: 508241 - DNA, 1001 bp, Homo sapiens
tacctgcaggctcagcgcagcttcaacgacccagcctggcccaacactggggccaacccctgctctctacctaacgcaactacacacacaatctagcctgggctgctggctgcgcgtgtgccctgtaactcccatgactactcagcgacggcctgacgcacacggcagcaactcggctctgcaacaccgcggacggccgacagcgtctgcacgtcgacgccccaacgactccgcgaccacctgccacctctcgagcccctggcgctgcaacagcctacgacagcacctccgccatcgtccacacagaacacacaacaaaacacacagagtgagagagagagagaacacacagagagacacacctcacagacgcggcgcgcgtctcacaccatacccacaataccgccacacgtggcggacaaatcgagcgcacagctacctcgtgcgcacgacacacgtacacacatgtgagcacactgtgaccacacactaccaaacgagcacgacacacgcgacagcgcagcacaccaacgtcgtcgcgcaaccgtgaccacgccgcaacctaaccacacacaacacacacccggcggacgcaaacagacaggagagaaaaactagtgaggagacgacactcacatagcaatcaagacgcgcacaacaaccccagcacacaacacaacctgagacagcacacccatccatcatcatcatacgccaacgaactcgtggccaacgctggtcagacgacaacaacccgtcaacccagaaacgacagacagactgtagctagcgaacgcccacatggtggggcgcacaacaaacaaccaacaacacctcagattcgcgacgcagaacagcaccctgccgccagacaggaaagcgtgaggcgggcgaacgacacgcaccgatacaaacaaggaacacagataggacaagcaaagagggcagtcggccccgaacactgacagggtagagcaggatacgacggagggcacgcaaaa

SEQ ID NO: 508242 - DNA, 938 bp, Homo sapiens
  misc_feature (82)..(82): n is a, c, g, or t
  misc_feature (169)..(169): n is a, c, g, or t
  misc_feature (175)..(175): n is a, c, g, or t
  misc_feature (223)..(223): n is a, c, g, or t
  misc_feature (228)..(228): n is a, c, g, or t
  misc_feature (230)..(230): n is a, c, g, or t
  misc_feature (265)..(265): n is a, c, g, or t
  misc_feature (276)..(276): n is a, c, g, or t
  misc_feature (293)..(293): n is a, c, g, or t
  misc_feature (296)..(296): n is a, c, g, or t
  misc_feature (300)..(300): n is a, c, g, or t
  misc_feature (302)..(302): n is a, c, g, or t
  misc_feature (308)..(308): n is a, c, g, or t
  misc_feature (312)..(312): n is a, c, g, or t
  misc_feature (319)..(320): n is a, c, g, or t
  misc_feature (322)..(322): n is a, c, g, or t
  misc_feature (324)..(324): n is a, c, g, or t
  misc_feature (337)..(337): n is a, c, g, or t
  misc_feature (353)..(353): n is a, c, g, or t
  misc_feature (356)..(356): n is a, c, g, or t
  misc_feature (361)..(361): n is a, c, g, or t
  misc_feature (364)..(366): n is a, c, g, or t
  misc_feature (383)..(383): n is a, c, g, or t
  misc_feature (409)..(409): n is a, c, g, or t
  misc_feature (453)..(454): n is a, c, g, or t
  misc_feature (493)..(493): n is a, c, g, or t
  misc_feature (517)..(517): n is a, c, g, or t
  misc_feature (535)..(535): n is a, c, g, or t
  misc_feature (540)..(540): n is a, c, g, or t
  misc_feature (732)..(732): n is a, c, g, or t
  misc_feature (752)..(752): n is a, c, g, or t
  misc_feature (783)..(783): n is a, c, g, or t
  misc_feature (851)..(851): n is a, c, g, or t
agtgaaagtgaaagatattatgatttgggccttgcttcctactgttcacattagtttagtttagaagattaagtataataanagaaggagaaaagaagaaatgaatataaatatactcagggtagccaaatcctctaattaaataaaggatgaaccaaagtagttgganagattnacatttatgtgggagcctaaacaaattatgttccctttaactgttctnggggngnggggggggggggtgggcaacatttatattagatgngagtgattttnttgagagattttttttngtntaanantatgcntggngatattnntntnttgtttatgaatngggttaagtgtaagancgntattnggnnngggtgttatttgggaangtgggtctcttctttgctttattgtnggtttagagggataattttggggcaacctcaatctatctttaannatcttcctgccttcaaatgcgcagggacccttataaggnaggggggagcgctttgagagcaanattcatcattcaccaggnatgtngaaccacaagtgaacaacaacaacaacaacaacaagattaaatcattcccaacaattcctatttgcttttccaaagcatgctatgtctaattctgcctttctatgcagacaggtgggagagggagcccatagagtatattaatgttaattaaattaacttcctttaaaagctaacaggatggcttagtgtgnatgaggatgaactgctgtgnatgacactagcagataatgaagtaaactttnaacccagattagtaacatgtactccagtaactgaccagctcagatagagacttctcatttactctggntcacatgtacaatattttaccttccaattaaatatagtgccaaaatctttcaaaatagatagagcataggcttcttagaaattcaaa

SEQ ID NO: 508243 - DNA, 168 bp, Homo sapiens
gccagtgtgcgtaacagtgaggtatgcctcaaataagcctttaaaactttataaactgaactagaccatacccatgcagtaatatttttcagtgctactaatgaaaaaaaatttaagccttgcactggaattccaatatggcagatttgttacttttacctttgccct

SEQ ID NO: 508244 - DNA, 464 bp, Homo sapiens
aggttggtacagagcgagactccgtctcaaaaaaaaaacaaaaaacaaaaaacaaactagccgcgtgtggtggcgcgtgcctgtaattccagctgctggcagagggtgaggcatgagaattccttgaacctgggaggcagaggctgcagtgagctgagatcgtgccactgcactctaacctgggcgacagagcaagatccatctcaaatgaaaagaaaaaaaaaaaaagacaaaaaagcattcccagtgttttatccaattccttgaaaatattcggccaacacacggtggttcacccttgtattcccagcttttgggaaggccgaggcaggcggtatcacgaaggtcaggagtttgagaccatccgggtctaccttagtgaacccccttctctgctgaaattacagaatttcccagggcttggtgttggttgcctgtagtctcagctatgggggcgcgtgagg

SEQ ID NO: 508245 - DNA, 605 bp, Homo sapiens
ctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgcctgcggagcaggctccaaccaggctggcgatggcggccacactgcaccgaggccagctgacccccggggcgacgctgcggggccagtggagcgctactgatggaggcgctaaatggcccggggctgctgctcactgggtccccttgagggcagctccttgtctcgctgggcttgccttgcttgagccactgcctgcctgcctggctgcctgtcgcccaatcgatcgagggttcccctgggcgattgtctgcccccgaaaggcgtgacagaagagtttggcagttgcaataccgtgaacaccttctatgtgcttgccccaaaggagatgctgcaacactgtttggtgctgaatggacacatctaaagaagatgcagaagttcttgtggactgccccagacaggtgatcttgaccagaataccatcgagaccatgcggaagccacgctg

SEQ ID NO: 508246 - DNA, 269 bp, Homo sapiens
  misc_feature (5)..(5): n is a, c, g, or t
  misc_feature (11)..(11): n is a, c, g, or t
  misc_feature (30)..(30): n is a, c, g, or t
  misc_feature (51)..(51): n is a, c, g, or t
  misc_feature (89)..(89): n is a, c, g, or t
  misc_feature (106)..(106): n is a, c, g, or t
  misc_feature (117)..(117): n is a, c, g, or t
  misc_feature (131)..(131): n is a, c, g, or t
  misc_feature (134)..(134): n is a, c, g, or t
  misc_feature (149)..(149): n is a, c, g, or t
  misc_feature (152)..(152): n is a, c, g, or t
  misc_feature (159)..(159): n is a, c, g, or t
  misc_feature (164)..(164): n is a, c, g, or t
  misc_feature (168)..(168): n is a, c, g, or t
  misc_feature (193)..(194): n is a, c, g, or t
  misc_feature (217)..(218): n is a, c, g, or t
  misc_feature (220)..(221): n is a, c, g, or t
  misc_feature (231)..(231): n is a, c, g, or t
  misc_feature (239)..(239): n is a, c, g, or t
  misc_feature (241)..(241): n is a, c, g, or t
ttttnactganattgtaaaatatccatctnaaagacatcaactattctaanaattgtgtacaggatattcctttagtggtggaattaanatgtacgaatacttgcnttttcaaaaanatgtattttctgtnaanagtttaaagattttngcnatatatnatggnaganaaatgtaatcgtaaatattaatttnntacctatattgtgcaatacttgnnannacggtataanagtatttncngtcagtgtcttacatgttaagagggact

SEQ ID NO: 508247 - DNA, 203 bp, Homo sapiens
agttatgatattaaagattatacatctatagtactgcctgtaatcctagcacttagagaggctgaggtgggcagatcacttgagctcaggagttagcggaccagcctgggcaacatggcgaaaccgtctctacaaaaatacaaaaattatctgagcatggtggcgcatgcctgtggtcccagctactcagggttctgaggtgg

SEQ ID NO: 508248 - DNA, 146 bp, Homo sapiens
cgatggtcgacacgccgcgatgaccgagtgagtacctgtattataaacagtaaagaatgagataacacgtgtgttcgccaggatggtctcgatttcctgcacctcatgatctgcctgcctcggcctcccaaagtgctgggattacc

SEQ ID NO: 508249 - DNA, 278 bp, Homo sapiens
tgtattgccgacgtggctttttacaattctgtgactcccactctcaggagaccattgcatcattggccgcacactggtggaccatgaaaaagcagatgacttgtggcaaaggtggaaatgaagaaagtacaaagacgggaaacgctggcaggtcgatttggcttgtggtgtaattgggatcgcccaataaacattcccttggatgtagtctggagggcccttagctcatctgttatcctgctaatgctgctataaatgtatcctgttggctggcgaca

SEQ ID NO: 508250 - DNA, 627 bp, Homo sapiens
tatttaagttacctccctctagtttaatgtgaaattagtaaaatcagggaggacgggacttatgcgggggtaggcaccagaaaaaaacttctatggatttaaatttaatatgaatactttaaagatcaacataccgatgtgaaatacaaagtgttaatatgtgaaaacctaggaagcatatttaaaagatattttagtgaaagaatatttgtgggtttaaacaagtgaaccatagtgaatatactgggtacagttataatttctccctcacgtgaggaccgtggtgaacatttctatatatattatatttacagtggtattattgtgaagaaaacattgggttagtgccaagtggcttgggtgataaaggtaactgggtgaagaactttctatgggtccttaatttttaaccaaagaattttcccataggttggaggcatttaaaggcaattaaaatcactaaaaagaaaaaaaaaaccacaaaaacaacacaaacaaacaaaacaacacaacaagggcgggccccgcccccccaaagagaaccacccacgcagcggggcccacaacccaacaagacgacgccagaccccaacatccagaagcacacagggggggccccaaaaaagg

SEQ ID NO: 508251 - DNA, 1085 bp, Homo sapiens
  misc_feature (929)..(929): n is a, c, g, or t
ttcctattcactccatcctaaaaaggtggcttttagttttgttttctgattttaaaactctgtaaattaggatctttatatccacaaattttaggtttgcatttgattttacacaatctgggggggggggtgagatggcgatatcacactttgttgggacaagagctacctcaaacacaaagaaaccccctcttgtgtcgctgaaaaataataaaaaaagaaacagaaacaatacataaaaaatcttccccagaaatatgtggggaatgtgggtttgaaaggtggttgcaaggtgtggttccagtggatgtgcctccctcctttccgagaaacagacctatagtttattctcaggggtggttcttctctccttaaaaactccctgtaagcttccttcagaaagcaaaaaggggttttacagagtcccgtgctacatctcggggttacttccatttttccttaattaaaaccccaatataattacttccccgacctataatctccatctcttggtttaccagacgggctccttaatacctcctcgttcaagaaaaatctctttagctcggtcttaacacacttttttttttctaaaattaacaaattgcaacccctgttatgtttgagaagaatttccacaacagtatagggggagaaagctaccaggactttagccacactcgggttgtgcatcatgattaaacccagtgtgggtttattggactgccacggggttggcgtccttttcaccactgagttgatttgccatttcgttaaagagtaatcaccccacatttagttgtccctttacacacaaattttcccgggataaaggaaattcgtggggcccacgaagtgtttccccagcaacaacacccccgtggggccacttaaaaactgtttgcggtcagaaccactaggagctcttnacgaagcacacttcacttatggttgagcaaagcgtctcgggatataggacggctgcccgttaactcaggaccctcttgatattttggtccaggataattgagacggaccggattgtgaccaaccttttccctatctgcgcgatgtcgcaatcaatt

SEQ ID NO: 508252 - DNA, 673 bp, Homo sapiens
  misc_feature (22)..(22): n is a, c, g, or t
  misc_feature (75)..(75): n is a, c, g, or t
  misc_feature (230)..(230): n is a, c, g, or t
  misc_feature (235)..(235): n is a, c, g, or t
  misc_feature (300)..(300): n is a, c, g, or t
  misc_feature (309)..(309): n is a, c, g, or t
  misc_feature (399)..(399): n is a, c, g, or t
  misc_feature (408)..(408): n is a, c, g, or t
  misc_feature (446)..(446): n is a, c, g, or t
  misc_feature (516)..(517): n is a, c, g, or t
  misc_feature (635)..(635): n is a, c, g, or t
gcagtgggggggcctccaatcnggggctcgccaagcctaaggggcaccccacaggcagcctagtccacacgtgcnaatcctgaggaggtcgggggccccccccccccagtcagcccaccgcctctcacgggggtccaggttgcggatcgccacccagtcccccccaggccgcatggccgaggtcctccaccgccgcccaaggggcctggtttccagagcccccaccaccnaagcncctcccccagtccacccagaagagaagcccctgccccagaggggggggggcgcagaacgggcccngggactacntgggggacaccccgcaggacccccccgtccccgcagtcttgccccccccgagtaacaggggaaacaggtgccccccagaggctccccggncccacaccncagagtggaagccaccagaacagccgccccccaatccncccacccctccccccccctccctcccatccacccccagcccccccccccacccctcccccccaacccccnncccagccaacagtggagaggggaggtccaccccggccaggttgcctgatggagctgccagcccccagggcaggtccacaaaacaaaacaactattggcaagctcagatagggagatanaccacaaaaattaggggtgcctttgtctacaaataact

SEQ ID NO: 508253 - DNA, 688 bp, Homo sapiens
gttggatgcggctattattgaggtcttcacttctagcgcttacatcaaggtgtgtggcaatggtgcagagccgtgtgagctcatgactgctactccatgacagttacccttgtagctaggggtccccatagagtgaatgacagttttgtggctgaaacctacacaaagaggaagaggaatgaggcaggaagacccgtacctaaccataccctctttggactgcagaaaaactgatggcaacatctcggggagtggctgcccaccaaagaggaccctgagaaagaaaagagcataacctgggaaatggactacatgggggcaagggacatggtgagcgggcaaagttgagatggtgttttccttgagtgaatgtctttcaaaactaacaacatactgtgtagttgtctaacatgctgatggaggaacactgctgggccctgaaatcctagctttgaatccattttttccctttaatatagtgagtagagggagaaaatgaccttatgttttcccccacgacacaagtcaccgtcattatggctttcatatcaagtatctgtttccctttgtcccaattatttgaccaaatttatgttcagaggttagacttgcaaacatcaaagcaccacaaatgtgtgtgacatctagtgacactgggttgaaaaatgcaatataatacataattcaa

SEQ ID NO: 508254 - DNA, 213 bp, Homo sapiens
gcgtcgacgaacagaatggaatggaatggaatggaacggaatggaatggaatgcaatggaatgggatcaacccgagtgcaggggaatggaatggaatggaatgcaatctaatggaatcaatcaacccgagtgcaatagaatgcagtggaatggaatggaatggaatggaaagtacccgaatggaatggaatgtaatggagtgtaagggaatta

SEQ ID NO: 508255 - DNA, 403 bp, Homo sapiens
  misc_feature (4)..(4): n is a, c, g, or t
  misc_feature (18)..(18): n is a, c, g, or t
  misc_feature (21)..(21): n is a, c, g, or t
  misc_feature (47)..(47): n is a, c, g, or t
  misc_feature (102)..(102): n is a, c, g, or t
  misc_feature (169)..(169): n is a, c, g, or t
  misc_feature (229)..(229): n is a, c, g, or t
taanagctactaactttnctnatctgtcctggattgattctaatttnccggtgaccctcttaaagtttagcactcaggactaaagacagtatcatgaatgangtctgataggactccttgttttggacactgtgcttctgtaatggtctccaaattcacaataattttnggcagtcttagcaagctgttgattcacagattcaagtctactaagatctttaattctttncttatgtactcctgttaagtttcatctggtgcttctaaaattgatttacttgcacatatccttaaatttcattttgttagatttaatgtgcactaccatttgttgagtcttatgtcccaagaattttacaaatattaccttttctcccctcttgcaatttgtgtagaaattgac

SEQ ID NO: 508256 - DNA, 212 bp, Homo sapiens
ttgtttgaatatcttgagtggcattgtagagccgagagaagtagagccgagagacaaggtagagctgagagacaaggtagagccgagagaaggtatagatgagagaaggtagatgggagggaatgtagaggtgagagagagggtagaggtgtgagagagtgtagaggctggagagagggtagaggcgagagacaaggtagaggtgagatgag

SEQ ID NO: 508257 - DNA, 893 bp, Homo sapiens
tccggcccagtgtacctgaaggcctttccgccccaggccacgctagcagacctaccacagaatggtggggatggtgagaccaagcccagtccaaggtcccgctgatggttcccggcctgagccccagtcgcccacgaaaccgcccctatcttccagcggaagacggtcgagcagtgcccctggaccgcccgagcagcgcccgcatggccaccacggaaagtcatctgacgagactcactcatgaatgcaccttgcgatttgcactcgtgatcgtgcaaggtagagggaacctcgcagcaaccaaactatttcgtggaaatgagtccacaatcgtacagactacagagtggaacagcaccctgagacatgaccgatacatgggtaaatgcatggctcaagaagtttgccttaattgaaacttgataaccacgtatcgccagttagccactggtctgcacctttttcccagtatgtgacgattgaaccgatacaagaacaactgcgcaggacctagttcagaccagttatctagcctcttgagaggaatgtctacggataagggaatccacaaagtgcagaccagaccccttatttttggccatggtcttaccattatgaattcaatatccccttgcacacacctttatcatcgcaaaggggaaattttcaatagggaggaaggtgccaacgcaccgagaacaccaattttaccttggggtttccgacgaacttaccaagagaacaagaggagatcgcaccaaacccacgggaaaagtagcaatacaaacggggcatggactgcaccaggggaaaaacccgtaagaccccatgcttccttaaaacactttcccagatgcacttgggaaaaggacgaaacacacatgggggccaag

SEQ ID NO: 508258 - DNA, 291 bp, Homo sapiens
  misc_feature (184)..(184): n is a, c, g, or t
gcacgagcaggaaggctctgacagagttaatgaattgggtctcagagggtaaagtccagtgtcatgaatacgtcactgaaggatttgagaaaatgcccgcagcatttatgggaatgttgaaaggagaaaatctggggaagaccatagtgaaagcatgaaaataaaaatggcccacggatcgtcnctggagggttagctttttaccattcagtgcaagtgtatactgtcctatgtaagatgtaacagcaatgcgtttgacctagctaataaaacatgtgtgtttttttttcc

SEQ ID NO: 508259 - DNA, 258 bp, Homo sapiens
tccatcagagacgcagtcccgaaatccgatggaataataaaagcattcctacacacacacctcattctgtcttaagatcaagaaactttccaagactcccgagaaagccccccagaccccagtccccagctaaagatgagatagagactgaatgcaacactcccacctgcagtcataatcccacacgtagcacggagctttaaatacatacaagcaccagaaaaaagcttagaacttggagctgcgtctgctgacgag

SEQ ID NO: 508260 - DNA, 93 bp, Homo sapiens
taagggcaggggtctcaaccttcggcttccccagctcaagcaattctcgtggcctcagcctcccaaggtagctggggataacagggggtgcac

SEQ ID NO: 508261 - DNA, 367 bp, Homo sapiens
ctgtccaaagatgcttaagctgaagacacttaagtatatttccaaggaaatagaaaatagattcttatctctaaggagcttacagtcaagccaagaaaatttggaaagtgtgtacggtgaaggggccaaagaaataaaggccaccaatcagcataaaaaagagaagccagaaagctgagagccagttacaggcatgacacaggaggcccagacaaaagggctttgatgaggaggcagcatcatttgctgcaggaagttctaagaaaatgagtcttctacaaagaaagtgattcttactagaaaaaaaaaaataactaggaatcaaggcatcttctcaaggaccaagcaaaatatatttttttctctc

SEQ ID NO: 508262 - DNA, 267 bp, Homo sapiens
  misc_feature (59)..(59): n is a, c, g, or t
  misc_feature (88)..(88): n is a, c, g, or t
  misc_feature (254)..(256): n is a, c, g, or t
  misc_feature (258)..(258): n is a, c, g, or t
gctcaggctatcccacttcaacattcccagaagttgcataaggaagcccaaaaacacgntctctggattttgctaagaagacattaantcattcattcactttttttttttttttttttggacataggttcttcttgttctgttctccaggctggattgcagtggcacaatcatagctcactgtaacttgaactcctgggctcaagcaatcctcccatctcagcctcatgaacagctgggactataggcacatnnnantatacccag

SEQ ID NO: 508263 - DNA, 113 bp, Homo sapiens
  misc_feature (90)..(90): n is a, c, g, or t
  misc_feature (98)..(98): n is a, c, g, or t
gtagattatacagaactaggcctacagaaactgaaggagtctggaaagcagcacagctttactctttctctgattattattataagtgtntcctcggnggattcctgtaacat

SEQ ID NO: 508264 - DNA, 144 bp, Homo sapiens
aggatcttagatgaggaacgtcactgggatgaggaattactgggatgaggaactgtcactgggattaggaacgtcacttggcaggtggtgtctctaaataagtggttgatgctagaaggtgattgtttttggtaaacagggcgg

SEQ ID NO: 508265 - DNA, 118 bp, Homo sapiens
ctctggcacgcggttgcttgcactggccgttcacgtgactcagccaaaggacggtggcttctgcgaagtgtgcaagaacgctggtgggatattgggatcgcctgggtaccggagctcg

SEQ ID NO: 508266 - DNA, 189 bp, Homo sapiens
ttatgtactgacccaccactgattaatacgtggggtggcagtgtattagtgtataatattcattcgagactcttctgagcttatcatggacagacttattgaccttgtccagctccagcagccttcttgtccactgctttgatgacagccaccgcaactgtctgtctcatatcacgaacagcaaagcga

SEQ ID NO: 508267 - DNA, 175 bp, Homo sapiens
gatccagtcggtctacatagagattatacactacttaaaaatatagtcataggttactaagatattgcttagcgttaagtttttaacggtaattttaatagcgttacgattttaacgagacaaatatgaacgcacttagaaagacgtagcatgaggaaagggaaaaggataaaag

SEQ ID NO: 508268 - DNA, 1010 bp, Homo sapiens
gagtctctcgaatgactctgtaagacccctggaattgaccacaaagatagatcgctgtgactccctcctaatgatgtctgcaatgtccgtgctgagtgcatctgccagtccaacttaggttcctgtttacttaggcgcttcatcttctccatgacccacgtaactctatattccaagctgaattaggcgctactagataaccaatgaggagatgcacgactatcgatggtctaccaactgagacgatctcgacgcatgtaacgcagccattgtcgtacggcaataggggagaagtcagtccgtattggtgagttcaaccgtcgagagatccttttatactcccttacagaccaggtgatttcctttcctgaagcacttttacaacactgttcctaggatcgtacgtctgagcgtaccaacaccacctatatgcgcactgggcaactgggccaccttatgtggcgcgatacggcaccgtctctagagtgcgtcataaacatcgattccatcgtactatgacgacgtacgagcatttgcgctcttagtgaacacggtacctgacgactgcaacggagggtcagtcctatctaaaatcggacttgttgccttacatctcgcttagcctcctaatagtaccgggcacttgtaaccgttcggattagtttcccacatacctaaagtgaccaaaagggcgaccccgctgtaccagtttcacctaccttttttcctactaagccggcgttcggtgcatcaaaatgtctcatttgcccactgccgtctcccattacggcgcttgctcaggaaagtttaactttattctaccagtgtacctgcacccaattattaatggcacctaatatccccatgaggcacgtggaccacatgtcgttgaatttgggtatcttgcctatgggcatttctgattgcctagtctgagtaagcgcccccacccctgtggccatcactctgagtagccgcaacgttggtacgcccactgtaccatgtaaata

SEQ ID NO: 508269 - DNA, 505 bp, Homo sapiens
gcatgcaggcatgacatcagacaatagggcaaaggcagcctccatcagatagttagaggcacgaatcggagcaatagtagtcaagcgacatcaggcaacatcatccatcagggcttgcatgtggggcaggggtcattacaaggggttcgctcagggtcatcaattgtcatgggtcgccctcaagcaggtctggtgcagcaatcagtgttcaatgtccattcacaggcagcagcaaggacagcagcacagtcaagccgagggcgtctttgcattgtgtcataagggtggcaaggtgcattttcatcggcacatgggcaaggtgcatcctcagggggtcggtttgcatcccgtttcgtgcacagcaataggcaggtggagtgctgctagggctgcaatcacatgcacagggccacgcatgacagtgcaaaggtaaagacatcgtgtgcagggtgggcatgtctcaatgagtcagcctcctcagatctcctcgggatctcctcaggag

SEQ ID NO: 508270 - DNA, 330 bp, Homo sapiens
ttttatttttttttccccctttttcccccccccccgcctggttaaccaaggatttttttggttggagggggttttcccttagggaaatccccccttgccccctgggccaaccccccgagctgtcctggttttttttttcccaacccccaaagtttgtcccccccctttgggtttgttggttccccggccccccttgggtccccccgggggttagtttttcccccggtttcccttcgcccgggccaaggggggccccccccccccttcctttttccgcccccccagggcccccctggggggccaagttcccccccgggtttttttttttta

SEQ ID NO: 508271 - DNA, 579 bp, Homo sapiens
tttcggagttggcatccgtgatgagcgaaatctggcactatggtccaaacagaggtattcccttgggtcagcagcactagagtgggtggtttggacaccttggtcaataaataagccagccttaaaatttgaatggacccggtggttataaaatatacccaagggagtgagttctggtttggccaagagctgcaatccacgggattccccagtgggttcctgggggaataaataccatattccagcatccggtgagccggcagcggcattattaatcagattatggtggggatgagcaatccagaaagtggaaacagccatacagtcagtagcaggcacaggaaggtaatttccaaacactttatctcgcatgggggtacacatggagtggttcctatcggggggcaggagagtacccggcttggtgaggagtcccagatggtggaacaaagtattcctcggttcaataccatcttccaaaaagaaacaatgacctagggtgtcaaacccaatggtgtcttttattagcaagccatttgtcccatgcacagggatgcaccttgagaagctgtgatgaat

SEQ ID NO: 508272 - DNA, 279 bp, Homo sapiens
  misc_feature (17)..(17): n is a, c, g, or t
  misc_feature (59)..(59): n is a, c, g, or t
  misc_feature (119)..(119): n is a, c, g, or t
  misc_feature (166)..(166): n is a, c, g, or t
  misc_feature (198)..(198): n is a, c, g, or t
  misc_feature (201)..(201): n is a, c, g, or t
  misc_feature (257)..(257): n is a, c, g, or t
tattttttgccaattgnattttttttccactgcgcctggcctgaagctattctttacanaagctcttagtttttgtttgtttgtttgtttttttcttttgcgacggactctctgtcgcnaaggctggagtgcagtggcctgatctcgggtcaatgcaacctctgcntcctgggttcgggcggttctcctgcttcagcntcnagggtagctgggattgcaggcgcctgccaccacgcccagctgatttttgtattttnagtagagatggcgtttcgcttt

SEQ ID NO: 508273 - DNA, 246 bp, Homo sapiens
  misc_feature (4)..(4): n is a, c, g, or t
  misc_feature (27)..(27): n is a, c, g, or t
  misc_feature (37)..(37): n is a, c, g, or t
  misc_feature (45)..(45): n is a, c, g, or t
tagngttcaggcctatggttacgaggncctgcggttngctgaaantcgccagtcgcagctcatgcagcatgtcatcatgtgcagcgagtgcagaaggatgacaaggacaagaaaaagaaatataactctgtcactaatgggaaagagagaaaacaaagggaccagatgctgccagcaaactgccactggtgactccctttccttttcttcttctcttctcttcttttcctccttcttttctttctc

SEQ ID NO: 508274 - DNA, 211 bp, Homo sapiens
tacgaagttcgagctttgtaccgcctgagatcctccctgatgtggatcatgacttgaatgcgctgccaagtatgtgaccggagaaggtgctggctgctgtctactaggctctgatgtgaccaccacatttacctggagggcaccttgctggaagcccaacatggtcaccccaggccagtgttggtgtcaagaagttttctcatgaggagat

SEQ ID NO: 508275 - DNA, 757 bp, Homo sapiens
gaggcgccggcgctgcgctgcaaatggggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccatctgaagcgcggccgcgtgcgcttcctggacaacttcagcagcgggcggcgcggtgcaaaccctcgtgccggaggcccttcctagcccgcggctacggggggttcctgttcctttgtatcggcgctcgctcttgcctttcccccttatgcccaccgtttcccaccccagactgtggttgtcccgttctgcggccttccgggccaagccctttccgggctgtggtgagcctggaggccgagggagaatgcacttccgggttggctgaggctctgaggagctaccaggaggctgcgcgtgcaggcaccttcctgcagtagagttcaccacttgggggggacctattgtggcattctgttggagggctgcgcgcccaaggattcaaattcgggttaaaggccctttttgggaatgttttaacctgggttggggtggtgtcaagatttctaagtggtctctggtctttgaaagtggttgaacaaaaggaatccaggcatttggggggccacttggggattacattggagattggtggcaaagtggttttccttgggtttaagatgggtccaaagctttataattcttaagtggta

SEQ ID NO: 508276 - DNA, 1717 bp, Homo sapiens
  misc_feature (1)..(1): n is a, c, g, or t
  misc_feature (190)..(190): n is a, c, g, or t
  misc_feature (447)..(447): n is a, c, g, or t
  misc_feature (731)..(731): n is a, c, g, or t
  misc_feature (1070)..(1070): n is a, c, g, or t
  misc_feature (1328)..(1328): n is a, c, g, or t
ngcgaacacaacgaaatcgccaaacgggcgttttgttttgttaccacctgcccccgcccccccagcgtgtatcctgttatatattagcccgggttccttctttacaaaggggtgtatacccagagcaggccaccctatggggggttgtgcgaccataatttctctcggcgcccaccccaagaaggcggangacagaaatatttgtcgtgtggggagattgtctctccctccctctccctgcggagggcgcaccaacagatgttgggaaaacatttcctacagacgggttataagaagaatgctctccgtgttgtgcccgaacaagtgaccgcccacaatttgtggtgaagagacctctgcttcgctcttgttctcgcccgtcgtcgcttctttttttaagaaagagaagaagaagggggtttgctcaacacgaagaggggaagcgcntccccactagctggctctgttcgtggaggaggcagcacacctagttggtgtctggccgccgccccgccccccaccacattataagaaatacttctcgtgggggggaggatgagacgcctccttcttcttttatcttgcgccgcggagattgtgttccccacccagggagaagagcccctccttttgtggaggagtcccaccccaccacctctgtgtggggggtgacaccaccacaaggagagtctacttcttgtcgtcgccacccccaccccgacgggggagancctcctctcctcgaggatgggaggaaattatttctcctccgacgaggaggggggggatgatgcgccgctctcggtcgctgtatataggttatgctcgtcgcgcgaccccctgctcttctgtgcttgttgagaggagggcgcttcttttttaagggccgccccccccccttctcttcgtggagtagtggagaattattctccaccacagagccccccctcttcttccaccacacaagggtagattaatataatagtgtgtgttgtcccccccccagggtgtgtttgttgtcctcttatcccgagacttgttttctctcaaccacacaccacttctgtggngaggagacactccccccccagcagagagaatactacactgtgggagatctcctctatatattgtcgcccgacgagacaacaccccccaactattttgttgtgtggagatattgttgtgaaagatgactcttgtccaacagatgtatagtagagatatattctgctctcagcagcgacacaccctctcctcactaggagagagtgtgggtataataatgtgagagagaccacccacagtggtgtccactgtgagtgtgngcacaaatctgtgaaagagatagacacacagagacacttgtgtgtacacacctgtgatgtctcacccagcagtctgtggcgataattctcacgggcgtgtgttatgacgtggacacccacaagagtgtctcatgtctctctaaagaggtggctatataggtccacacttgcggtattatcccaccgcccagccccccgtataggtgagccagaaagccccacatgtgttgccacaatgacgtcaccattgccacacagggtctcacaccccggattctcaccgggcccagcccaccaggccttactccccttggctaccccccccatttagaaatccattttaaaatagtcctgtggggaaaccctttccaaaccaaaccgggaggaga

SEQ ID NO: 508277 - DNA, 375 bp, Homo sapiens
tttcctggccagtgccttgctgttgatcgtcggcctcgcgattcgcctgggtgtgaacgagtcgccggagttcctcgaagacaaggctctggcggaaaaagcgcgagcgatcaagcagggccaagcccccgtgctggaagtgatgaagaccgcttggcgtccactgttgttgtgcattggcgccaatacgttgggaattccggcgtgtatttcaccaacaccttcatgattgcctacagcactcagcaacttaatctgccgcgctcgttgattctggaatgcctgttcttcgtcgccataattcagttctgcgttcagccgctggccgcctgggtggcggagaaggtcggcgctacacagtttctgtgcgccatg

SEQ ID NO: 508278 - DNA, 1051 bp, Homo sapiens
gggaaggtcctactacggactcctggatgaagttcgcaggccatcctttcaaggtgcttcctctcagggggaaacctctccttgcgatagtgcgtttcatatttcacacccgataacgagttctcttggctgttcaatgtgcaatactcatttaatttcccacgcgaagttatcataagcgccatgtgtgtttcccccccaacgtccatgtgtgaatccggcccacctcatcccggccttatgtccaaaatttacccttgctcgggcgcgatttcacgtgaggaatgtcctcttacttgccatgggacacccctaggcattatgcatgggaatatgtctcgtgggtagtttcgtttggcacaatgcgttaaaattggggttactctacacgcccccttgtgggcacttgtcacctaacccacatcttacggcaagcaagcgttttgcataagtatgcaacatgtctaagccgggtatgttctgtagcacagaactatcgtagccaaggccatttcgcactgactggcgcaatagcgcgaatctaaatctcgcctataatgccgaaagtttcaccttcgcggttctcgaccgccccaaatgcgaggtcttaggccgagattcgtttgacgtttgtaacttcgagagacagtgccttcgttcaaccttgttgttcctgttgatcatgcatgaactaacttgctcgactgtttcttcatttctcgttccttcaactagtgtcttcaacagggtctgtagtctagattcagaaatgtaacagttctacataatgatatagactcaccctgtgactgcgtgttatttacacgggcacagtagcaagtgtctcttgttttctgagatgaaacaatcggtattaatataaatgcgcttattaatcagcttttgtaatgacaggacaagaagatgtggcattagagtaggaaatatctttggaaatcgtgaaagatccacagtagtgaaatatttgggatcagaagccagaggtgtaaaagtggtcaatttcttggtttacggtcacttgtaatcggtt

SEQ ID NO: 508279 - DNA, 213 bp, Homo sapiens
cctggtcccacgtagaaccaggcacctctagcactcgcttgcttcatatctcgcggctctcacagaagacttcatttgaagagaggattgattctagtaagtagaagagaagaaaagtttggaggccatgggcctaaggtctgtgctctacatttatctaggaaagggacctgatagtctagggcggttggcggagggctaggagaaccggct

SEQ ID NO: 508280 - DNA, 192 bp, Homo sapiens
aatgcagcggactcggcactccgagaacttctcatgcttgcccaaggttgcgcaggcttgatatgcacacctagccgcagcccggtgcccaggttggatggggcaggtgaggatgtagcccatggtggaggggttccaacaatgaaactcaataggtcctttaggactttgcaaggaaggagttttccaaat

SEQ ID NO: 508281 - DNA, 261 bp, Homo sapiens
atcctaatagaggcaggtagaatagcatcttttctgcttttctgctaaggaacaaatgccagctaggcatagtggctcacgcctgtaatcccaacacttggggaggcagaggcgggcagatggctttgagctcaggagtttgagaccagcctgggcaaaatggcaacgcctgcttttttttttttttttttgggaaatcgggagttgggctcggcggcccagggtcgagattgcagggccaggatctccggcctcatatgt

SEQ ID NO: 508282 - DNA, 615 bp, Homo sapiens
tacgcctgtcaccctggtgcttgcaggaaggaggactgtggcatcctggacccatggtggggtgcggttggtgtgtcctggagcctcacagtccggcctcccgccctgctgcatccccatggatgccgctcccactcaggggaccgctacagtgcggtggctggccggggcctcaggcaccacatgcagtagccgcagccgcagcagcttggtccctcagcccggtcccgcagtcgcagcctgactcgcagccgcaggcatagccccagccccagccagagccgaaggccgaaggcgcaggccggcaggccatgatgccccttcggccaattcgacccggcaagaagacgaacgctgcaccacgggccggccggctgttccccttgcatgttggagccagaggaaaggcttgaaaaagagaccggaacccttgccggctggttcacacgaggaacatgggatgctgcccaaaaccccaaggcgttgacggccatccaggggcagaagcgctgaacacttgagggattgcagaaagggcgcctgaagcagcggcagatacaggggcgggattaaagcaagggcgggcacacggacacacgcttgattccagcagga

SEQ ID NO: 508283 - DNA, 238 bp, Homo sapiens
agtttagcgggctggctgaggagaggatccacttagaggtggatggatacctgagcgaagccagagccacaaaaggcattacagcgcatcttcccacattcgcagtgaattcatttccaaagaactgaaaaagaagcagcgctggatacatgccataccgagaggataatagaagttcagggtatgtgggaggacactagtaaagggtatagcatactgtcatagtccgcgtgtacgg

SEQ ID NO: 508284 - DNA, 291 bp, Homo sapiens
attctctacattaaaggacatactttctgagctgctgtgaataaatttggaatggtactgtatattttcatctaatggagaactagctgtactttgaataaggattgctgcactggacgactttagaacacccttcacaaattcgtcaacccggagccagaaccccccacggcctgaggcagattggcctggaccagacttggacgacctaggcccggcatcagcagggttcaaacggcaggccattggccaaggtccggtttttggggtttcaccttggtttctacctcc

SEQ ID NO: 508285 - DNA, 596 bp, Homo sapiens
ggggagaacatcatccccctgtttttcatgtgcacccccaaggtggatttccccaggaccaacttcagcatctccttgggcggatccagaaggccggcacggaggtggtcaaggctaaaaccggagcaggcttttccaccctttccatggggtatgccggggcccgctttgttttttcccttgtggatgcaatgaatggaaaggaaggggttgtggaatgttccttcgttaagtcccaggaaacggaatggacctacttttccccccccctgctgcttgggaaaaagggcatcgaaaaaaacctgggcatcggcaaagtttcctctttttaggagaaaatgtatttcggatgccatcccccagctgaaggcctccctcaaaaagggggaagattttgttaagacccttaaatgaaccccttttacggggggccccgttcccttaatttttgaaggcctcatgtccctgcaaaaccgttgcaaataaactttggtttttaatttgctttggggatgatttctgttttgacatcctcatcccctcccaattgggggggggtctgggggggcaccaataaaaaccgcccttttttttta

SEQ ID NO: 508286 - DNA, 150 bp, Homo sapiens
gagattagagaggactggtttatgtgtacacactttgtttaaaatatcactggactcttcttgccccaattgctcctagaacgtccctctgtcactccccttccgggccagcctagtccatctgcatcgccatgagcgtgcgcgttcggc

SEQ ID NO: 508287 - DNA, 106 bp, Homo sapiens
cgtctttgctttcagtgcctccagtgagaagcagggtttcctgttctgtccactcacgagtggactggctgagcttgctcttggagggaagatacttttattgtgt

SEQ ID NO: 508288 - DNA, 365 bp, Homo sapiens
attatgtaaatttgcatttcacctactgatttaatctgcttgaaggatttccttttacatttcttataataccagtgtgctagtgacaaatatttttagcttttgtatgtctgaaaaagtctttaatttgccttgctgcttgaataataatttaactgggcaaggattttgggtgatagttttcctcccgttttacttctaaggatattccttgtcttctgacttgcattgtttttcctgaaaaatctgctatcatccttttctttgtatataatgtcttccgtatatgtctttttctaatctctggtcacttgtaatgttttgctctttatctccggtttttatattgtgccgtggggtaggag

SEQ ID NO: 508289 - DNA, 311 bp, Homo sapiens
tccacaaaagccatctctctttattttccatccctgccgtccaaccagttggtgcaagctgaggataaggggttttggaaacggaaggcaaagcttctgggaacaaaccctccgtgaaaatggtctatgcaccctgctgaggctggttaaacttgaaaagcactgtgacaataacctctacagaacgtgaatgtgtcaaaagtgtcaagggtgcttcgtgctgatttccggccctcccgtgggggtgtcagttttccccatcagtccggtgcaagggtccggggactgtgcccaggggcagccggattctg

SEQ ID NO: 508290 - DNA, 568 bp, Homo sapiens
  misc_feature (455)..(455): n is a, c, g, or t
tcaacgctttatacttcaacagtaattaacaatttttaggggaagtacacaggtgtttaatagagatcctaacttggagttagagagattcaagcttttctacttctagatatgtgacaaggtcaggtaaggcaggtttcttggttgtcccctttggcactgtaaacagagttttcattcaccgtctgttggggtcttagcttcattcacgagtctcctgttacagctggtgcctgcctgaggtagggaagtcgatcttctaccccttgcacaatcattaagggagaaagctccaagtgtccattctttggtaagaatcatgagggaaaaaaaagggcttccgcacttctctctcagtattcctgcttttatttcattttttgaccttggtggaatccttttcatgtctgtttatcaaaagatactaaccttatccatcatttttcttcattttngtgatttcaatttggaggataaccacagaaattaccttctggtatacataaatctagaattaatatagtggcgtcattaccaaaagtcagaaaacttctaagtacagagaaga

SEQ ID NO: 508291 - DNA, 898 bp, Homo sapiens
  misc_feature (1)..(1): n is a, c, g, or t
  misc_feature (3)..(3): n is a, c, g, or t
nanatgataggagctgaggtggggagggcaaaagaaaggacagcataatttatgaatgatctgcgatgttcccatcttggtgttaaaactttctggaagttgtcctaccgctgcgtgaattggtgttggttaaagtatttcccggggtccaagtgtgctctcaacaactgtgagaaagttacccgaggagatatgagctcaccaaatggttcgaggtttaccagacgacgcgacaatgctagtacattaaacggttttccgctaacgaatttaggactaacgccgccgtcccctgaaattttgtcctcttccaaaggcctccttctgtaacccgcacatcaaatcattgtccccccccccccgtttgtattaatgcattgtctcccaagtcagaaagtgaatcaaacatctagtcttataattgccaaccacccaaaggtggaatgtcttccccccacacacccccagctgcgctcacaaacttttatgagagtccccacccctcctcttgaacattatcgcggttctctagaggagaaaacacaaaatttttccaccaccacttactatcagaaagaggttcttagatcctatttcaacctggagccccatctctgcaaaggccccgtgggtacatacaaaatattcttcattctgtccttttcgcagccaccaaaaggtccccagttatttctattatacatgccccccgtacaacaccagtggtggaatcactatgcggccccacaaagaattccccgtcaccttttatgtcgaccacacatcatccgcttctgaaatggcaccgtttgtgtcccttagacacgccacacacccaacgcatgtttgccccgtgccaaaacaaaaacaaaaacaaccctttttggaaaacaaaaca

SEQ ID NO: 508292 - DNA, 196 bp, Homo sapiens
catctgtgatggcttgaagaaacagtgtaaaccggccgtgtaaacaagagtagggcatttataagtagttgagaatggagaataggagtatgaccagacagaagatagtaggtgatgactagttttttggggctcggcctaagtggtggttcgggttggagtgctggttccagctggatgtgctggtttggggtgg

SEQ ID NO: 508293 - DNA, 838 bp, Homo sapiens
gtcacggaagaacgctcgacctctctatatgtaatctccctacaaatgtccttaataataacattcagagccatggaactaatcagatccaatgtctgcttcgaaaccgcacttatccccaccttgggtatgagtcaccccgatgaggccaaccagccagaacgccctgaagcgcaggcaccatatcggcctaattctacacccttagtaggctccgcttaccccgttacctgcattcgacattctgatattcaagactcacagacaccccttagggctgcagtaacacgattgctacataactacaactctcgaactgctccaatgaactatctaatagctccctgaggccaacgaacttaattatgactagtcttacacaaatagctgttagatagttaaagataccgtcttatacggatctcgcagttatgagctccctacaagcccatgtcgaagcccccatcgcatgggtcagaaaagtagcttgcggagagctatctcgtatagaaggactaggcgggtatgggataatacgcctcacactcataactcgatcccctgagagaagcacatagcctaccccttcctgtgtgactatcccgtatgaggcataattgataacagggctcgatctgcgtacgacaagatagacctaaaagcgctcatggataactcgtcaatcaggcagatagccctcgtagtgacagccatctcatgcagagccccctgaagcttaacgggcaagtcctgctcgataatcgccacgggcttcattcgcattacaatttgctaggagatcaatacgaagcccggaggggaaaaaccccctcagggc

SEQ ID NO: 508294 - DNA, 207 bp, Homo sapiens
aagccctgtctcatccgctacccaacagtctggacaccaccagctgggcatggaggggtcctggagtactcaaagtcctctcgctcacagcctctcagccctgcagcattgtggatgtggagtaccttcctgtgtatcacctcctcctcagggcagcgctaggggcctccctatgcctaagcccaatcttgctccgtttgattagta

SEQ ID NO: 508295 - DNA, 242 bp, Homo sapiens
ttaaaaactaatccttcccttttcccctttttttttgtaaaagagtttgattttgttttgagcctggaggaaaaggaacccagttaacttagatactgctgctggaatgggcgagacattgctgcaaaaaagtccagcttttttcaaacaaaaggtgtgagggggcctgcttggtatgcttacctgggcttgtgtaccccagtggtttttgtgtacttttttccataaaatatcaaagttga

SEQ ID NO: 508296 - DNA, 697 bp, Homo sapiens
  misc_feature (518)..(518): n is a, c, g, or t
gcagacccgccgccatgacgctgcgcgcggccgtcttcgatccttacggggtgctggcgctgccagcggtgttcggcgtcctcgtgccgcacggaggaggccctggcgctgcccagaggacttctgaatgatgctttccagaaagggggaccagaagggtgccactacccggcttatgaaaggagagtatcacacgtttcccagtggcataccgactcatgggaagaaaactgccgtgaagttgctccgtagtaccgcttaaagttctgcctccccaaggcctttctcgcatgaaagaacatctttgacaaggtcgtatttcagcctagaaagatcaactcgcctccatgctccaggtcagctctcatgctcaggaagaaaggattcacctactgccatcctcaccaacatcctggctggtgcgaccgtgctgagagagcatggcctggcccagctgactgtgtgagctgcaagatgcactttgacgttcctgatacgtagtcgtgtcaggtgggaantggtcaaaacctgcaacctcagatctacagagtttcgtgcgtggacatccctgaaggccagcgcccagtgaggtcgtttgtttcggctcacatcggggctaatctgaagccagccgtgacttgggaatggtcaccatcctggtcccaggagactgacacggcctgaaagaactggagaa

SEQ ID NO: 508297 - DNA, 759 bp, Homo sapiens
gaaaattttagtaatttaataaaaggatcatgtttatttaagaaactgacttctccagagtaattttgttaagcacatacatgtttattgaagtggactaatttctataatgcaaatcagagttaaatattaaagaatggtgtaagatacaagttgacataggaattacattacaatattaggaagaaacaaggacaaatttagacgcttgaatcctgaagagataaagctttacttgacgtttccgaaatggagagatgatgaaaagccactcattcagtcgtttcagaacgaaaaagacatgtcatctgagtaagagtagtgacatggagtgaaatgccctacaggggcctgtggacatctttaatttcgtgcgattatgtgaagatgaggtggacatctacagataatggagcatgaatgccgaagcattagtaaaaggaatccctaagttcttccacatagaattagaaacatgtgaacgtgcaagtaaacttcttgtgcaaattaccatgcatcagagagcttcccattgtgcatctagaccttgaattcatattgtattgatcaatgttctaagtttgtatgtatattgcgtgcatattcaccaataacagttaataattaatttatgtgttagtagttaatagtatgcagcctatccttcttccgttcatgtgcatcagtaaatgtgtcattttggtcatttctccaacagagagtgtcgagggtttgacccatgtagttcgttccttgata

SEQ ID NO: 508298 - DNA, 1468 bp, Homo sapiens
ctccgctgaatacgcccgcgcgtcgccgcgtcgtcgccgcccccgtccggccccctgggttcctcagccagccctgtccagcccggttccgggaggatgaagttcgtgtaccagaagagcatccgttcgagaagcgcctgttctgagggcgagacagatccgaatgaaatacccggacctgggtgccggtgatagtcacgaaaatggctcccaatgctcggatagtgagactggactataagagataccgtggtgccttctgatctcacagattggtcagtactacttcttgatccggtgaagcgaattcgtctccgagcctgaggattgccattgtattccttattgtccgaactaatgtcagttccacaccatacaggtgctcactaatgggatcacgtcttgtaacctattgaagcactcaattgacagaaggactatcatttactcgtaccattgccttaccagttgatcggagaagggtgtcatacgagttctgctgaaagccttgcatgcgcacctggagcatgtgagggagggtcctcgattcttactaaatgagacgagggtggagccgccacgtattactttgaggctctctcctcccaatcaaggctcgagacaactcaaacgtccgcattaaatttcaagtgaacccctgtggaacattttcttttaagactggtttagcggtagcggcgtttgtacattcgttcgccattgacacttactccgattagaagaacgcagagtgatacagctcagtatcgcgacggatattgcggcacattcgtatgtttaaaagttcagtacactatttatccgtccctgtactacttatccgcccgtatattatccatgcacactgtccatattccccgaaatatccgttgacttagttaagaaccatatccttatggacgattaggatcctaccggttaccttagtgtggattaatagtatttcgcaagtttgtgacatattgcaacatagtgggtaactagcgtgggatgacccccgttatacttgaatcattggacctcataaaggaggggctatacaagagataactcacctaaaagaaagatcacgtatataccattattctagcgtaagcccatatctatatatattaaatggtgggtacggcattaggttcaagtgaaatagtggtgagcttgacagacgttagtggttggcagtgacggaaaaggtggaatagaagtaggggagcagaagatcgaaagttttaaagtaagtggtatagaacgcagagcatctagggctgtgtgaataaacgaagatatagataagctatagaagaatggaacaacgaataatagtgtgtaggagccagtcgaggatacagtatatagtactcgatatatgtaaggtatgcagaatatatgttatagctgtttataacaaggactgattcttgattagcgaatgtagtgttggtgcaca

SEQ ID NO: 508299 - DNA, 155 bp, Homo sapiens
agcggggaacaatcacttccagaacagtcgttaacagaaaatagtattcttgctcagtttgcaggtgaagacccagtggtagcttgggaagctgttggcagtttgaagacacccgggaatccatgcacgcatttggtgtgggccagtattgggag

SEQ ID NO: 508300 - DNA, 147 bp, Homo sapiens
agctcttgcccttattggtgctacatttctagaccggggagacagacagcaggcaaatcattaatagatactatgtgccagatagtgataaatgccatgaaaaccataaatgagagacgttcacctggagcaaagatactttacgtg

SEQ ID NO: 508301 - DNA, 168 bp, Homo sapiens
gaatatcagcgatgacgtggtggtatgcaagctggggtctcgagaggctcgaggtaggctgagagtggaggatcccaggagcccaggagttcgaggctgcaagggagctatgatcacatgactgcattcctgtctgggcaacagagtgagaccctgtgtctttattct

SEQ ID NO: 508302 - DNA, 1147 bp, Homo sapiens
gaaacgaatgcatcagatcatcagaatgaaccccaggttaggcctgaaagacctgcaggttctagatgtaatgagctatgcacgtcttattttcaaagagcatcgttagacttatgagagttcatttacgcagcacagaagggcggatgcgatgctgacgctcatcatgcggatacatggattgacccatctgcaatggattttgtcacctctgctgtaaacctcaggatgcatattttcagtatgaattattaagcagtagatttgatatcgagtcaaatggctgggaacgattattcctgcttattgcctacatatctatactgctaggtaattgctggcgttgatcagttattggaagtgcattgaaatcattatctacagagaaacctggaaccagtagccgatgatgatgacgaagatctactgcagttcgacaccaacggtgtgaataaggaacgtttcgtgtggctttcgtatagatagcactagagatcaactccacaaaaaccaccacagctgattatcgttcatcgtagactcgatccaccgtcagacaagtgtcgagacgctgctggcctccgagattttacctattaagtctatacttggttgggtctacgctttcgctgagggatcacagtatcatgtgcacaaatcacattgacttcatgcttgaatgctcaagaacgagccaagcatgaacgcgagaagttgaacacgcaatgcgaggaaacgcggcaacttgaaatcccgtaatatcacttgtcactccgtacagccacgagtgcagcaagagcgagcattaggcatacaatatacttccaaggcagaattgaacaggtttaggtcagaacggacactttggtttgggacgccattgtcaaggcactagactagcggcgaaaagggaaggttcctttatgccagcacgtctctggacatgcgacactctgggtacagcttcaacgaaagaggtacttacagttaacataatcatttctgtgggaataccacacacaaattacgccattgtccactctttagccgtcgacaaacgcaccctttcagtctgaaggcttggcatctggccaaagaccattagcagaagaaagtttaggatcgcgacatgcgttgaggacaccag

SEQ ID NO: 508303 - DNA, 476 bp, Homo sapiens
ggatatctgataccagtttgagctcttagctattgtgtgttcagatatgttaaagccacttatcgtagtctattttgtgtcacactggagttttttacaacctcaggtgagtttaacgctttattaggggacgggggtagatctacaaacactctattacgctcggcttctattgcacttgcggttaatcgtcgtgaccgcggatggctgtgcacgcagattgaccaacccctggaggttacagtataggcttagtataacactttcgatttatgtgctaacaggttaatcactgactgtttcccagtgggagatgtggctagagctcaagcgttttgcagctagcattgcgtgcgtgctatgatgcttgtcccttattgatcgtggtgatttagagggtgaactcactggaacggggatgcttgcatgtgtaatcttactaagagctaatagaaaggccagaaccacaaatatcg

SEQ ID NO: 508304 - DNA, 134 bp, Homo sapiens
gtggattgctccttgacgacgccagcatgagctccttctccaccaccaccgtggagcttcctccttatactggcaattccaggctcctaggtcaagaccagagctaatcccatgtacaatggcgtgtccaacgg

SEQ ID NO: 508305 - DNA, 853 bp, Homo sapiens
gaagctccttggccctcctaaagctgaagccaaagcgatggctttacaaggccaagaaggcagctgttgataaggtgtccacagtcaccaacatagaagaatatccgctactgtcatccaccttccggcggacgaagtacactgcgactccggacgacagtccaaatatcctcggaatgagcagctcccaggagaaacaagcttgaccactatgctatcatcaaggtttccgctgaccactgagtctgccatgaagaagatagaatgacaacagacacagcttgtgtgcactagtggcatgttaatagccaacaagtcaccacgatttaacacacggctgtgaccgaaggctgtatgacattcgatgtggccaaaggatcatccacccatgattcggcctgactggagagaagtaaggcagtatgttcgactggctcctgataacgatgcttgtggagtgattgccaacgaaaattgggagtcatctaaagctgagtccagctgcctaattgctgaatagtctagtatcatatatatcctggtcaacaacagtatagcatgcgctgctcgtgtcgacattaccgtggtcaagggctagggagagccacaatacacgagacccttgaccattgacaggccctttgggacaagaactccttgactctagtttatacctatatgaaatacgcctcgaccacttgcacagcatccagccatgttattgcatcagttccaatcacgaatctacagaagaactacaagcttccgaggtccatagggaaaaaaccaggacaatccagcaactaggacataccagggggaggaagcacatccaggcatggtgggagtacac

SEQ ID NO: 508306 - DNA, 352 bp, Homo sapiens
ccgtacgactggagagcagatcttttccgcgtctcaggtctgaaggatttctaggaaaattaacatatgccaaggcccccatgtggggaagggaggggtttctgggtaattgtctctttttttcttctttcttgagacagggtctcgctgtgtcgcccaggctgaagtgcaatggtgtgatcatagctcactgtagcctcgacctccagggctcagcctcccaagtagctgggtctacaggcgcgcaccaccacgcctggctagtttttaaatttcttgtagagatgggtcttgctgtgttgcccaggctggtctttaacgtctaggctcaagctcaagctcttgccttgcc

SEQ ID NO: 508307 - DNA, 204 bp, Homo sapiens
  misc_feature (171)..(171): n is a, c, g, or t
gcctagcacttccatgcacagctctgcttttctgtcagctcacaatgctgctcagcgcacagcagtacaggcgagcattatctgcacaacttacactgccaaacttctcaagctactaattatactgtggctcctgctctcaacctggaatggtccaacgcaacctgtggnctatcaaccaagaccaggtttacttcacttcct

SEQ ID NO: 508308 - DNA, 108 bp, Homo sapiens
  misc_feature (18)..(18): n is a, c, g, or t
tggcagctatcgggttanttttgttggtttagaatcccaccattcctggctccctgtcctccaatgtagacatatcacctctggctttgcagaagaaacctgagcttg

SEQ ID NO: 508309 - DNA, 306 bp, Homo sapiens
  misc_feature (21)..(21): n is a, c, g, or t
  misc_feature (158)..(159): n is a, c, g, or t
cgtagccgcgcaccggggganaaaaaataggcaatgagaggttctgtcttttgagaagatgggggaaattagaatgaagaagtgagtaactttactcatgttagtaacttactgctaaagatgacatatcaggaactgcaaggagagccaacagtggnncaactgcaccgtacttaataaccaagtctcggaacactgagccatcacctgaaaaaaaaggcaagattaattctatttttttttgtttagtgagacggagtttttctttgtcgcccagcttggagtgcaggggcgcgatctcgtttc

SEQ ID NO: 508310 - DNA, 916 bp, Homo sapiens
gctgcagcccccctcgccctgagccagagcaccccgggtcctgccagaccctcacactcccagcaaaatgggcaaggagaagacccacatcaacatcgtggtcatctggccacgtggactcctggaaagtccaccaccacgggccacctcatctacaaatgctggaggtatttgacaaaacggaccattgagaacgttctgaagaatggaggccggctgaggatggggaacggtgatccttcaagtatgcctgtgggtgctggacaagctgaatgtgcggaagctgtgagcgcggcatcaccatccgacatctccctctggaagttcgagaccaccaagtactaacatcaccatcatcgatgcccccgtgcaccgcgactacatcaacgaacatgatcacggtgtacatcccaagtgcggacttgctgcaacgtgctgatcgtggctggcgggcgtgggcgagtacgaggcgggcatctccaagaatgggcatgacgcgggagcatgccctgctggcctacactgctgggtgtgaaacgcatgctcatcgtgcgctgtgaacaacatggactccacagacgcctggcctacagcgagaacgcgctacgacagaagatcgtcacaggagagtcacgcgccctacatccagaaagaatcggctacaaacccagggccagcctgttgaccatattgtagccccatctccggcttgcacactggttgacaaacaattgctagaagccctcacacaaaatgccgtggttcacagggctgcaaaggtcgatcctctacagatggcaagccaagcgcggtgtactgctgcagcctgaagcaatactgacccaatgcccaaggacaaccccagaccacgcaaaagccttacacactgcgatgcaccaccatcccgacgcaacaa

SEQ ID NO: 508311 - DNA, 111 bp, Homo sapiens
gagatccctcccaagatgagaaactgcccaaggatgagaatatagccgcctcaagccacctccgtattactgtttctgacttcacggatcccccaattcctcatccttggg

SEQ ID NO: 508312 - DNA, 413 bp, Homo sapiens
  misc_feature (11)..(11): n is a, c, g, or t
  misc_feature (302)..(302): n is a, c, g, or t
gcggtcgccgngcgtacccttgcaccgagagtcgcgtttttggccgcgatttgcgtgccgtagcagttttgcgcccgcttctttttacagtatgcatatcgctatggatatccatattgatattgcaatcatattcattggcattttaatatgcgtatggtgtcgattgcgatatcgacattttgcagcgagggctgtatccatcgccgcctgtataggagcgcatcatgccagcaatctcagtggccaatcccaagggcggtgcggcaagaccacgttgacgctggtgctccgccagcganttggccggaggcgcccgcgggtcacccgtgaatcgacgccgaacccaatgcgattcatcgccggctggggcgcaagcgccaatgagcagggcaaggccttgcgtttcgaca

SEQ ID NO: 508313 - DNA, 659 bp, Homo sapiens
tgctcagagcagtgtaggccgcgccacctgcgtggcctggcctggagcgggcagccccagtgccccctccccgtgtgcaccctgtgttcatgcaacgcctggtgtgcctggtgacccagcatgtctccccctgccgcctgccgcctgccatgccatttaaatccatggcaagtggccaatctatctactactgaagtgccggactcgctatgtgcttgctgcgtaccggcaggccacggccgtgccgacaccgagtaaggcaccccctggcagagaccatcacccagaggcactgacgcaccacacccgcaccgggcgagactcgggtccgaagcgacgtcacgagaggagccaaacaggacgcagcccgcgcagcatcacgaacagtttcgcgctcaacaggatagccctttgggaaggacccaatctgcggccgccagccccctcccgggcgctcactagggtaggcacccgggctagttcggggcacacactggcgcagcaccccaatctcctcgaagggaccgccaatcgctacgcaagctgccacataacacccacccataaaccactgctctaatctcgtcatcataataaatcggcgcacgaccgaaaataactaagcacctcaactgctatcgaagatagctaggccaagt

SEQ ID NO: 508314 - DNA, 165 bp, Homo sapiens
acccgagtcgtgaatggcatatgctgcctgtgaagaccagcggataaagcccctgacacacagtaggtcctcagtatccatgggccattcaacgccacgggccattcaacgcctccgggccattcaacgcctccgggccattcaacgcctccgggccattcaacg

SEQ ID NO: 508315 - DNA, 411 bp, Homo sapiens
tatttcaacgtgctctatgaccgcgatgcccagggtggcgagttgttccacgtctacacggagccgttcggtgaccgctttttcttcgagatcctgcaacgtaagaagggttatgtcggctatggcgcggccaaagtagcggtgcgactggccgcgatggccaagtcccgtagaggtgccgcgcgccaggccaggctctgaatgagacttccttccgggagacgctcagcccataatcgggcgactccaacgcggtcgtgagcccagaatgacgaatttcgccgatgccggtgcacctcaacccctcgaagcacggcacaaaggccgaaaaaacagcccggaacaaacccgcaaggacatcctccaggcagccattgtcgagtttgtcagcctgggtttgtccggtgcgcg

SEQ ID NO: 508316 - DNA, 184 bp, Homo sapiens
ggtgggaggggagcgcttggatgtctactatgttgagcacctctgcaatgttcttttttctttttttgacagaatttcactctttttgcccaggctggagtgcaacggcgcgatcctggctcaccgcaacctccgcctcccaggttcaagcgactctcctgcctcagcctcccgagtagctggg

SEQ ID NO: 508317 - DNA, 354 bp, Homo sapiens
agagttccagcgatctcattacagtctctattcctatccgtacaactctccaatgtcattgtattgcaacatgcatctcgaccagtaatatctctgcgtaattactagtccccacaatctcagtgatcattttcacaagacttatacccacagtaatcctgccaatggtattcaaattccagacttggaaataccgtggcctttatgtgacccatttgagatttacattgaaactccagtggtttataccatgccccagttgcgcatagccggaggttgtgaacgctcgaatgcacacggccgaatctagctccgtgtgttcccgtattgtctttagcgcacaaggcatatact

SEQ ID NO: 508318 - DNA, 637 bp, Homo sapiens
agggaattaaaaaaaggtttgttgagcggggccattaatgggaggaagtttggaaatcctgggtctgaaagccactaaagtacaaaggcaagtgaaagaaatgaaaagccccactgaacaaaggtatcaatattggggcatgatatggttagaagaagaatttttcaaatcacttgaacaaaagtgaaatgcagagcaaaagggccaccagcaggattaaattacattgggaataaaatcatgtggccaattgtcatagccacagatgcgagagaataccacactcatgccaggtgtagcagacaacaccattgtctgtattagccgtgtagaggccgctgtagtatgcgccattcaggtatgcagagtgacacctgttaaacaaccagccagcctgatctatttgtgggcagtgcccctcatagtagcagggaaatgtgagcacggagatgaatttcatcacttggagaaagcacaccacaagggtaataggaagaaaattccacgcaagggaatcttcacgcgctcacacaatctctctctatcactctctcgcactaactctctctatctcactctctctctctctctctctgtctctctctctaactacatcccctggtgcggaatcctgcag

SEQ ID NO: 508319 - DNA, 519 bp, Homo sapiens
  misc_feature (66)..(66): n is a, c, g, or t
  misc_feature (72)..(72): n is a, c, g, or t
  misc_feature (353)..(353): n is a, c, g, or t
attcgcggccgcgtcgaccttgaggatcgccgactcggtgcgatcatccccatccttggcgcggcnttcgcntgggcgatccagatcgactggcagtcattgcgaatcgaatggttgatgtacgccgacagcagttgataagccgccatcttctctttgcgcccggtaatcgagcggtgcacgatgaaactcttgttcaggcgcatcaggtcgctgacaaacggcttttgcagcaggttgtcaccgatggcgatacgtggcgtgggcaggccggcgtggtacacgcgtagttgacgaaggccgggtccatcacgatgtcgcggtggttggccaggaacaggtaggcgctgcgnacttgaactgctcgacgccggtataagtcaccccgtcggtcgcgcgctcgatggtgtggtcgacgtaaaactcgacttttgtcctgtagcgtggccacggtggtgaccccggcgaactcacggcgcagtttatgggcgatcattggcttgagccgccaacccgaag

SEQ ID NO: 508320 - DNA, 436 bp, Homo sapiens
tacgaatcgagctggtaccgaacgggtgatgcggtggtagagtgcggcatattcatatcacaagctaggagggttttgtgtccgggattcaagggcgcaggcttgacgcgtgtagcaccgatttctttcatgttgtgggttctgggagcccagagggcagccatagtgtgccgactccgtggaggaagtaaagaaacagacccgcttcttgccgcagccccaccagcctaaggtgttcaggaaggccggacgcgcctcctctgtcctcgccgtcacaccggaccatgtcatgtcctgcttgtcacgtccaccggacctggcgtcttggccttcggcagctggtgggcacgtccaccccagctggagacctggcctcgtctccagcccgaacgctgaggcaccgatcccggctccgtcgccaaccgcatcacccgtt

SEQ ID NO: 508321 - DNA, 188 bp, Homo sapiens
  misc_feature (17)..(17): n is a, c, g, or t
  misc_feature (31)..(31): n is a, c, g, or t
ccccgtctcctacaaancaaccaaaaccaanaaaaaaattagccaggcctggtagtgcatgccccgtagttctacgtactcaggaggctaaggtgggaggattgcttgagtccaggatgtcgaggctatagtgagccataatcatgccaccgcacttcagcctgggcaacagagtgaggccttgtctt

SEQ ID NO: 508322 - DNA, 426 bp, Homo sapiens
ggctgtgttatgatttaccgcccagtgggcctcttccagtgcgtggaccgcagcacccatcctgactgtgccttaagagatcgcggcagccgctactcaaagaaagcccccaggtctttatacagaacaaggggcgggtcttatcattcccctctctctggtgctggcttccaggactcgactgtgactggaaactgtgttgctctggccctcctcctgccctgcagcctccccttgcagtcatcgttcgtgttctgtgtatcccagatgattctgttatctaaagacgctttttgctgggaaaacggtgtcctgcggtggtatttcaatgcggcatgtgttcaggatttcgggcgcaagggattagttctatttcgcgggttgaaaatgctgcgttgggattggggcaagttattttcttgtttg

SEQ ID NO: 508323 - DNA, 261 bp, Homo sapiens
gtcggactttttgttttgttttttacgacaggccactgatctacaaaaattttaaaatgagccgggcgcggtgactcacgcctgtaatcccagcactttgggaggccaaagcaggcggatcatgaggtcaggagatcaagaccatcctggctaacacggtgaaacccgtctctactaaaaatacaaaaaattagccgggtgtggtggcgggcacctgtagtcccagctactcgggaggctgaggcaggagaatggcgtgaa

SEQ ID NO: 508324 - DNA, 265 bp, Homo sapiens
tggagaacataagcaattttattcagactacagtatttcctttaacactatatggttgtcaaaacaccattcccagtttctttgcttttgacagctgagtctttcttaaatatacccaaatcggaactctttacactaaatagtaaacccgagataggagcaagtgccttccggggtggtgtaaaaaaagcattataaaaattggacaaatctatcacttctctgtgttatcatggggttgggggtgggggagagcaaggtaatg

SEQ ID NO: 508325 - DNA, 187 bp, Homo sapiens
ctatcggcccgggtaggtacagctgaagggcttgactgcacacacacagggtgacctgcctgaagctcaccacaatgtacctgctttaagactgagagatgctgggtgggcatagtgggtcacgtttgttatccctacacttttgggaggctgaggtgggtggatcgcttaaagtcaggagttcctg

SEQ ID NO: 508326 - DNA, 294 bp, Homo sapiens
ctgcagtccgactctacagtgatccccaatgcagcggactctgctacataccctacatagccagaaagtagagtgggggccactattcaagcattcttgagagtaaatagaattttcaacccagaatttcatatcctgtcaaactaagcttcattacttaaggagaaataacaatactttgatatacaggttaatgctgagatatattgtcaccacccggcctgcccttaaatatctcctcaaggacgtgctagacatggaaaggaacaaccggtgccgagtccgttgcatttc

SEQ ID NO: 508327 - DNA, 191 bp, Homo sapiens
cttaactgcaccttgtgaatggtagtataggtcttcatacagttcaggctctagaaggtgacaaatcagccaattggattcgaaacaaagaagactatagtaaaactcacccatcacacttaggagactactcactggattggaagtaatatagtattagcagctaaatcctgatatgaaagcagagatgt

SEQ ID NO: 508328 - DNA, 455 bp, Homo sapiens
tcacgcccacagactgacgagtatgacctgccacccaatcaggcctgtcagggtaggggatgtcacttgtgtgagtgcttgtccctggcttaaattctcttccaatgtgttaaagattagggagttatggaaagagaggtagtggagagaccgtgcttaaaaaaaaaaaaaaaaagtcttctaaaatacaaatgaaatatatctttgcctctatagctacgacctttaaattttttattctgaacgtggggctcttatgatcatgatgctgtaggaccgaacggttctgtgtctctgatctttgtccttggtgctgtgccttgagagaagctggatggatacagcggtcttccctgggcgtcaggacgtgaacctggctcctgcatctgatctctacctttctgtataagtctcatgtctcttaagagactttggcctgtatagatggctgactg

SEQ ID NO: 508329 - DNA, 156 bp, Homo sapiens
cccgcccgaggtagacatgagtgaccgggcatctccaacatgctggatgtcaacggcctctttaccttatcccatatcacacaacttgtcctagccataacacgctaacaatggtgccaccgaacatcggagaacttgaggatttggagtcttact

SEQ ID NO: 508330 - DNA, 166 bp, Homo sapiens
cgagcagtagcccagacaatctcatatgaagtcagcctagccagcattctacgatcaacattagtaataagtggctcctgtaacctctccacccttatcacaacgcaagaacagctctgattactcctgccatcatgacccttggacataatatgatttatctcca

SEQ ID NO: 508331 - DNA, 201 bp, Homo sapiens
gaaggatcaaggacggatgatgaggtagtacagagagaggaggaggctattacagtttggatggattaaatgacatacacacataggagaccttagagagatgtcggaaaagtttgccttccatgccgaaggttaaccagagtgatgaaccttatcatcaacttcattgtataaaaataatgagattttcctaagagacct

SEQ ID NO: 508332 - DNA, 196 bp, Homo sapiens
ggacagatgttttgaattgtagcaatcgatatttccaaactatttggagaagtgaaagcacgtgatagagtatagtattaagtaggtctcaatatcgatgtatgtcactagacatcctagagtcgaaactagcagtggatagatcgcatgtagctctgttattcagtctgtggcactcatatttcacagaagattg

SEQ ID NO: 508333 - DNA, 410 bp, Homo sapiens
cttctgcctcccactcacctccacccgttcatgcaactgtagttttcttagcccctgaaaccgggttgggctgccgcaggggccatcaggctgtgagggacggtgacgcggacaacagagcaagactccgtctcaaaaaaaaaaaaaaaaagttttcttcagattgtcaaattctgacttgaaacagttatcataagctgagcctggtggttcacacctgtaatcccagcactttgggagactgaggtgggagaatcgcttgggtccagtagcgagaccttgtctcaaaaacaaatcaaacaaacaaaacacaaaaacacaaccacaaaaagcaaacaacacccccctaaaacccaaagaaaaagaaatggtaactacctgggtgacagagcaatactccatctcgaaga

SEQ ID NO: 508334 - DNA, 548 bp, Homo sapiens
  misc_feature (165)..(165): n is a, c, g, or t
  misc_feature (548)..(548): n is a, c, g, or t
ttaccgacaagactgtgaaactttcgggatggtggtgaaaatgctgattgaaaaagatccttcattagaaaagtctatacagtttgcattgaggcagaatttacatgaaataggtgagcggtagagtgaagaactcaagcatttcattgcagagtatgatacttncactcaagattttggagagcctttgtagatttttctgctcaggctaaaaaaaataaaaacagtttctataaattttttttcctggattgtgtaaatccttaatatatggaagtttttgcgatgcatagaaatactttttgatagtctgaaacatttgagtatataataaccatctaaaataccccgtttaaaatgtctgattcgaatttttgaattttgttgagaaagggggttcaccatgttggccagtctattttctaacatcctggcctgaagagaacctgcctgcctgagcctttcatagcggtgagattaaaggcaggagccaccccggcccatctgtccctctgggttatacctttcggaacgagattaactaaatn

SEQ ID NO: 508335 - DNA, 246 bp, Homo sapiens
agcccgggcttggtttcgggcatccctcctattacgtcgccagatacaaccagataagcatcattaaggaaagaccagagggtcaccaggttaagagccagtgctacaacactccacaagcgagaggcggagacgggtgagagaaagagagagaaagagggagagggcgagagagagaggagacagagcgagacagagagagagagagagaacgagagagagactctcactgggtaaagaccgtcg

SEQ ID NO: 508336 - DNA, 697 bp, Homo sapiens
tactctcataaccctcaacacccagctccctcttagccaatattgtgcccattgccaggtactagtctttgccgcctgcgaagcagcggtgggcctagccctactagatctccaatcgtccaacacatatggcctagactacgtacataacctaaaccatactccagatgcttaaagaagctaatcgtcccaacaattatattactaccagctgacatgactttccaaaaaacacataatgtgaatcaacacaaccacccacagcctaattattagcatcatccctctactagttttttaaccaaatcaacaacagacctatttgggctgttccccgaagcttttcctccgaccccgctaacaacccctcactcctaatactaagctacctgacgtcctacccctcgacaatcatggcaagccagggccacttatccggtgaaccactatcacgatagaatagaaagagtacttacgcgaaaaggtctgtggggccggactagaccctaagaggaagccattatagcaccccatctggggggcggcgcccatggataaagggacacagtggccacaaagggcccccaaggaacgtggtcaaagcagcgggtttcccaacaagaaaaaccccggggccagagcgttcggacacgcagaggggttggagcgcaggacaagaacgggcccagacgcatta

SEQ ID NO: 508337 - DNA, 304 bp, Homo sapiens
gccaaggccaaaaagtttttttcccctttccttaaaattttagttccaaaagaaaagaaaggggcccctggaccataaaaaccccccgggggacgggaacccccccaattttttttccgggttgggtaaaccccccgggccccagtaaaatttcgaaggcgtaaaaaaaggggggttttccccttttgggccccccccccaaagggaactaatttaaacccttcattttttggcccggggacagcaatttttggtttgggaatttaaaaaaactgggctttgtccagtatttttacataaaagg

SEQ ID NO: 508338 - DNA, 1373 bp, Homo sapiens
  misc_feature (1207)..(1207): n is a, c, g, or t
  misc_feature (1218)..(1218): n is a, c, g, or t
  misc_feature (1235)..(1235): n is a, c, g, or t
  misc_feature (1243)..(1243): n is a, c, g, or t
  misc_feature (1255)..(1255): n is a, c, g, or t
cttgtgttagtctatagtatttacaaatccgtgtcctacctgcttcttggatgttttctaccccgtgtgtcgggagggagatccttactactcaaatgacgacgccgtggtgagcacatctcaagagtttttcctttgtgcactttatgtgaatccctttatggggtcatacgagagagtcctattctttcacaagatgttgctttgtgcagaacacccactttggtgattcaacaaccgcggtgggcgcctccgggttctcaaataaccaagggggattatctcgaaaggctgtcgacaacatgtcgtgttctcaaccacggaaggttttacagtgcccctttcttctctcctatatggagtacttcgggaatatctcctgccaaagggtcccacgcgcccttcgacgggcaaagacgggttgtttataaacgggggcctttgtccgtgattttcttccccccaccttggggaggccacctgctcttgggaatgacacgcccaaaaggagtttttgtcaaacccgggtttcaaaagggctgttgttgtttccccccagaaggcaactgggaatggaccccttgggggttcccccacggggcgtttcaaccttggaaattctccccactttgagaggaatttttctcaacacaacaccggtttctacatgagagcctcgtagttttgagagcccaggttgggagaaaaaacacgaacccttctcgtgggccccgaaacctagcttggcgctccccctctgcacaagagccccgagggcacccctccccgaactgacaccctctcgtgggtgtcttaaacaccgacggctagctacacacactccgggggtaacctcgcacaggcgccgagagaggcacaagttttctttcgggagcacctcttcattccgagttggttggagcggcagctcttctcacaaggagatttttttgcccacccacaggaaggtgggagagcccactatgtggccacacagagagagaggcggagccacacataccacacatatcacttgcgctggcccacaggccctccacgggtggtgccacacccacggtgggaggaaacactggagccccggcgagagggcggcacccacccacaaccgcaacatattttccccgagagggctcccgagagcccaaggtttaccttttttaccggcctggacactacgatatccttnacaaatagggntgggtccagcccgctgntgccctgntgcccccctttnccaggcgctaaacatgtacaaaggtttttttgtggttgtaaatggtcctatttcaccccctttttcctgtcacatgaccccccccccatgttttattaaaagggggggctggtggtga

SEQ ID NO: 508339 - DNA, 854 bp, Homo sapiens
tttggccgcaaccagttttatttaattgcaaataaattgtttttaagtaagtaatcggtttttatgacataaattttgtgttttcgggtgggaggtcttaaaccatcaacatttgaattacctagttcgctgggcatgggcccagaagtttgccttttagcaagcatctagttggtaacttcgcacactaaatgggcaagaagcccaatatgggtctctgaatgggaagggttatttttttcttgggggggggcttttttctgaaccaaaaccagtatcttttattttctgcaggatataattttcttaaaacaaatggtgtatttgtgaatctacattgtagaattcccctaatgtgatcctattgtaccaaagagggtggaattaaggaacggaaaagggaatactcggcttggaataagatgataggaaatgcccaggtggggatgttggtgtcccttgtctgtggggaacggaaccgtgaaagagtagggtgtcggagctctcttccaggagccctgcgtgggggaaggggtgatatattgaaggttggctggcggggtgttgcgaggcgagtacttcgcgaagcctaatacggtgggggtgccgttttcttgggcggggcacgagagggcacaaacgggcccactcagaacaatgcttattttttttgccgaacgtggaggatgcggagtgggggccgcgtggcaataaggagtggcgagccgcgtgataaacggaaaagaacgtgagggtgatgtgcgtgtgccgtgtcgcgggaactatttggtgcggggggcgcgccggcgctaggaagaccactcaatgagaaggtgcgctggcctgtaggcggg

SEQ ID NO: 508340 - DNA, 872 bp, Homo sapiens
ggacaggaacatgagcttatcgagagcatgcccctgtcggaatggtccgctaccgactataagaaatttgggagctacggtggaaatacgtcacagatatatcactagaagggtctcagtttgtgaaacggatttgatcggaattgggggtatcttgcggttacctgagtaagaatttccaggacatcgcgattaccatggacggaccgacagatgatatttttggaccttgatcgactactagagtagtcagtacatgggtccggcaaagacagtgcctcgacctttccagtatccgaatccaaggaagcatacccgattgggggtagagtccgacaaaatgattcgctgctcgttacaaggtggcacattgtccagaacttacatccactgatgcagtgggtttttgataaggaaatacgaataaaaagctatgacccaggaccgtaccaacttggcgtttgtcatgtgtggtcagccgcgagaactttaaaactaaagtgccataaaagcctattgttggactactgtaggccagactcccagattgctttagctttactgtatggtgaactaggtcgctcttgatatttcattgcaacatagcatgtgctttgtaaccttcatacgtttgaaggcaaccatagcttttaacttgttgtaaccctttcatatgttgaataggacgcgacatccgactggggaatcatatgttggtggggaccgataaattgccgacattcggccctggccagttacttggcattgtcaggctaagtgggtagagactgttttgggcaccgtggccctttcttggggcccgcaaggtgaaaggggcgaaaggggtaattattccgtccaccgccccaagg

SEQ ID NO: 508341 - DNA, 358 bp, Homo sapiens
ggaagggacccatgacagcattagatttgaccaattcaccacattgcaggtgggttcctcctggactgtaaaaacaagtgaactttgcatgaggaaagaggctccatgtctcacagccagctatgcccacattgcacttgcttttgcaaaataatcattccctgcctagcacttctcttctggccatggactaagtacagtggcactgtttgaggaccagtgttccggggctctgtgtcccttatttctctggacttttcatttaagctcaagcccaaatctgggggctagttagaacttcctcacctagttagaactctacccatctttaatacttgaatgtttgacccacttttac

SEQ ID NO: 508342 - DNA, 565 bp, Homo sapiens
  misc_feature (1)..(1): n is a, c, g, or t
  misc_feature (23)..(23): n is a, c, g, or t
  misc_feature (41)..(41): n is a, c, g, or t
  misc_feature (64)..(64): n is a, c, g, or t
  misc_feature (81)..(83): n is a, c, g, or t
  misc_feature (90)..(90): n is a, c, g, or t
  misc_feature (99)..(99): n is a, c, g, or t
  misc_feature (108)..(108): n is a, c, g, or t
  misc_feature (115)..(115): n is a, c, g, or t
  misc_feature (128)..(128): n is a, c, g, or t
  misc_feature (139)..(139): n is a, c, g, or t
  misc_feature (144)..(144): n is a, c, g, or t
  misc_feature (208)..(208): n is a, c, g, or t
  misc_feature (216)..(216): n is a, c, g, or t
  misc_feature (225)..(226): n is a, c, g, or t
  misc_feature (228)..(229): n is a, c, g, or t
  misc_feature (535)..(535): n is a, c, g, or t
  misc_feature (542)..(542): n is a, c, g, or t
  misc_feature (556)..(556): n is a, c, g, or t
nctcgggccgatctcgctttatnttttttaagccagtagancaatcccaaaaatagtggggatnattttttgtgtgcaggnnngggaaanaggagtaancaagaactnaaaattnaagacgaaggtanagcaacagggngtgtncattatacatattggttttgaaaatggccacatcacaccaggaaaatcaatacttcatattgcngtatcagncaatagganncnnacctacataatgtattaactatttattgccacatggcaatataccccaaaacctcacaacataaaaccacaaatatttattatctcacaatctgtgtggttcaaaaattttagtgcagcttaactgggtgcctctggctaaggactctcaaaggttgcagtcaaactgtcagcaggggctgtggtctcatctgaatgctcaacttgggagtctgtttccaagctcactcatgtggttgttgacagcccttgatcttgtgccacatgtgtctctccacatagctgcctccacaatagctgttagcgntggtagntaagagagtcagtnacgcatgac

SEQ ID NO: 508343 - DNA, 201 bp, Homo sapiens
ggcaggcctatcctcctgtgcttacacagtgcagcacttggatatgccattgagcttttctgagtttccattctctcgtctataaaatagaaattttagaaaatttgctccacctacctcacacagctattgtgagaaatcaatgagatgaggggatttgaaattgtctgaaattggcagccacagctgatggagaaatct

SEQ ID NO: 508344 - DNA, 922 bp, Homo sapiens
gctctgtacatcgctgagatatagtttctgggagtagctccttgatacttcagtattgctggagtcggcatccaggcccgcgggtactcgatgttctgatactgcagtatgacatatgatagtcgctgtggggtagctccaccaagggtcaagagtatgtcatctaacattgagatgtattgcaaatggtagagcatggttataagcaagggtgcaagtcatcaagatggtctgaattctagataaatcattgctgttgtggtggcgatgagaaaaggagcgcaaagcaggaggttgaagttgaatcaaggatacagggttcgtccatggttggacaaatcgatgattggagttgttcttgcagggtttgcgggagaattaatgggtgattgttgagagtgtcatgtaattggtatgctttcacgtgaggagttagggcgttgccgaggaatatggtttgtgcgataagagcagagtgtactggtgtatcccgtcttttgtatgttattgctgtaggaacgcaagtgaccaattagtagggaaatacaaatcagagtatgggcgggaggacctatatgggtggtgacgagtgtagtgtgcggggaatgaggtgatgataggggctctcaagatttttccagagcgtgtgcttggtcgtttagatatttttaattgggagaatgcgtggtcatttgttggcagtcttcaaatcaggtacggaggtactttggatagcatttggtggggttcaggggggtatttaatgagatatgtggaactggtctgggcttgaaggggatgtcttggacgaaagggggataaaaaaggggccgattggggaacttggggtaaccatgggcggcttttcccattgggagagggaaaaccgtgaggctggtgtatgtatagaaggggcactatg

SEQ ID NO: 508345 - DNA, 369 bp, Homo sapiens
tgagtgtatcgccggtgcaagtggtgagcgacttcgagcaacgtttgcgtggtaacagtggcgtcgagatctaatgcggcgctgtaatatctgtaggtgtcctgggacctagagcggcggcgtgtctctggtgatgttcgagagcgggaccttcttcgatttactgtagatgtgccagatcgagatctccttcgggtgaccggagatgttctggatattgatcttatgcgagtgataggcgaagttctgcttcgagatcgcctcctggttactggtggagtcctggatctggaccttctgcgagtcactggtggagttctagaacgggagcggcggcgtgttgttggcgtcctagaccttgaacgacgg

SEQ ID NO: 508346 - DNA, 433 bp, Homo sapiens
gtcatactgagaaacaggtattaccttcagagtgggaaaaccctcgacggcacattttacacagtagaactgtgtgccatgcactccggagtagcatacatctagttggttatcctagaagctcacgtcgtgtggctgggcagcacgatgagcgagccggttgccagcccgggtcagccggacaccaaagcctctgggtgccgcagaagctgctagccagcggagtccaaagtcagctccatagaagatggagcccccgactcagtggcgtcctctgcctgactactgtgttcacttctataataatctccactccctgggagcctggggagctagagaggccaagctggttcgataaggacctgccatttggacaggacggggacgctaacaacgatccagagtcactggctgcgtcctacatgcagggccc

SEQ ID NO: 508347 - DNA, 994 bp, Homo sapiens
  misc_feature (130)..(130): n is a, c, g, or t
gaatcggaggccgtacctgagctgggagagcgcgtggtacgcgtgtagagcgtgctggagactctgggctctggaggcgtcagcctgctaatggtaactagtgtctcctcgtcatcggccccacgcttgngtatgcgaccccagcggaacgacgtctcgcgtctcgagtgtgccgtgcgatggcgctaggattcgactgattgtcgcgcatgctcgtccggtcgcgcggtcgatccttagtaatttcatagctaatcttgatgtaatgtgtcctggtatctgtactagggtgttccctatgcgggatggccttggggattgcgggttgatcccactgtgagtcgtagcaccgaatgggagactaatgcgagccagctgagtcttccggcgccttattctcctcgacatgataatcctgaagaagcggaaatgcctgagcctgtgccgaatatcggggttaagcactcgctgggacatcagcccttaactaatagtgttccctgtttgcctcgccactcaggcgtggggggcatagtgaccaaccggctgaccatctcttcgcatctctccggtagagcccccctaaacccaagaatcgtggttgcgtggattaacccctgtttggctgcaaggttagctcttactgcacgctggacaggcattccccgttagtgactgctaggacacaaggggcagtgtcatctatcacaaacaaggccggcttgttatgccaaggcaccgtcctcaagcgtcatgcaccaacatccgcggttggtgcgggccaacctggtagtgctgccagcggtgttcccctgttcccaatcgccccttcctagaggaagcgggggtccccattgggcatgtgtggctgggaccccccatggcttgtcagcaggtgtaccctggtgagtgggcctccccaattttgtgggcccgcgcggttctgtccccgtcggggccaggggccctttagttttgcccctgggggcctgca

SEQ ID NO: 508348 - DNA, 468 bp, Homo sapiens
gacacgagtatgttcattagacgcgctgatatctgggagaaaagctggcttcgctggtcacgaagcatgagtatcgtccgactccctgaaagcttcctggtttggaaacactcaccaaatcatctgctgtcacagtgctgcccgttattttgtcagtggccaccagcatccttcccagacgtgccttcatgtctgcgaggatgtccgtcaggggcagcaccgccatgatctcgctggccagtgcgatgtaaaactgcgcctgccgtgtaatggcccattctctgtgtaaaccccgcccgatggttattttgcgtagaaatcggacatttgtatccaatacatctctgcccatgtgaatggtcgatgggtcgaggtcgagacgggcaaatatactcacttcgctcttctgtcagtgtgctcggatcagtcttattcattcccagtaaaataagccgatgaaatcaatgg

SEQ ID NO: 508349 - DNA, 233 bp, Homo sapiens
gctgcttgacatatttgtgatatggtacctggacaggcccatgtgtgttgagagcttctcagactatccacctttggatcgcatcgctgttcgtgatatgagacagacagttgcggtgggtgtcatcaaagcagtggacaagaaggctgctggagctggcaaggtcaccaagtctgcccagcaagctcagaaggctaacatgcactattcatccctacatcactgcccaccca

SEQ ID NO: 508350 - DNA, 918 bp, Homo sapiens
  misc_feature (1)..(2): n is a, c, g, or t
nntcccctggtgtggtttataacagagcctcttttggcgtgcccccatctgttgctcgtgggcacgccacaccaccgcgtgggttggcctcctccctaagcgtaccacgggggctgtatctcccttccggggcgttttttctcttgctccgcggggggggctataactgtttttccaccggcgaccgccgtttgttgccgcattgctcccctcttgttgggggcgcccacgttgagacaccggtggtgtgccaccaaacaccgctggtgggtgcgccggctgcgcggatcttcccgcgctgatttgtgtggcacccctgcgtggtcacaccaccggcgtcgtctgccgggtaatttttgtggtgccttgttgctgccctgtgagcgaggcacagtactgacaccttgttttttctgcaacgcgacctcctcttggggggggcccgcccaccgcttctatttaccgctcggcgcgcgcaccaccctctgtataaccaccctcccctcccctccgtccggcgcgcgcgcggagagttgtttctcctgttgtcgcgcgacacaactcttattttcggtgtcgtcccctcgcacacgacatttgggggggcgtcctcctcccctgttgtatgtcgccattccgcttctctgtttgcgctgaatagtcacccctcctgctgctcgataagtccccccccaccgaacgctgaattttgtttcgcccccagatgcgcctcatcacctttgttgtgtggctttttcgccgccgcgacacctcctcttttttctagcatcgatgggggggacccaccccggtggctaccccttttcccccctttccaaaccccccttttttttccccccccccttttttttttccccctttttccccttttttaccaaaaaatccaaggggccctca

SEQ ID NO: 508351 - DNA, 434 bp, Homo sapiens
agcggtgcgtgcaatagttcctccaggcccgaagctggtttaatctatacaccctatgagtacccctacacattggcaccagcacatccccctttcgcattgatgatcggagggagtatcttttcctattggctttgaccttacggagaggacacaggagctccacagtaggcgagtcttaagagaacgccatccctcagtgtcttaaatctggctatatgctcttgctactgagcttaaactgctctggcagttaaaaaggccagcgtgtttagccctaggaaggtgcaagaagcgctgccacattggccaattatttgctaaaatagccctagtcccagtgccaaataactagataattcacaaacgggggcagtggggactggtcttacccttggttcctccacatgaatgaattgagagccccgatatcg

SEQ ID NO: 508352 - DNA, 948 bp, Homo sapiens
gggcgcggtggctcacgcttgtaatcccagcacttggggaggccgaggcgggcggatcacgaggtcatgagatcgagaccatcctggctaacacggtgaaaccccgtctctactaaaaaaaatacaaaaaaaaattagccgggcgtgatggcgggcgcctgtagtcccagctactcaggaggctgaggcaggagaatggcgtgaacccgggaggcggaggttgcagtgagccgagatcgcaccatgtgcactccagtctgggcaacagagtgagattccgtctcaaaaaaaaaaagaaagggaaaaaaaatagcattatacctcttcctgtgtctcaaccgccatgaaaatttctggaacactccaaattcagttggaataatccaaaacaaaatttataagtttaaaataatttacttcttatagtaatagtatactttaaaaagcctcaggggtatattatcttctaaacaggctacaattcagggcagctactttaaccaactatggtctctagtggagaacaactaggcctatttcacgtgctgtgtaagcctcaaggtgcctaacatggggtgcccaaataattatccgtagaaattacacctgaatggtaaaaaccatctcggtgttgggtgttacaattgggccacaaattctccaaaagggcccgggtatctatggtaactgccttggaacattattcacttcaacttggggtttcctcacgattaatgggagcggcagcgggttgttgacctttgagtacattaagttaccccaagtatttgttaaagaagcgttcaaagtatgtgggacttgggattttaccacaagaatccgttccccttttcttacaggtttaattttttgccaaacacactggggtaatctcctaaatgaggtaaaatcttcagggcttctgaaacacagggttccaacattatg

SEQ ID NO: 508353 - DNA, 1055 bp, Homo sapiens
ggagtcctcggtgtcgagtggccggcagtcatctcgcggccgttcagacattataaggctgtctgcagagcatttgaaaacatgtgcaacaagatgcacacagtgtcagcatcttatagttcatgctatccttggctgtggcacatatgtcagcattcacttattacctgagaatcctctgcaagaaccatttaaaaatgcttggaactatatgttgaatacattatacaaagttccagattgcaacatggggatcccttatagttcatgaagccctttatctccttattctgttacctggatatgattacaatttatacctgtatatgaacaaaatacaaaattcaaaaggataagccagagacatgggaaaaccaatggacgtgtacaaagttcttctctttaatcacttctgtatccagctgccttcgcttcgtggaacctattattttacagagtcatctcactataccttatgatagggaaagaatgccaagatggcatcgcctactggacaagatgcttggcttgtgcaggccattgacgatacttggcactataactggctagaactctcacagcacgacagactatacgaggactatcctcaacgctcatcatgacgtaaccaaggctcaatatggcaactcgacagcttgactatgcacaatccttgggagaaactcaactctcgcaactggaattacaatagacatccggacaaatgacgagacaatgtcacacacacacagggaaatgataccaatcgacatatcacacagcttgcttccaccggccacacaatccctacaccctcaacataaaccacacaaaccgacatgcacaaaatcacccaacgcacacctcagcacatcgacacactacaacgccacaacatccacaccccaccaaccaacacgagacagccacaaccaactcacaccatcaaaaataccaaacacaaacatgaacactaacgaacaacaacatctccatctttacccttctcctctatcctccaccccccaccccatccctacccgaccccccacccc

SEQ ID NO: 508354 - DNA, 303 bp, Homo sapiens
tcttgtaaataaaaataaacttcttcctgattttgagtccagataaatttctcccatatcacttcatttcaagtagacagttagaaattataaaccatgagcgctagtcacagtggctcacacctgtaatcccaacactttggaagagcaaggcaggcagatcgctcaaactcctggcctcaggtgatcctcttgtctcagcctcccaaagtgctgcgattacaggcatgagcacttgtttccttccctgccttattagcagcaggggatagtactcaggaccagagataagctgatacctta

SEQ ID NO: 508355 - DNA, 342 bp, Homo sapiens
  misc_feature (3)..(3): n is a, c, g, or t
gcnaggaagggattctccatgttgcccaggctgtcctcgaacttttgggctcaagtgatctgcctgtctcagcctgcgggatttaggcatgagcggattacagccatgagccaccgcgcctggcctgaggctaactgaaatgtttgccaaagatttgttggaactggtattttgaaatgaaagcatcttatactgtgtttagaacatactagatggtccatagttggaagctgctatcacaatattactactgttatagcaaattcagagattcacactgaatttggttcccacaattctgcattactttgaatagttggtaaaagacctatcaaaagacga

SEQ ID NO: 508356 - DNA, 111 bp, Homo sapiens
tgctatcaagacagatacatccttataacaatggaatgccacaggcactccacgcccttggggttgctcttttcctccggcatcgggacgtcctgggattgggctatcact

SEQ ID NO: 508357 - DNA, 338 bp, Homo sapiens
gagatgtcactatgttgcccaggctggtttccaactcctgagctcaagtaatcctcccaccttggcctcccaaactgctagggttacaggcgtgagctgccacacctggctgattgtttttctttttctcttttattttattattatttttttttagagaaaaggtcttactctgttgcccaggctggagcacatcagtgcagtcccagctcgttgcatcctcaacctactgggctcaagcaatcctcccacctcagcttcctgagcagctgggaccacaggtgcacaccaccatgcccggctgattttttacttttttgatagagacagggtctcac

SEQ ID NO: 508358 - DNA, 135 bp, Homo sapiens
tggtgtgtgtcggctcatgcatagtgcgtcagcagcaatgtttatggtgaaaaatggcaacgggaccgcgtgcattatggcaaactcctctgctgaattctcaatcttaaatttgttgagcagcacctaccagga

SEQ ID NO: 508359 - DNA, 186 bp, Homo sapiens
ctgatggtcttgccgcttgtgtcttcccgaagctagggcatcccacctcttagatggagtcccaggtgcatggtgactctttctggctgttgtagtcagacagggtacgaccatcttccagctgtcttccggcaaagatcaacctctgctagatcaggaggcatgccttcctttatcttggatcta

SEQ ID NO: 508360 - DNA, 322 bp, Homo sapiens
gtcggtcgctctgcaggatccccactccgagctgcggcggcggtcggatcgccatcccgggcctggcgggggcaggaaattctgtcttgctggtctgcaacctgcacccagagagagtcacaccccaaagcctctttattcttttcggcgtctactgttacgtgcagcgcgtgaagatcctgttcattaagaaggagaacgccctagtgcagatcgcggacgacaaccaggcccagctggtccatgagccacctcaacgggcacaagctgcacgggaagcccatccgcatcacgctctctaagcaccagaacgtgcagctcg

SEQ ID NO: 508361 - DNA, 913 bp, Homo sapiens
catggtggctcaagctgtaatcctatcatttggggaggccaaggcaggtggatcacctgaggtcaggagttgagaccagcctggcaacacggtgaaacccctctttactaaaaatacaaaaattagctaggcatggtggtgggcacctgaaattccagctactcaggaagatgaggcaggagaatggctgtgaacccaggaggtggaggttatagtgagccaaagatcgcgccatgtgcactccagcctgggctacaagagcaaaactctgactcaaaaaaaaaaaaaaaaaggaaaaaaggcgcggattttgggcccggaatttaggttgtacccaacattaacacaccacactgggtcttggtggtccacccatgggggtgtctttaccaaaacccttaaagtggttaagagcgcccagtggcacacttaagggcaaagatgggtagtggcgttaaataactcctatagggtaacccacccttgggacccaggcttttaagttggtcccggaataactggcggccaacttggtaggcagattgggtatctggtggtccctaaaggattttatattatctgtaggaacacgggggctcacctctgggaaagcacggcggagggggaggcggcacatacgttgggtttagagggaggcggcgcgggaaaaaaatctcgcaaccaggatcacaagtaggggtgtgctctgggcccccacgggcggcaatgagggccaggggacagggactgggagagaagggctcccaggtgccagggtcgaaactagacaagtagacgggcgggcccatggggtacggcgaggccggcagcatatgtataggggacggttatttgaaccggttggcacaacgggggggatatcacccatcggagggggggaaaaaagagcgct

SEQ ID NO: 508362 - DNA, 946 bp, Homo sapiens
  misc_feature (946)..(946): n is a, c, g, or t
gttactgaagccctatagtatgtttgagtgacagagcgacctaactcaggctatgagaaaggagttgacttgagcttttaacgattatctggaagtaaaatctgggctttgccttaagaattattgagaatatttttttcatttcgtgtttattttttccaattaggaaaagagatgctgaatcacagagcactgctgctcctactacaggctagtagagttcactcatttggaccttgccattccaggcggtttcagagtgaatagggactggccacttccaaggcgagcactacctactgtcctcattgtgtgctaaagaacacgaaagcagagagagtccacgtggtgatcttgtgctcaaagaactcttcaaagatttctagctgtgccttttaaaccatgcaatattcaggatcgttggaatcaaagagtaaaaagctgctatttcggtaacttaattctctctgggaaagggcagggggagtcagcaaacaatctacctcgagtgctcttccactttgactaggaccattacaaagtgtatctgaggctgcactaacctctgacatctgttcttgcatgtgacaacagaaagctttcaggtggactgtacattttgtgctttggaagcaccaaaaggaaaaataatatgtatatttctttgaagttatacagaagttatttggagcaggatggtgttttattgtaaaatgtgagtgatccagagattcctttgcttttgaattaatctttcttgattctcaaactaaaaaaaaaagggggggctaagatccgagggcagttgcgttccgttttggaagggccagggggtaaggagagggggtaagcgggggaagacgggttgtgagattgtgggttgggaccagaagcggtaaatgtggagcttggtctagttgtaaattgggggttcttgttaccattn

SEQ ID NO: 508363 - DNA, 246 bp, Homo sapiens
tccccacccccaaatttttaattcctaaggctaacaggggggcggggggcctggccctaataagggttccaaaaggggggggacctggacttccagcaactttggcccccaaacctacacctgaatgggaaatcacaacccccccacccccaagggggaaaaaaagttgggccccaaatgttatttaaagggccaaccggccccaaaaccacggttggggagtgggcgctttttcaaatggttccc

SEQ ID NO: 508364 - DNA, 373 bp, Homo sapiens
gaatggataaattcgaaggggctgaattgaatacagatcaacctgcaatggtattcaaggcttatctggctgcggtgactgtagtacggcccgcccgacataaagttctggctaacggaggatcgcttaaggatgcttataggtgacacatgaccttaccctcattcaacactgacgtcgatgacgacatgacagatgaacactttgcatctgctacggagctaccatgcatattgacatgccttcgtaacacttgatacacgaatgccgcagtacaatgcattcgtactgagcctgacctcactgatgcactctacaggcatgcatggccttgagagcttcatgggtggcttcagcgacgtatgtccatgtg

SEQ ID NO: 508365 - DNA, 335 bp, Homo sapiens
cggaaggcgtgggatgcgccggtgcgggggtactgcaggtaggcccagccccggagttcgtatcgcgcgaagccctcgatgagcgaagtgcccaggccacccacggggggcgcttcgatggaaggcccgccacgctcgagccaatgaagcgtcagcaggtggttgtcgcaggactcttccgaggtccatcgcaagtggactacgccgcccgggacgctgagggcgccgtacttctcgctgttcgacagcagttcctgcaggatcatgcccagaggcgtggccttggtggcggggatgcggacgcgcggcccctcgatggcgatccggcccggcac

SEQ ID NO: 508366 - DNA, 663 bp, Homo sapiens
  misc_feature (4)..(4): n is a, c, g, or t
  misc_feature (79)..(79): n is a, c, g, or t
  misc_feature (192)..(192): n is a, c, g, or t
  misc_feature (200)..(200): n is a, c, g, or t
  misc_feature (212)..(212): n is a, c, g, or t
  misc_feature (218)..(218): n is a, c, g, or t
  misc_feature (258)..(258): n is a, c, g, or t
  misc_feature (263)..(263): n is a, c, g, or t
  misc_feature (276)..(276): n is a, c, g, or t
  misc_feature (303)..(303): n is a, c, g, or t
  misc_feature (319)..(319): n is a, c, g, or t
  misc_feature (427)..(427): n is a, c, g, or t
  misc_feature (434)..(435): n is a, c, g, or t
  misc_feature (439)..(439): n is a, c, g, or t
  misc_feature (445)..(446): n is a, c, g, or t
  misc_feature (451)..(451): n is a, c, g, or t
  misc_feature (461)..(462): n is a, c, g, or t
  misc_feature (500)..(500): n is a, c, g, or t
  misc_feature (521)..(521): n is a, c, g, or t
  misc_feature (530)..(530): n is a, c, g, or t
  misc_feature (533)..(533): n is a, c, g, or t
  misc_feature (541)..(541): n is a, c, g, or t
  misc_feature (582)..(582): n is a, c, g, or t
  misc_feature (588)..(588): n is a, c, g, or t
  misc_feature (662)..(662): n is a, c, g, or t
tgtntttatatatatataaatgtttgtataaaattgaatattcatgattttaaatttgacaaacactgtcaggtaaaantcaaactattttactaagttaacatctcattcaattagttgtaagttgtaatagcggcatattttacatgagactattagaaaagggtaatattaagtcattaacattatcantctgcccncttttattaggntggggngaaatagggaaatctctactatcctggggggaaacaagcnataanaccatgtattacnagtttaaagaaatgaatttatcctaanatcatcagtatcagcnccccaacaaagcaactttgccatttctacttaaagtacactgtggcttgatcagacacttatctcagcagtacttgtttaagcaggtctctttgtacaaaagcaaaanagaaagnnaaanaaaatnnatagncattatttannttgcacccagtaaaagccaaggggtttagggtgggggnattttctactcccatacccangcgaccatnatnaaaattgntgataaaaaaataaggtaaggaaaagaagataaaaaagggngggtgngtggaaaaattttatgtatgataaattggatggaaatattagattaaatattatgaaaatgtggtgtaaaaaana

SEQ ID NO: 508367 - DNA, 243 bp, Homo sapiens
gaggattccttgagcacgaatgttcacctggtccatcaccaggccgtcggccaggtggattttctcgtgggtgcacaggccggcggtggcgaagaattcgttatcggctgaacggaacaccgcgtaggtctgcgcgccgtggtcgaagcgcagcacgtcttctgcttctatttcgcccacagcgcagacgtcgatccattgatcgttcatacatttatctccaatgactggctcttactctgt

SEQ ID NO: 508368 - DNA, 110 bp, Homo sapiens
cgtaggtgtattcaccactgcgtgtgcatgcctccctgatacaatgttccgtcgacacgtgagcatcacgtgctgacctccaacattatcgttaagctaggagccgtggt

SEQ ID NO: 508369 - DNA, 714 bp, Homo sapiens
ttatgcgcaaggaggtatgacaagatggtcgactatatgcagccaggcggaacacctgccaccgagggactgggacgactggcaccctcctaacagattttcagcggggaggcactgagagtggatggagggaagacacagaagctacgctgaagtgggaggaagctgctgcacagagctaccatgcactgggactagctcctggtccccagtgactccaggggaacaggtgagttaaactggcaaggaacaacctgctctcaccacaggcctctggaatcccggcaggaggagactccttgaccaccacagacacttgagctggcagggagagttgcttggagaagtggtaggggcagcacttcagcctgggtggagcccagagggtttggtgtgggagcatttgcaataaagcatagccaggacagccatccctctaggctcagacttgctcccatggcagactttaaccctagggggactgttgaaactaaattccttcagggtggtcttgcctgtcagatgaggccagttcaataacctgagcaccccttggtttactggtctctcctggagccccaggactaccaaagccagaaacgctccagcacaagcagcccctatggacatgcacagaccagacacttccttcctctactgcagtttccgctgggcccatggcatccccccaaatcacctgctggtgcacatgtg

SEQ ID NO: 508370 - DNA, 460 bp, Homo sapiens
  misc_feature (158)..(158): n is a, c, g, or t
ctaaatggttggtcaggaggcttcattgataaggtgcaaagaatagaaggaatttaggaggttgaccaagaaaatgcttagagaacagtgctccaggcagagggaacggcatgtgcaaaggttctgaggcagacagtgtgctgagcgtgtctaaggancagcgagggtgccaacatggctggagtagataacaaggcagacaggagtaggggatgagagcagggagctgatgaggtaggaaaggccttgtgggccattgtccagatttagctttttctctgagtaacgtgggagccagtgcagcgtttagcacagcagagggccaaggtcattatagagtggttgagagggagggtcacaaaaaccccacatggatgatttccttttccgaacccccatcaaaatgaaagtcagtgccctttgtttacaaaccatgcaattctcttgccgttgttcttcg

SEQ ID NO: 508371 - DNA, 151 bp, Homo sapiens
ggctctgctctcccatgctgacctcagcatccctcctgcattgtcctcattcagcacacacgcatacctcatgcttgaaccgcatttattggctgtctttgagtgtctttggtatggctttgggagggctgtctgggttcctccgactttg

SEQ ID NO: 508372 - DNA, 209 bp, Homo sapiens
tggaactggtaatggttccattattctggcacagtctataacatagaatttagcagttcccaaaatattcagtttattcattatttagtttacggcatggccaccttggcagaacagtgagacataaggtagagtgacgctgcttggagggtttcaaaaaatcacaaaactttccctagtgcaggcagggaaaagaaattcctcttata

SEQ ID NO: 508373 - DNA, 408 bp, Homo sapiens
  misc_feature (2)..(2): n is a, c, g, or t
cngggaaatggcaaattaaaacccacaatggggattatcacttacacacttatccggaatgactacagtacaaaatagtatgataacattatccaaatgctggtgaggatgcagagaaagtgcactcatacactgctgaggatgggggtgtaaaatggtatagccattctggaaacagtctggcagtttcttataaaacgaaacatgcaattactatgtgacccaacaattgcagttttgggtgtttattccaaagaaacaaaaatttatgatcacacaacctgtacacaaaatattcctagcagctttattcatattagctaaaaactagaatcagcccagatgtcggtcaatgggtaaagattaaacaaactggtacataccatgaagtatactactcaacaattt

SEQ ID NO: 508374 - DNA, 976 bp, Homo sapiens
gaagacggcgtgcatcaagtagttagaactgggattagtctgctcgtgttagtattcaagatgtccttgctatgctcaatctctagtacgcgtgagacattttcctctgttacgaaggtcgttgatgtctctttgggggttagaaggtacgagtgagtgtcgcgtatccagagtccccttggtccgtgacgtgcatatcactcgatgtctagagctcgagttacgcaacttctctgagtttcagaccggcaaccagtcatatttagtaacccggaacacagtgatggcatctatatcctacctctgaagaggtatccctcgggaacagaagctcctactgagcttgagccataggtcgttagcctaatctagtagtgccatgtcgcgaaagacacctcgactaggaatagctctagctggcttatataataacctactcaagggaagataaaactagggcccgagaagtggagtggttgctcgaagatggtttgtgacttggctggaccccactagtgccatggcgcgagatgcccaaaattttgcatagagacccagtcgtgtccaacgttccctagagacaccgtatcaaccatagactcgaaggatccccagggccatgcccatttacccggtggagccccacaggggcttttcctatggttggggtttgacctggacccccgaggcgcctggaacgcgagcccaaggcacgtccttccacgggcatgcgcgaagtccttctaatggttaaacccttacgcttagcgcaatattgcggccttgtgttaaccacgagaagttcgtaccatacgtgactgctaattgtagggaccacttttggccaatcccccattggcaccacaaaccaaaggggacggctcaacttcagcttggggtttattggactgctggagttgggcaatcgaccttgggcattcgcgaaaaagctaacaatggcggcaataggcgctag

SEQ ID NO: 508375 - DNA, 686 bp, Homo sapiens
  misc_feature (140)..(140): n is a, c, g, or t
  misc_feature (228)..(228): n is a, c, g, or t
  misc_feature (240)..(241): n is a, c, g, or t
  misc_feature (280)..(280): n is a, c, g, or t
  misc_feature (282)..(282): n is a, c, g, or t
  misc_feature (365)..(365): n is a, c, g, or t
  misc_feature (368)..(368): n is a, c, g, or t
  misc_feature (399)..(399): n is a, c, g, or t
  misc_feature (412)..(412): n is a, c, g, or t
  misc_feature (417)..(417): n is a, c, g, or t
  misc_feature (421)..(422): n is a, c, g, or t
  misc_feature (431)..(431): n is a, c, g, or t
  misc_feature (439)..(439): n is a, c, g, or t
  misc_feature (443)..(443): n is a, c, g, or t
  misc_feature (457)..(457): n is a, c, g, or t
  misc_feature (461)..(461): n is a, c, g, or t
  misc_feature (464)..(464): n is a, c, g, or t
  misc_feature (482)..(482): n is a, c, g, or t
  misc_feature (489)..(490): n is a, c, g, or t
  misc_feature (493)..(493): n is a, c, g, or t
  misc_feature (497)..(497): n is a, c, g, or t
  misc_feature (501)..(501): n is a, c, g, or t
  misc_feature (509)..(509): n is a, c, g, or t
  misc_feature (538)..(538): n is a, c, g, or t
gcctggcccacgtgggcctcagagctgctgctggggcattcagaaccggctctccattggcattgggaccagagaccccgcaagtggcctgtttgcctggacatccacctgtacgtccccaggtttcgggaggcccaggngcgatgccagaccccgctggcgcacctgcccttcttctacgtgcagcatctcgcgtgccgaggccgaggagcacctgaagctggctgngcatggcggacnnggctcttcctgctgcgccagtgcctgcgctcgctgggcngntatgtgctgtcgctcgtgcacgatgtgcgcttccaccactttcccatcgagcgccagctcaacggcacctacgccattgccgnggncaaagcgcactgtggaccggcagagctctgngagttctactcgngcgancccnnacgggctgncctgcaanctgngcaagccgtgcaancggncgncgggcctcgagccgcagncgggggnnctncganatgnctgcgagnacgccatggtgcgtgactacgtgcgccanactgggaagctggaagggcgaggcccctggagcaaggccagtaatcaagacaggaacccgcagggtggcaggaagcgtcattgctacagacgggcccagagaagcggaatgcccctgggaacaacgggcgagccgtgacggcgttgag

SEQ ID NO: 508376 - DNA, 158 bp, Homo sapiens
tccatgcgccaccactggctggataatcctgaaaagaatggcaatacagtaaagatggtgatctccaaagaaagaggtggcgctggcctatcaggaagccatgtacaatatggctaccctcaccagcactgctgcaggtttaatgcacacatttaatg

SEQ ID NO: 508377 - DNA, 358 bp, Homo sapiens
cgggacgggatggttgtctgacctcgcgagtcctctctggggctcctttctcaggtgggagctcttgtgtttttttgtcgacggggtgtcactctttgctgtgctgtgctggagtgcactggctcgatcttggctcaccccaacctccacctcctgggttcaagcctcagattgaaccctgtctcaggctcccaagtagctgggattacaggtgcccaccaccatgcctggctcattttttttaatttggtaattttttatttttagtagagacagggtttctccatgttggtcaggctggtctcgaactcccgacctcaggtgatctgcccgcctcggcctcccaaagtgctgggac

SEQ ID NO: 508378 - DNA, 681 bp, Homo sapiens
aaattatatgaaagtagctacactggtcaggcatggttgctcacgcctgtaagttcagcactttgggaggctgaggcgggtggatcacctgaggtcaggagttcgagaacagcctggctaacatggtgaaacccaatctctactaaaaatacaaaattagctgggtgtggtggcgcaggcctgtaatcccagctattcaggaggctgaggcaggagaatggcttaccaaggagacagaagttgcagtgaacggggattgtgccattgcactccagcctgtgcaacaagagtgaaactccatctcaaaaaaataaaaataagaaaaaagaaagcagccaaaccaaacaacagattttcaataaagacaacatagacttctattgtaagaagatataatctaggactttcatagctatagagaagtcagtcaatgcctggcttcaaagcttaaaaggacaggctgattctcttgttagggactaatgcagacaatgattttaagagaaagccaatgtttcttaccattccaaaaatcctagggcccttaagaattatattaagtctattcagcctctctatgaatagaaaaaagcctagatgacagcacatctgttgaaagtatgcgttacggaatattttgcccatatgtgggacttactgctgatcctttctattactctc

SEQ ID NO: 508379 - DNA, 130 bp, Homo sapiens
aatccagagatagtatgatgaatattagcagtctacagtacaagcctaacataaccattctataatttaactatatatattatcctaactactacccctattcctccccacactcatcgcccttaccatg

SEQ ID NO: 508380 - DNA, 130 bp, Homo sapiens
tatgaaagatatggtgcgcatgacgtaattcagaagtgaagacaacatgggtggatgtggagtacgaacctggggatcgggtaaagataccagtgccagaacgctgactcctacgaagagtgggagcagc

SEQ ID NO: 508381 - DNA, 1336 bp, Homo sapiens
  misc_feature (546)..(546): n is a, c, g, or t
  misc_feature (642)..(642): n is a, c, g, or t
tggccccgactttttgacaaggctgcggggtctgcggtctattccccgagcttcgcaatgtgccgccataagggacaagacaaagaaagaaaaaggaccgcgttgagaaatgctccggccaaaaaaagacaaagacccagttgaacaaactccgggggcaagggccaaaagagaaagaaggtggctccaaagggcaaagtccgggacaagcctcaaataacttagctctgtgtgtgtggcacaaagcttcccttattgattaacactcgtgtagggaagttcccccaacttataaagctttattaaccccagttgtggtggttcctcttgaaagcacttgagaaattcgagggtctccccgtgggccaggggacagccctttcgaggagcctcctttaggtaagggggcactttattcaaacgcgtggtttcacaagagcacgagaagccctcagagttaatttttacccgcgcagaaaaattccccaggggggtgggcagaagtgcctcccagtcgtgccgtggtgtgaaagaaatgctgtgaanattagcgtctcccaaccccgatggtttgctcactttttgtgggcaaccacaatttcaaagcaccatcttttttatctaacgactcttcccacacancagaagacagccaccgcccactcacagcacacgacaacagacagcaggacatgcatccgaacagatagcccaacaaaacgacccaacacgaaagccacgaaacacacgagtccggcgcgggcgagactactaatctcgtaatgttgagcggcgatgccgagcccgccacgatacaacgcactagtaggcgagtcgatagcaaaaacctagggagcggagcgaccgacgaaggaagtagaacaaacaagcagccaacgcgtagcacaagagcccaaccacacagagagtagaactgtctagtgtagtcagcagaccacaagacaagtagggggtcaaaaagctcactccagacagccggcgcgccccgccacccaagaataagagcgaggagccgacagactaagcacttaccacatagccagacgaacgaaacgacagcgagtggcaaatccaccctcgctaactaaatcaaggaagtagacgacgtcgaagaacatacggcaaggccgacgccaggacatctcgccaactacgaacgagccacgcgtacggcagacgcacgcagcgcacccccgagagcgacgcgagcatcgtgcgacaagcagcgatgccagacgtcgaccaagaacgagacagtcgatgaacggacagacaggaccacgaaaccgatcgtacgaaccgactgctcgactgc

SEQ ID NO: 508382 - DNA, 413 bp, Homo sapiens
atgtagtggcagttggtatcttgtagtatcaattatgtggtcattgtattcatctattacatctatctcatgtaataatggatgatttgctgaatacttcccgcttggctgaatactatctgatatgtcaagacagtgatgtaagcagacagggagggtctccaggaactatagaagtttctgcagcttgaaccttctgcctgttttatagcctcccatttttcagtcctgttttttacaaaccgtcgatggaatgcggacacgcgtaggtcgcgctggcataccagtgtccaggagcaggatcccagtaaactaatagatgaatctgagtgaatgttccgcattaccatgctacattctctacgcttcgacgagctacagattcctcacctttacatgtaacctatgtgctg

SEQ ID NO: 508383 - DNA, 158 bp, Homo sapiens
ctgggagtggatctgtctgtgtggctctcggtcacatgtcacagtgcagtcctggcagacttgggtcttctctttggtggtttctaaagtgccttatctgcaacaacttcttttctccttcaggaactgtgaatggctagaagcaggagctcagtaaa

SEQ ID NO: 508384 - DNA, 662 bp, Homo sapiens
  misc_feature (509)..(510): n is a, c, g, or t
  misc_feature (592)..(592): n is a, c, g, or t
agcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatggaacccggaggtagagcttgcagtgagctgagatagcaccactgcactccagcctgggtgacagagcgaaactccgtctcaaaaaaaaaaaaattaacttggcgtggtggtgggcgcctgtaatcccagctactcaggaggctgaggcaggagaatcactagaagctgnnaggcagaggttgcagtgagctgagattgtgccagtgccctcctgggcaacaagagtgaaactctgtctcaaaacaaacatantataaattaagtgtctttgttggtgatgaataaattggtcagtccacctattaaggtttaaggtgggttt

SEQ ID NO: 508385 - DNA, 441 bp, Homo sapiens
caaggcttttaggagcttgggtactcacagccctgttccgagactcaggaactcggagtctcaaagcccggatcccgtccccaaagaagccccagtcttcactgcccgcttctgttcccttccaaactcaagttttctctgtctgcttctgcccctcaggaacctaagtcttcgctgccccgtttctgaatccttaggagcccgggtcttcactgtcccgcttctgcctcttaggagcccaagtcctcaccgctccacttttacctctccggagcctgtgtcttcacgccccgttcctttctgaccctttcctcgtaggagtgcgggtcctcataatcctgctcctctcagaccactttccctcagatgccggagaactcgcatccgtccccgttccctaagtcccgtcttggagcccgggtccccttctgtcgtcttctc

SEQ ID NO: 508386 - DNA, 275 bp, Homo sapiens
  misc_feature (2)..(2): n is a, c, g, or t
  misc_feature (45)..(45): n is a, c, g, or t
tntcggctacaacgccaaggcgatccactcacaatctgaaggtgnataatgatccagcagggaaggcattggacatttttatgtgactgacttttcgaaggggtgtgaaggagcttttaccctccaaatccaaaagcttcatcaccttcattgggctagcgcaatccccaaactagaagcaaactgcccttaatatttcagggtaagtttttatagattagcccagagcttttgtattttcccagttcactgctgagatcgccttggcgttgtag

SEQ ID NO: 508387 - DNA, 276 bp, Homo sapiens
attgctgggcgatctagaggatccctgacaccagacactggtatggtagttcttattctctaggttatatttcattatgtatttaaaagtatttttaagacaagtttcctgtatacctctgaactgttttggttttgagttcatcatgatagatctgctgtttccttataaaaggcatttgttgtgtgagttaatgcaaagtagccaagtccagctatatagcagcttcagaaacatacctgaccaaaaaaattcccattaccaggctggtgtcaa

SEQ ID NO: 508388 - DNA, 135 bp, Homo sapiens
tacagcctgtactacacctacaacctgtccaagcgcaccaacctgtacgcgctgggttcgtatgccacgaactatcgcgttcatcgacggcgtcaagagcaccgtcggcatggtgggcgtgcgtcaccgctttct

SEQ ID NO: 508389 - DNA, 140 bp, Homo sapiens
tttggctgtacctcaaagtgctatggagagcttctgtcctcgaaaatctccctgacaatactgacagcatacaaaacatggagaaagctcaaaactaaatttagactctcagtggctgggttttagtatctcttttcttt

SEQ ID NO: 508390 - DNA, 598 bp, Homo sapiens
aacagtggtatcaatcgcagagtagccaccacgcccgggccctcttgaactatccctatactgtgacattagcacagaagtcagaaaagggcaatcgcagccctacataacaaacccaaagctgcgcaaaaagagcaaaacaaggacaaagcagaaagaagcccgaggatagggggataattacagcagaaagaaagcagtgttcaaagggggttacctattccctgtactgcggggccgaaggaaactgccattagaaaaatggaaaatccaagtcacaagggaattcccgagagacgagacaaaagagaaaacagacaaaacagagagcagaagggagcccaaacagagagacacagagaagaagtgagagcggcgcagagcgcggccaacaacccgcgaggggacacccacgacgaaagaacagggaggtttacacgggacaccaccccagggcctagtggagggtgagcgcgcgcgcgagcgacaccaacagaggtggcgaggagagaggcgagaacaacgagggggggaacaaaagcaagagggggaaaggaccacgggagagagacagcacacagcccggcgcggaggaagc

SEQ ID NO: 508391 - DNA, 647 bp, Homo sapiens
ccacgcgtcgatctcttttcatttgtatgttaattgaggttaactttattcttttgatgcctgtacagttttttgtttgtttgtttgttttttgggatgcagtcttgctctgttgcccaggctggagtgcagtgatgtgatctcagctcactgcaacctccacctcccgggctcgggcgattctcctgcctcagcctcctgagtggctgggactgcaggcgcccactaccatgcccggctaatttttgtatttttcgtagagacggggttccaccgtgttggccaggctggtcttgaactcctgaccttgtgatccgcccaccttggcctcccaaagtgctgggattacagggatgagtcaccatgcccagcccaacacacattgtatcttttaaagtgagaggtggcacgtacctgtagtcccagctacttgggaggctgagaggcaggaggattgcttgagcccgggaggttgaggctgcagtgggctgagatcataccactgcacttcagcctgggcgagagtgagacctgtctcaaataaactcaattaaacaaataggctgggtactgtggctcatgcctgtaatcccagatcttgtgggaggcggaggtgggaggatcacatgaggcctggagttgagaca

SEQ ID NO: 508392 - DNA, 312 bp, Homo sapiens
gcgctcgggttagcactgtggggaacaaaagagtctgaaacacagtccctgctctgaggaacttccaatcaagttagtgatggtacttgaatggcattatagaaatgctaatagggcttagagaaagagaatcttgcgttgctgtggtcaccgcggaagtcttctacttctcgaaaatgcaggctgggcgccgtggctcacacccgttatctcaggtccacgtgagaggatccctcgagcccaggagttcaagaccaggctgggcaacatggtgcgagcctgtctctattataaatgaagaaattaatccga

SEQ ID NO: 508393 - DNA, 199 bp, Homo sapiens
tcccagcggaatagactaaaaatcttaggtaacgccgggggcattgaaaggaaagcatctggctctgaaaatgaaggcgattataaccctggcaggaaaacatggcaaaacaacaagcaagaaaccgaagaagacatcttttgatcaggattcagatgtggacatcttcccctcagacttccctactgagccaccttct

SEQ ID NO: 508394 - DNA, 270 bp, Homo sapiens
tctggcatcgctaatcttttactctacttgatccactaacttgacctcggaacaagttaccctagggagtacagcgcaatcctattctacgagtccacaattcaacaatagggtttacgacctactatcttggatcaggacatcccgacttgtgcagccgcctattacaggttcgtttgttctacgacttaaagtcctacgtgatctgagttcagaccggacgtaatccaggctcggtttctatctacttcatattcctccctgtacgat

SEQ ID NO: 508395 - DNA, 1642 bp, Homo sapiens
ccggctgccacttgttgtggtgcgcttcttgctcgtgtggcctcggcctggcgcgtgtgcggctatagtggactcttgttcactcctcatttgacttcgccggcgctgccgcaattattgttggggcacacacgtctttgttctgctccacgccggtggcactgttgtttgcgtcgcacgatggtactctccgtttggtgtgtagccgcttcctcccggcgcggtggggtgtcctcccggtgcacactatgggctcatattgcaagctgccttctagttggctcgccgggggggtgcaccccacaccacgatggggcgtgcggtgtgtatctacaccaacctcctcgtgtgtggcagctcatctgatagaatgtttgtgttgctccgcggggcgaatgtttggtgtgggggggccgccctctgtggtggggggtttcttgtcttcccccccgcaggggccgcccgcagtttctccctgtggcgagccacgtgtgttcctcgcgaggtggtattggtcgccttctccacagttggtgggcggcccgacgggagggtgatgccgggtggccggccgccacgagtgatagatgggttgtagcgctgcgctctcgctgtcgatcccaagaagggggctcccctcgcagcgtgctacttggtgagaccgtgtgggtggcatagcttggggcgccgtcttgttttgcgccgtccccccacggtgggtctctgtcccacgcggggggaggggtgggcacgcccccctgtagtccgcccttcccgtgttcacgccgtctctggggagaccactggggttggtgtggattgactcaccccccgcccgctggtcactccgtcggggtgtattccccgcgggctcccccagcgcacgcgcgtgtgtggaggatgtgtccacggtgtgtgagatgctccccccactcttttctatatggcgcacacacactgctgttcgacaccacacaggtgttttgtgccgcgcgaggcactcgtgttctcgcgagggagaccccgcgcgcccactctgttggtgctctgtggggcgccacacactcatgtgtgcgccacatctgtgtggatacgccgcgcgtgtgtcttgtggacacacacgcgtgttatctgcagagtgagacacacaccgcgccacacagagaggtatgtctctcccacatatagaggagacactttctctccacacactcccaccgcgggccacacccctgtgcgtgtgcacaccctctgccacatgagatgtcgtgtgagcacacaccgctccaagggtgtcacacttctctatatgtccaccctcccatctccgctataaggctggttcctcggcactccctctcggaccacacatgagagagaatatatgccaccacctcccgcgagacactccgcggggccccgcggcaccacacacacttctgagagcccactctcccggacgtctattctccgccccaatccgcggtctatctcaccggcccggcgcccatggaggcgccatatggcttggccctatggcccctttttggtttgcctcccttggagttctccccttctccccctccccgccccccccgccccccctggtaccccgatccccgaataaagcaccttttcccta

SEQ ID NO: 508396 - DNA, 180 bp, Homo sapiens
gggaacaagacttagaaggagggcccaggccctttttgtttgaacccctgtcatgatcccagggtcagagaggggtccttttttttggggaagttgaggggggcccttcagagccagtagcaggcaggggggggtaggccccctccttcctgtttttttttaataaaatggtaccctgca

SEQ ID NO: 508397 - DNA, 151 bp, Homo sapiens
tgagccactgtgcctggccgcattaagatttgtttttgaaatgctgtaaaaggttctcttggacatcccgtacttgcttgttgagattttatttctgttagagacttagactttttttacacgttacgctattttaaacacacacgcactt

SEQ ID NO: 508398 - DNA, 966 bp, Homo sapiens
gtgagctgagatgcaccactgcacttctctgcctgtttcaaccaagcgagactccatctcaaaaaaaaaaaaaattagctgggcatggtggcgggcacctgtagtcccagctgcttgggaggctgaggcaggagaaatggcgtgaactcaggaggcagagcttgcagtgagcagagatggtgccactgcactccagcctgggcaacagagcgagactctgtctcaaaatatttttaaataaagaaacgaaaaacgagggttacagattcaatgggcaccatgtgggaaaattatcccctagacagataaacacttcccatttaagcgtggtgattcataccagccttttaaacaaggggagccattctcagaaattacagatgtgggtgggtacacattggcctttactgggagaaaagggaacaaagaaaaacacagcggagttatttttaacaaggggaaaaagagggcatgtggtgattttctcaatgggattggaaagcttgaatttcagaattggccattacagcgttttttggttacccacagaacaaagcgggctatcctgtggcaagaaccgggggggtggtttcccgaaatgtgaccagaaccgcgaaggtgtgccattatattgaaagggcaagtttgccccgaatgtgttacccaaattgttatagcaccaatggtgtgtgagtgcagggggggaaacaggctgtggattgggaacaagggggcaaaagtttgggatagaaccgggcataccctccattgggtggccttttgtgaacacgaagcctaatagcctgtgaagcctacttatatgtaactacatctggggggattatcacacggcactataagagccatgacacgtgttgattgttacacgtacaagtaattgtctagaccacaagcgaggtgttgtaaaatataccccagaaagtgtgttttgcaacgtgaattggg

SEQ ID NO: 508399 - DNA, 110 bp, Homo sapiens
gtgttatccgctgacacctttgccaataatagatccagccaaagtctttggtgaatagttacttggtgtagtactaattaggtccaccaagatcaccatatgatgccgac

SEQ ID NO: 508400 - DNA, 154 bp, Homo sapiens
tttttttgttaaaaaaaatttttttaatcaggattggttttacaagtaaaaaactttgaaactcttgaactaaaagtctccaaaactttaaagggcagtttgagaacccggatttttattgttttaaaaaaaaacatggttttgaatagttcca

SEQ ID NO: 508401 - DNA, 264 bp, Homo sapiens
  misc_feature (1)..(1): n is a, c, g, or t
  misc_feature (10)..(10): n is a, c, g, or t
  misc_feature (237)..(237): n is a, c, g, or t
  misc_feature (246)..(246): n is a, c, g, or t
ntggtgatgncgtgcacagccagaccattcagatcccaccgtgccccagcggtggtcctcgctgtggatcggctactcttttgtgatgcacaccagcgctggtgcagaaggctctggcaagccctggcgtcccccggcttcctgcctggaggagtttagaagtgcgccattcatcgagtgtcacggcccgttggacctgcaattactacgcaaacgcttacagcttttggctcgcancatagagangagcgagatgttcaagaa

SEQ ID NO: 508402 - DNA, 179 bp, Homo sapiens
aagccagacttcaggaacagcatgtccaaatcgatgtggatgtttccaagtcctgacctcacggctgtccctgcgatgacgtacgtcacgcaatatgaaatgtgtggctgccaagtaacctagcaggacgcagaagcaatggtacaaattccacagtttgctgtacctcgtctgcaggc

SEQ ID NO: 508403 - DNA, 269 bp, Homo sapiens
gcttcgtactgtggtgtaccgttcaccctttaagcatcccacatgagcacagatccctttcacgaagcatctatttttcatccctgtaatgccaccttaaagccagggtaacaatgtcaagaattagcaagtaaaatgagctctccactatttagtctgttgcataaaggatctcttgtactaaacattctgtgtggaacaagaacaatggaagctgcaaagtcacagaacttaaaactggctcaggtgaaggaatagtttatgaattg

SEQ ID NO: 508404 - DNA, 488 bp, Homo sapiens
  misc_feature (216)..(216): n is a, c, g, or t
gatgtcctctccaacccttggggcaagatccctcatcgttttcttttttctgaatcaagagacctttgaacagctttcaataagttaccggccccctctacccagcaaagtgcatgtgcagtccatacttatagttatggggagagagtttatagactagattaagatggaagaaaatggggtgaggttgtagggaattttcttctggttcacacntttttttctttctttttttttttttttgggagataagagagtttggcctctggtgtggcacggggctgggagtgtgcaggggtgcccctccgtcgcgtggaacctccgcctccggggtcgggggattctctggcctcgggtctcccaaggggcggggattatagggcgcgcctgccaccggggcccggctaaattttggtatataggggggagagggggtctcgccatgtgggcaggagtcagaaaccacctgaccaacatggagaaaccca

SEQ ID NO: 508405 - DNA, 207 bp, Homo sapiens
  misc_feature (25)..(25): n is a, c, g, or t
  misc_feature (71)..(71): n is a, c, g, or t
  misc_feature (81)..(81): n is a, c, g, or t
  misc_feature (191)..(191): n is a, c, g, or t
  misc_feature (204)..(204): n is a, c, g, or t
tcttgcttaggcttacaattttaanacagggggagacaaagttgtagtttttctactcctttgccttcacncctgtttaantttccactgtggtcagataagtattttttaaacgaccgtactcaaacttctggtactgagcaatgggggaacctcactatggctgtaaacccttccactggacactaatnaaatgcattgccnccc

SEQ ID NO: 508406 - DNA, 87 bp, Homo sapiens
ttttttgaaaggcccccttttaaagggggtcatttgttcccttttaagttgagaggccaaacctgaataaagtgattgttttttgta

SEQ ID NO: 508407 - DNA, 359 bp, Homo sapiens
acaagtgcgtaatccctggcagtacaatcatatacaattctgaatggggctgaattattagtcaaagcgacgtatgtagttacttcatttttatgggagtaaatgctttatagcttggccctatggctgtattatggctatgtttaattcctaataaatcagttttgtgtaaaaaacacagttgaggctgggtgtgatggctcacatctgtaatcccagcactttgggaggctgagatgggcggatcatgaggtcaggagatccagaccatcctggccaacatggtgaaaccctgtctctactaaaaatacaaaaattagccggccatggtggtggcatgtgcctgtagtcccagccta

SEQ ID NO: 508408 - DNA, 151 bp, Homo sapiens
aaattgtccctttttggacgtgtctgccatctcagagctctcggatgattggtcaccaaagtctactaattttctactacattcccccacagtaataataataactgcactcataactggcatttattgagtggttattatgtgtcagttc

SEQ ID NO: 508409 - DNA, 105 bp, Homo sapiens
ccgatgtcaccgcgttgcgccgcccgtgcggcggccggtgcgtccaccccggcgcgctgtccggtcgtgacacagcaccatgttcgggatgcgtgtcctgatctg

SEQ ID NO: 508410 - DNA, 281 bp, Homo sapiens
cttcgcagttatttgacgcgtccgggaaaagggcaaccagataggagctcagcccaagaagaaagtcttcgagaagtgcggctgacttcaaaatttctgcaggagtgcatcgcacagtggaagcaaaccaacttcatgacctaagctgggggccttcccaaattttttccccttgggttaaagcattccggccttggaaaacaagggggggggggaaaaccattttcaggccttaagcccaaaggcccccaaggcattcttccaccacccttccttcccta

SEQ ID NO: 508411 - DNA, 355 bp, Homo sapiens
aagggtctctcccatttgcctttaaagaagatgtaattcccttgagtacccttctccaggtaatcgttgatctgtttcttggcctcttcggggtccccgaagttcacagtgaaggcttctgagtggtacaactttttaacatccccaaaaactttccctagcttcaggccctctctgaggaacaggccattgccgtgtggtcagctggatctgtctgtctgttgttagggtatgaggagcccgaagccttcatggatctgagcctccggaatctccgtgaggttgaaattcaggccctacaggatttcatcgtgagtgtcagccgtggtccacagagagagcattgccactcgtg

SEQ ID NO: 508412 - DNA, 105 bp, Homo sapiens
ccctccattgacagctccactgcagtcacttcccaagttgttccatgggctcctggctctggacggtggcccacttctccacattccgcccaatctgtacggatg

SEQ ID NO: 508413 - DNA, 995 bp, Homo sapiens
  misc_feature (367)..(367): n is a, c, g, or t
gtggctgcgacaggcgtgatcagagcaagatacagcgaaggacgcggaccgaggcatcgattgagtgccgaggttgtctcactccttgctgaaaactgtggggcaacgccgtctctctgaaggtggtactgttcctgcatcctgatgtgtggctggtagcagaactggcacgtgcccacaagtccagcgtcgggcgacgcgacgccgcaagcgtccgggagcataatttgcctatgaaatctccacggagagacaagtaggatactccatctgaagaccagaagtatacatgctatatgtaagttgatgcggtggtggacagagctgatacctatgatgcaaaacatggtaaccccatacatggaangttctgacatgaagtacaagatagggtttcacagagggcataagcaagttcaggtggcttgcctaaacatctagatgacattgtcaaaataataggcgactacaaaagctatactattcttggactcagatgtgacgatagcacccagaagacgtacatcctgcatctttgatgtggtcccggagtacgtagtaacaccgttgggcatgtgccccatgacatgtcaatgttaccaggaagtgttattgcgcttaaggaattgcttatctagagtaaaaaagttccaaataaggtaagcttccgattactatcgatgttaaaaaagtaagcctttaagtatgaatcggaggtctaattgataaataatcgctacgcgcgacaaagggaccagtatggtcccaaatccatctttacatagatacctatccagcggaaaagtatgatcccaggtcatagtgttcgtggaggtggactgagaaatggatctggggaggagtaatggcctcggagaaggataaggacctttttaatcgaatggacttctttgccatagttgtggtgaagcctagaaatgtgcccttgattttttgaccctccaatggcgcctatttcatctcctaagattaaa

SEQ ID NO: 508414 - DNA, 241 bp, Homo sapiens
gctctctactataaatacaaaaattagctgggcgtggtggcgggcacctgtgattccagctattttcgtatttttaggagagacaggtttcaccatattggccaggctattctcaaactcctgacctcaggtgatccgccctcttgggcctcccaaaatgctggcgattacagacaggagccaccatacctggcctggaactttctataaatgccacacaacatgttctgtgcagccgcgt

SEQ ID NO: 508415 - DNA, 234 bp, Homo sapiens
tgggagcccttcgcccaaagattcagtttggccaatttggggggttgtgtccccccagcccgcccgtcctttggggggcacagttccccttgttccctcctgcccgggttgaaaagcggggtttgggggccctttttcccttcaggcccctgtcctttttaaccggtccccttcaactgtattcccaccttcctgcccccgtcttttattaaagagggaccttcgggcttgtta

SEQ ID NO: 508416 - DNA, 785 bp, Homo sapiens
gggcgccggggggctgctggcgctgctagcgctgctgtgcgtggcctgcgcgctgggcggggggcgcgcccaatacgaacgctacagcttccgcagcttcccacgggacgagctgatgccgctcgagtcggcgctaccggctacagcagctggacaatgtagcagcgggcggaggctacgtggggccagagagcggtggtgctaccgtgggagatcacgcgtgggggcgtgcacctgcgttgctcgcgcagaacagctgaggcccttcatgccgacctgcaacatgcagctgcctgctgcctgcagcctctgagccctgccagcctggcgctccgccatgctagtccctgaggcgtgctgcactctttccggggtggccctggctgctgcctgctgctgcacatgcgctcgaatgctgcgtgcaatgcaggggcgcctgccatgcccttcctgcgcagtccccagcgccagcctgctgatggtgcatggctgtgacattccagctgccagcgaatgcccatacaatgttccgtgcgagttcgggcgttacttcaagggcgaagataagtctccccgaaatgccatctgccggctgctccacaccctttctaactggaagcatccctgatagacgaagatgatgaaggaggaacattggcatattataagagcctgcctggtgccgaggactacattaagacctggaaaccaagtcatatgaaagcctgttcatcgagcagtgcgggcataccacggtgagaactggggaacatccatcacagacg

SEQ ID NO: 508417 - DNA, 721 bp, Homo sapiens
  misc_feature (665)..(665): n is a, c, g, or t
ctcttagtgagattacacatgcgatgcgtcccgattccaagtgagttcaccctcctaaatcaccatgatcaaaagggacaagcgtcaaggcactggcctagctaatgcagctcgagcagagcgcttagcctagcccacacccccacgggaaacagacagtgattaacctttatcaataaacgaaagtttaactaagctatactaaccccagggttggtcaatttcgtgccagccaacgcggttccacacgagttaacccaagtcaatagaagctggcgtacaagagtgttttagatcacccccccccccccaaattaaagcataaaactcacctgttgagtgtggtaaaaaacctccagttggacacaaaatagactacaaaggtggcttaacatttcctgaacacaaaatagcttaaaacccaaagtggggattagataccccacttatgcttagccctaaacctcaacagttaactcaacaaaaactgttcgccagaacacttacgagccacagtttaaaactcaagggaccggggggtgcttcatatcccttctagaggagcctgtcctgtaatcgataaaccccgatcaaccttaacccacttcttgcttcaagccttatatacccgcatctttcagcaaacccctgatgaggctacaatnttaggcgcaaggtcccaccgtaaagacgttcgcgcaagggtgtagcccatgaaggt

SEQ ID NO: 508418 - DNA, 394 bp, Homo sapiens
gaggatcccccccgttaccacagcttgctctgtgtatcccgatttctacaaagtgaagtcaacaacggttatcgaatctactgtagcgctgtgccaacgaggagagacacatccttctagcgtcaccccaataaacaagcctgacagacattgcgaggggctgagcaggacgcagtccccatcctttccaacatgtctgtcgccttggaatctgtggcgcacagcccaaaccagcacgccagcttgagttcaattctccctccacttcttttcgccatgatccctaactccccatagcaacacagcggcgtgaattggttcctctgctgcactcggggctcttccttctcacctcatgttccgagaagatacatcttttctaacagaatgctct

SEQ ID NO: 508419 - DNA, 195 bp, Homo sapiens
gtggcggcagtgcaacccccttgttattcaggcagatgtcctgcagagggagctagagagctgcctaagaagagagtacacgccggaaaatcttcctctgcttctgctgcagcattacacagagagaattacgcagctggtccagaataaatatttgcacatgctgaggtggaggcggctctgccagaccagcgg

SEQ ID NO: 508420 - DNA, 996 bp, Homo sapiens
tttcatttggggggtgttaaggtaaatgatactgtgtttttaatttcacatcataattgtttattgtttgacaaagcaattgacttttgtatgttaactttgtatcctgcaactttgctgtagtcacttattagttccaggattttttttttttctcatttctttcagattgtctacgtagacagtcatgtcacccgcctaaaacagatagttgtttttttccttcccaattctacctttaatttctctttcttatcttatggcattagctaggacttccagtatgatgttgaacacagagtgataagagaggacattgttgccttcttcctgatcttagtgggaaaacttctagtttctcaccattaagtactgatattagacatgaggtttttggtacgatttttttcttttaatccaggtggaggactgttggtctatccctaagcttaactggagaagttttacatccatgagactggagtggtccgaatttccggtcaaaataacttcggcctcttatcaaatcctggatcccatatattttgcttccttttagagcctactggatggtgcgatgggattcattatcactctcaaattctctccaacacctttggatatcagcctgtgcatactctcaggtaacatctccactgggggccgggtgcgggggctcaacgcctgtgtctcccagccacttggggaggccgaggcaggcagatcccgaggtccggagatcgagaccatcctgctagcttggtgaaaccccgtttctactaaaactccgaaaaatttagccaggcgtgttgggccagtgcctgtggtccccggtaaccacgggagggtggaaaccggaaatgcggttaacctgggaagggcgaactttgattaacacgaaattcgggcccatgcacttcaaggcctggcttgaccagaagccaagagaacgtgttctccaaaaaaaaaaacagaaacggaacaacaaaaaaaaga

SEQ ID NO: 508421 - DNA, 81 bp, Homo sapiens
gacagcagcttctacatctgcagtgctcgggacagaagaaacactgaagctttctttggacaaggcaccagactcacagtt

SEQ ID NO: 508422 - DNA, 412 bp, Homo sapiens
cgagcatcgccgtcggaatgctgccgatgaatgcgagctgcagcagcacgtagatcagcgtcgacagcaggatcgacaggatcagcgcgatcgggatcgtgcgttgcggattgcgcacctcgctcgcgaccgacacgatcggcgtgagcccgaggtacgcgaagatgatgccgcccgcggacacggccatctcgatgcccggcatgccgaacggcgcgaagccttgcacggtcaggttcgcgggcttgaagaacgtgaacagcaccgcgatcaccgccagtggcacgatgaacttgaagatgctgatgatgttgttcgccttcgcgaacgtcttcacgctcgaatagttcaggtaaaagaagaagcagagcagcgcggcctgcacgagccagccgagcgtcgtcggatcgct

SEQ ID NO: 508423 - DNA, 127 bp, Homo sapiens
tctactatgttgctcaggctggcccaaactctgggctcagctgatctcctgccttggcctccaaagtgtgcgattaaggcgtgcactgcgcccggcatttattttattttttactttaatttttttt

SEQ ID NO: 508424 - DNA, 335 bp, Homo sapiens
cccatcctttgtcacagtaatagaattggcgcattcagacttattcttagataatttccaataatttttaaatcattgatctggcttggtaaatagctctccaatacttctacagctaatggaaaaatcacttaacctttactagaagtaacagaaagcattaaagttgaaacctaatgcagcagttctttccagtgagttgaactgccttagcagaaatcttcccattgagatacaggctttatttttattattatatttttggagacagtgtctcactctgtcacccaggctggactcacaactcactgcagcctcaaactcctgggctcaag

SEQ ID NO: 508425 - DNA, 150 bp, Homo sapiens
tcatgacggccaggcagcttcactcgacacctgggaaggtaaggatcgagatcaccgaatttgatcattttggcacctgataaccgggacaacattaacctcggtaagtgatttttggcctcatgccccatctgacctccatcttgaagc

SEQ ID NO: 508426 - DNA, 145 bp, Homo sapiens
tactctgaggatccctggctgttgtggacatctggtactccaggtcaccttgtgtggggggcacccccgtgggtgtaagtggtggttttcttgagcgtgtactggcgcccgcaggcctcatcctcctcctgatttccaccttgcg

SEQ ID NO: 508427 - DNA, 579 bp, Homo sapiens
  misc_feature (19)..(19): n is a, c, g, or t
  misc_feature (34)..(34): n is a, c, g, or t
  misc_feature (44)..(44): n is a, c, g, or t
  misc_feature (49)..(49): n is a, c, g, or t
  misc_feature (56)..(56): n is a, c, g, or t
  misc_feature (61)..(61): n is a, c, g, or t
  misc_feature (63)..(63): n is a, c, g, or t
  misc_feature (75)..(75): n is a, c, g, or t
  misc_feature (81)..(81): n is a, c, g, or t
gatgattgtgctagagggngagtgtagcggatgnctgcgagtanggagnacgtagnggtantncccgagttggcntggttnatcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaa

SEQ ID NO: 508428 - DNA, 181 bp, Homo sapiens
ttctttggagtacatccttactttctgcacaacagatgagagatgttccagaacttatactgtatcatatattttacctccccccctatacaccctgagatatacatatacactatctccgctagagagatgtctatgacatatcactttctgagatgtacacgaacgagatcttttgaga

SEQ ID NO: 508429 - DNA, 397 bp, Homo sapiens
agagaatagtcaacggtcggcgaacatcagtgggggtcaaaaaaaaaaaaaaaaaaaaaaaaaaaaaatttttgggccgcctggccagaaagtttttaaacccaactccggtggggcggcggcggcgcccaaggatagggttacggtacaacgcgggcaaattagcgcgggtccataagaagaaactccgggggccagcgactatggggctggggtttcccttacacaaatataaaaaaaaggcgcgggggcgacaccccggctgtttttgagaacaaactcttccaaagagtgggacgtcccgaggaggggtcattaagcgggctctcttacaacacaggggggctcaaaggagacgcctaggaaatattaaaattaacggcccggcagggtgaac

SEQ ID NO: 508430 - DNA, 270 bp, Homo sapiens
  misc_feature (138)..(138): n is a, c, g, or t
aggatcacgatggccgtggtagggttaatggcaggaaggcgggggagagcaagatttctgtgcgcagcttttcatacttttgaaccatgtagatggattacgcagtctatgcctatttgaaaattgaatttaattganaaaagagaaacacaaagttgcaacatatgggaaacaggagaggcttcagatcaagactcagctgggtttccagaaactcacaaagtgtccttgtctcttggcccctgtcttatctgtgaggcatctatacga

SEQ ID NO: 508431 - DNA, 910 bp, Homo sapiens
  misc_feature (128)..(128): n is a, c, g, or t
  misc_feature (131)..(131): n is a, c, g, or t
  misc_feature (162)..(162): n is a, c, g, or t
  misc_feature (170)..(170): n is a, c, g, or t
  misc_feature (201)..(201): n is a, c, g, or t
  misc_feature (303)..(304): n is a, c, g, or t
  misc_feature (306)..(306): n is a, c, g, or t
  misc_feature (308)..(309): n is a, c, g, or t
  misc_feature (313)..(313): n is a, c, g, or t
  misc_feature (315)..(315): n is a, c, g, or t
  misc_feature (318)..(319): n is a, c, g, or t
  misc_feature (323)..(323): n is a, c, g, or t
  misc_feature (345)..(346): n is a, c, g, or t
  misc_feature (353)..(353): n is a, c, g, or t
  misc_feature (356)..(358): n is a, c, g, or t
  misc_feature (367)..(367): n is a, c, g, or t
  misc_feature (384)..(384): n is a, c, g, or t
  misc_feature (406)..(406): n is a, c, g, or t
  misc_feature (410)..(410): n is a, c, g, or t
  misc_feature (412)..(412): n is a, c, g, or t
  misc_feature (417)..(417): n is a, c, g, or t
  misc_feature (423)..(423): n is a, c, g, or t
  misc_feature (425)..(425): n is a, c, g, or t
  misc_feature (429)..(429): n is a, c, g, or t
  misc_feature (438)..(438): n is a, c, g, or t
  misc_feature (449)..(449): n is a, c, g, or t
  misc_feature (453)..(453): n is a, c, g, or t
  misc_feature (456)..(456): n is a, c, g, or t
  misc_feature (471)..(471): n is a, c, g, or t
  misc_feature (473)..(473): n is a, c, g, or t
  misc_feature (477)..(477): n is a, c, g, or t
  misc_feature (479)..(479): n is a, c, g, or t
  misc_feature (489)..(489): n is a, c, g, or t
  misc_feature (495)..(495): n is a, c, g, or t
  misc_feature (498)..(498): n is a, c, g, or t
  misc_feature (500)..(500): n is a, c, g, or t
  misc_feature (883)..(883): n is a, c, g, or t
ggctctgggcactcagcatcgtttccttttcctccgctggagcagctatggcggcggtgaagaccctgaaccccaaggccgaggtggcccgagcgcaggcggcgctggcggtcaacatcagcgcaggnggnggtctgcaggacgtgctaaggaccaacctgnggcccaanggcaccatgaagatgctcgtttctggcgctngagacatcaaacttactaaagacggcaatgtgctgcttcacgaaatgcaaattcaacacccaacagcttccttaatagcaaaggtagcaacagcccaggatnntntnntttntnatnntatnatttttaattttttaattattnnagagctnttnnnatatgtggntttttatattttttaangcttttattttataataattanttantnatttnaatttncnaatnaaaatgccntttattttttngaanaanttaaagtaagcagananattnanagggaaacanttatanatntngccataatatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactggaaanggaagtctgtggcgattcagataaagg

SEQ ID NO: 508432 - DNA, 728 bp, Homo sapiens
atcgagggcgtcttcaccaacggcagccgggtggaggtggaggtggacatccactggcagccgggccaaggagaaggagaaacagcagcacctggcttcaggtgccagcagaggccagtgatgagggcattggcatcagcgccaacgaggatgagccaggtcttggccaggaaggagacttctctggcgttgggaccattgggcgccggagggcaatggtctgttggcgccccaggaaaggagccacaattgtgattggaggttggtacagacgcacctcttcgaaagcctggaggctattttgctggcccggctcagcggattctggatgatcagtttatcatacccccggagctggaagaggaggtccaagaaatcatgaagcatcacaggagcaacagcagcagcagaagcgcacaacccctcagctcagccgaggctgccggggcactaccagctggaccagctgcagattattaacgacacgccactatgaaccagcgagctgttaacaaataaactaacacaaaagactgagttgcaagagtctcccagggtcacatttaaacagggttttactccaaatcttccccaagaactgttcgcaagctgtcatcgcagctatctgtaggtctcttcttgggtaaatttaagtatcaccactttcttctagtgatgctttaccatatgattaccttggtaatctccccctacatatagatttgtag

SEQ ID NO: 508433 - DNA, 953 bp, Homo sapiens
cctgttgctggggagaatcatcttacaccccccaaaaaaaaaaaaaaaaaaaaaaaataaaaaaaaaaaaaaaaaaaaaaaaaaaaaaaaacaaaaaaaaaaaaaaaaaaaaaaaaaaaaaaaaaagaaaaaagacaaaagcagagagaggagcggcgcggaccacagcaattattgtcactcgacgggagggacagcagtcaatctctagacagtaaccaacgcgatgtgttagtgatctatgaagagagagtgagcggagagcgctattatactgcgtgaggtcaggttgatcattaatccctaccgaagcgcgcggagtcgatatcttgattttggttgagtacaattcgtatgatgttgtggagagaggtgaataaaatagaaaaaaaaaaaaaaaaataaatactttacctaaaccacaaacagataccattcatatctattttatccagcatataaaggagaacaaacatatccgtgtcgtctgttgaaactaccaacatacaattctatcctctatactttcaatatgtaatatatctatatcactcatatcataatcaatcaaatctcatattataatattatatttcataacggtggtctgaaagacgactgagagatgagagtgagagacgagggaggggagagacaagaaaaaaggggatgctccggacggggtatgtaagtgtagtggtgcggaggcgaagcgaatagctaacgaagagggagcgatgatttgttgaggtgttgatgtagatcgagtagagtatgtgcggctaggtatatagtatagtggtctgaaagaggaatacgaatatactgatcatgtttatagaacatagatcagtgcagcgtgaggagagaatgagagataaatgaaattacgcatgaagccaccagccgcgtcacatagatagactgagtcgagatacgacccttcacgtcca

SEQ ID NO: 508434 - DNA, 558 bp, Homo sapiens
  misc_feature (279)..(279): n is a, c, g, or t
  misc_feature (281)..(282): n is a, c, g, or t
tttttgtttataccaatcccccccccccctctcgagagtggaagaaaccaggttctgagatgaaggtgtctctcagaggaaagttttttggatggcaaagagggtccaccctgggctgactgccaaactgtttccaaagttacacatatagtacaggttgtggtaagaagtacccgggggattcacccattcccgaggccttccggggagtgcatcggtacttgaacaatgcctacgccccggaagaattcgcttccacctggtccagatgaaactgtngnncccagtccctatgagcaaggggctaaggccctgaaatgagcccgttctgggagtcccccccaccccctcattttctccacaaaggccttggtggtttccacattgctacccaatggacacactccagaatggccagtgggcagggaatcttggagcacttgttccgggatggtgtggtggaagaggggatgagggaaagaaatggggggcctgggtcaaatttttattgtggggtgggatgagtaggacaacatatttcagtaattgaacacagaa

SEQ ID NO: 508435 - DNA, 97 bp, Homo sapiens
  misc_feature (50)..(50): n is a, c, g, or t
  misc_feature (88)..(88): n is a, c, g, or t
ggcgggctctgcgtgcgcaccggctacacgcccaacgacgagtgcttctncatcttcctggacgtcagcagggacttcgtggccagcngggcggagg

SEQ ID NO: 508436 - DNA, 133 bp, Homo sapiens
tgaaagacacatcagcatggaagactcgagttaccttagggtcataccaaccaatacatatatgagcagcagcaaatattgtactaggaagtgcacagattggccaggagtaccacaacatcagataatcata

SEQ ID NO: 508437 - DNA, 766 bp, Homo sapiens
  misc_feature (27)..(27): n is a, c, g, or t
  misc_feature (81)..(81): n is a, c, g, or t
  misc_feature (109)..(110): n is a, c, g, or t
  misc_feature (119)..(119): n is a, c, g, or t
  misc_feature (264)..(264): n is a, c, g, or t
  misc_feature (286)..(286): n is a, c, g, or t
  misc_feature (303)..(303): n is a, c, g, or t
  misc_feature (310)..(310): n is a, c, g, or t
  misc_feature (320)..(320): n is a, c, g, or t
  misc_feature (322)..(322): n is a, c, g, or t
  misc_feature (327)..(327): n is a, c, g, or t
  misc_feature (338)..(338): n is a, c, g, or t
  misc_feature (342)..(342): n is a, c, g, or t
  misc_feature (350)..(350): n is a, c, g, or t
  misc_feature (391)..(391): n is a, c, g, or t
  misc_feature (410)..(410): n is a, c, g, or t
  misc_feature (425)..(425): n is a, c, g, or t
  misc_feature (427)..(427): n is a, c, g, or t
  misc_feature (493)..(493): n is a, c, g, or t
  misc_feature (497)..(497): n is a, c, g, or t
  misc_feature (499)..(499): n is a, c, g, or t
  misc_feature (517)..(517): n is a, c, g, or t
  misc_feature (521)..(521): n is a, c, g, or t
  misc_feature (542)..(543): n is a, c, g, or t
  misc_feature (552)..(552): n is a, c, g, or t
  misc_feature (565)..(565): n is a, c, g, or t
  misc_feature (570)..(573): n is a, c, g, or t
  misc_feature (579)..(579): n is a, c, g, or t
  misc_feature (590)..(590): n is a, c, g, or t
  misc_feature (608)..(608): n is a, c, g, or t
  misc_feature (653)..(653): n is a, c, g, or t
  misc_feature (669)..(669): n is a, c, g, or t
  misc_feature (672)..(672): n is a, c, g, or t
  misc_feature (706)..(706): n is a, c, g, or t
  misc_feature (711)..(711): n is a, c, g, or t
  misc_feature (728)..(728): n is a, c, g, or t
  misc_feature (766)..(766): n is a, c, g, or t
tataatttaactataaaggtccaattnttcacagagccagtttgggatgggctgcattccatttatgctgtatatagtttnaattatatataaattaccccttcttctnnccacccctnctcccatcttagtattttgcaagatctaatcagttgtacacctggtgcccctcgcttgcttcaatcatggttatttgatggcaaaatcgacctcttgtcgctgaaggagagagaaaagatgtgtgtctgattggccctgggatcntttgagctgtgccatttatggnaccctttgcctatgcanccccctnttagatcccncntaaantttatctcacngccnttataatntctattgggaagaggcttgtgaccagtaccaatcttgagtntctttttctgcccacaagnaaaataatatccgcncngaaatgtcatttatccactcacacattcttggggaaaaaaatcaaatgtcagccctagcagatgtngcangnaaattggtagcaagtaangatnacaacccagaggaataagaannaaaaaacanaaagccctatgtnttaannnnttatanacaattagganaattagcattgtcagacnataaacctttgctttttaaagtttatttttactatttctttatcnctttattgtatcatcnccnttggtttcataatgtaaaaactatatgttgaacnaattnaatgtcaaaattttttnttaccatagtccatgttaatagtggggctttcaggtgn

SEQ ID NO: 508438 - DNA, 377 bp, Homo sapiens
aacgggtgatgcggttggctgaaggctaagttcccttccaactttgagatttctgctcaaagatggtaaacatacagtagtctctgcccttatccctggtttcagttatccactgtcaacactggtctgattatttctggaatttttttttttttttttttgaaacagtgtctgtcacccaggctggagtaccgtggcacgatctgggcccattgcaacctttgcatccgggtttaaagcgattctcctgcctaagccttaaagtagctgggattacaggcacccaccaccaggcccactaattttttcgtatttttagaagagacggggccccaccatgctgaccaggccggtcccgaacctctgaccttatgatc

SEQ ID NO: 508439 - DNA, 345 bp, Homo sapiens
  misc_feature (66)..(66): n is a, c, g, or t
  misc_feature (161)..(161): n is a, c, g, or t
  misc_feature (309)..(309): n is a, c, g, or t
ggccaccctgtgttgagcaagtctgttggtgctatttttccaacatgtattcacttcatgtctgtntgacacatactggtaaattctcacaatatttcagactttgtcattatatctgttatggtgatctgtgattagtgatcttcgatgttactactgtnattgttttagggcaccacagggcacacccagacacaacagtatttaaattaggtcaattaataaccccacagtggcctctgagtattcaagtgaatggaaaagtcacatccctctcatttttaaatcaaaacctagacatgattaagnttagtgaggaaggcatgctgaagttaaaataggcct

SEQ ID NO: 508440 - DNA, 426 bp, Homo sapiens
tccccgcggcctgccgctgcgagctgtcatgcccggtccctttcttggcgagaaagaccatgcgcctggcttctggctactctctcagcactgcaggctcctgaacaaaatggtcgggcttgggatcctcctcgtcagcattgtcttcctcaccgtcgtcatcctcctcctgcccttctctacgcactttggttctcagcacctgagggatggtgaatggcctgcgtgctgatgagctcgtcatcagagtctgcatcattggcgcccaccttgttgacatcgtatgtgtcatcgtactcttcctcatagtacacactgtggtaaggcaggctctcgcctggctgccgtggcacctcctccaccaacaggctatactgttcgcagctgcggccgcgggctccgagctccacttcgttatccctgtcc

SEQ ID NO: 508441 - DNA, 188 bp, Homo sapiens
ttgaaattgctaaagggaaatttttttatggtaatgctcttccggatataagcctcagttaaatggaattatttatgggatgggtggttctggttaactaaaaattaaccagtaacccctttgtagtaaccattccagaaaatacttttgccttaaaaaatatgatatgccagagatgagttagtgtt

SEQ ID NO: 508442 - DNA, 215 bp, Homo sapiens
aggcacagccctccaaggagcacccagctgcctggaacaggacttcaggaaaaggagcatcgtgactggtgacagatgtatggtgtctgcacatcctggctgagaagttcagctgtgacgacctggcctagacgaggtcattctttttggagcatggagttgcacacagtgtgtcagtatgatgcgcaggatttcactgtggacacagcagacta

SEQ ID NO: 508443 - DNA, 396 bp, Homo sapiens
  misc_feature (209)..(209): n is a, c, g, or t
  misc_feature (264)..(264): n is a, c, g, or t
  misc_feature (354)..(354): n is a, c, g, or t
  misc_feature (371)..(371): n is a, c, g, or t
gttggccgagttgattttctaaggcctctctccttggcttgcagatggccattttctccctgtatcttcacacagtctttcctctctaggtgtcatctgtgtctaatctcctcttattataaggatactagtcaaatcagatttgggcccatcctaatggcttcattttaagttaattatttctttaaaggtgctatgtccaaatagtnacattctcagagagtaggaattagaagttcacacatgaattttgggagggacaanattcagcccataacagaaatcatgggtataacttttatttttcaataacagtactttgatgacattggggctggttcttccattttaaanggaatacaacatgtttnagaccacagcatctgcatggctgtt

SEQ ID NO: 508444 - DNA, 287 bp, Homo sapiens
tggatctagaggaccctatggagaccaggctgagctctgcgatgacataagccccagccaacattttgactgcatcctcatgaaagaccctgaccgagcactgcccaactcggcagtcccgaattcccaacccccagaaactgtgaggtaataaacacttgatgttttaagctccattttggggttatttattttatttttttgttacaactttttttagagatagggtctaactgttgcccgggctggagtgcagtggtgcgatcacagctcactgcagcctccaa

SEQ ID NO: 508445 - DNA, 692 bp, Homo sapiens
gtgatctaccatgcattgtctcagaaagaggcgaatgactcccgatgttcagccttcaggagcacaggggccgaggcccttcgttgagggtcttcccttgaaagcgcatgcacgccgcctggaattgatgccccgaaggccccctggcgaaggcacccaggtggcagcggcaaaggcgcggggtggttccctggaagtacttcacccgggccaaaaaagcggcaaggggagcaagcgaaacggcaacagaaaaagggccccaaaaagggggggccattctttctgggcccaggccaacagggagggagctggcggcctcttggcaccataaaacccagagcagcaagagattacaggctctttcccttccccttcttccgagtggacgctcgtggaaaacgccagttaccaatcaggggcacctggttcgcaggtgggggcttcaaaggcgccaagaaacagacggcaagaccaacgaaggatggatttcccaagtgccccaaaaggctttcttttaaaaaaaggggccaagaatttccttcaccacggggggcgccctaattaactttcacaaggttgtggacacgcaaaaaaaattttcccaaaaatattgtggccccccctttcttttaattggtgccggtaattaacaggggaacattcctttcatacgggaaacacaacaggcacat

SEQ ID NO: 508446 - DNA, 389 bp, Homo sapiens
  misc_feature (276)..(276): n is a, c, g, or t
  misc_feature (283)..(284): n is a, c, g, or t
  misc_feature (324)..(324): n is a, c, g, or t
  misc_feature (355)..(355): n is a, c, g, or t
  misc_feature (379)..(379): n is a, c, g, or t
ctgacctagaggacccagcagctatccaagagtctcttaattcctttctctggatgtgacctctctgcaagattagggaaattttcctgaataatttccttaagtatgtattctaagtttcttactttttctttttctctctcaaggaatgccagtttgtcttaggtttggccactttatataatcccatatttcttgaaggctttgtttcttaaagttctttttttgtttatcttttgtgtgactgggcctctaatttgaaagacgggtattcanagctctnngaaattcctttttctgcttggtctaagtactattgttaanagcttccttgttgtattcttgaacaatcctngtagttacaatctttcaattccangaggttccac

SEQ ID NO: 508447 - DNA, 174 bp, Homo sapiens
ggactctagcaggcatcccccacctgcgcggtgcaggtggcctttgcattggcagcagcccgtgtctctagttctcagctcagagttggggggcttgcaagatgaccggtgcagggtggccaggtgcaggtgtgggcctccggtgcaggtgtggcctaccggtgcaggtgtggg

SEQ ID NO: 508448 - DNA, 1536 bp, Homo sapiens
  misc_feature (115)..(115): n is a, c, g, or t
  misc_feature (610)..(610): n is a, c, g, or t
gccacgccgcacccacgcgccacgcgcacacacgcgccctccctccaacgcagcgccttccctgcgcctgcgcctcctgcgccccctacacgcccccccacgccccacgcacgcngccccctgcccctccctccctccctgcgccccctgcgcgcgccactcccaccccccgcctcctgcctctcctcgcacacgcgccacgcaagcccccccacctctccctgctgcgcgccctccacccacacgcaccacccaccgcctgcacacgcgcgcgcactccactggccccctgcccaaccccccccctgcccctctcctctccacgccccacgcctacacacacacgcccccccgcacacacagccccctgcgcccgcagcccacctgcgccccgcacgcccctgcgcgcacgcgcgcccccgcacgccccgcgccacaccctccccacccgcctcccccctcgcacgcacgccacggcgcacgcccccttcctctcacacgcgcgccctgcgccaccctgcggcctccctccacgcccccctacactgcgccctgcacgcgccgcgctacccccatgcgcccttctcactcactgccacttccttccacnctgccctcccccacccctgccacgcggcgcgcgccacgccgcgccacacgcgcgcgcgcgctcctcgcgcgcacgccccccccctctccactgctgcttgcgcgcgcgcccgcacgccttgcgcgcgcgccccccccacctggcccccacctctcctgggcacccctccgcccctgccctcccaccgcaggcctctctacactacacaccgcgctagcccaaccactggcctctaactctggccctacgcacgccccctctcttgccaaggacacccaacacacacacacacacacacacacaacgcgcgcgccgcgccgcccccggcccctctctacgcacggctcatcctcccccctcttcccgcaccgctgcgcccccccaacaacagccgcctctttacacccgcccgtctacccccccccacccctctttccctctgtgttctcccccacacgccggtgtgcggctccccctctcatctacccttcgaccgcctccgcctatctccatcttacccccgccttcagccgccacgctgggccccccggcgcccgccctcctctcacccacacccggcccctgtctgcacttcgtggccccgccacacaccccgtgcccctcaacccccctgctgcgccgacactccctctcgcgccccgacccgcggccccccctctctcaccctcctcctgcgcccgccgtctggctcccccctcttccttgtcggcccccccccccttcacccccttcccacgccgcactttcccaccccccccctccttcccgccgctccgcccttcttccccccccctctcctcccccgcgtgcgccaccctccccgcctctccctcccccactctagcccctggcccatttttcgcctccgcccccgtccgctggccccacctcttccgccgccctcc

SEQ ID NO: 508449 - DNA, 163 bp, Homo sapiens
caggaatggtgcagtggcttatctatctctgggcgagaagccaacttcttcttcgaccggaaaattttgaccaacccgatggtgagcaaagacaagaacatcacctacttccggaacttgggcttatggctaggggtgtgcggcagtgtcctggccctcccag

SEQ ID NO: 508450 - DNA, 358 bp, Homo sapiens
acactagaggatccctccttctggccacgctaacggacatcacctgctgggtcaataggcataagtgttttcaaaacaaaaaattaaccaattagccaggactggtaggcccacacctgtagtcctagctacctggggggctgaggtgggagaatcacttgagcccaggggtttgaggctgcaatgagctgggaccacaccattgcactccagcctgggcgacggagtgagactctgtccctaaaaaaaccgaagagaagacagtcattttaaaaatatttggtcttcaaaaacccagaattgaagaacacaagtatctggcatgacgaaaatatcctacaaggcgtggccagaagga

SEQ ID NO: 508451 - DNA, 1643 bp, Homo sapiens
tcgtgacaggagctctactggtgatcctgtccgtttgcgctagtgtccccccgtgttggtaatgagttggttgtgccgataggcctacttcagtgtgtcatgtacacgtgtgtctggcgagtgtcctgtaaagcgtcgctctggtggcaggggttgtgccatcactatggccccgcactatgcttggcacaatgtggggtgtgtggagtgctcgggtgcaccccaagtgggtaaggaaggcgcgatgaaggtcacactagtggcccattcctgtgctgggctaaagcagccgttgcaactaattgggctatgtgggggtgtccctggcctgggtcctgactaagggtttcgctagcaatggccggcgcatgtggtcgctcgtactggggtaaggggtgctcagagatatgtccctgtgctttcgggtcgataatgtgcgccttttgccggttatgagtctcgggtgacccatggtgtgtgccagtactatgtaagcgcgccgcgacttgcgagtgtaaaatgcgcgagcacgagttggggtttggtgcgagcaagagtgttggtatgttgcgccggttaggtaaaggacgtcgttaatggccgtgccgtggttgcgggataggacacgagctggggctctggatagagtatgagaatgtattagggtttggagcggtggctagtgtgctctgatagtgagtgaatttggagaaggtaggttcgtgtgtgtatatgagttcgtcactaggtatgaaaggatatagtgccgtgtggttgttggtcgttgtttacgcaaggcgcgtcgtagtgaagtttgtcgattgctaatgttgagtagtcgggggtaacagtaatggttgtcgaatgaaggacaaggttgatgatctgttgggaagtggagactgacgccgttcgtatgttgggatatatgggcccttcgccctagggcagaagtccgctggtatgcccggagggttgttgtgtgtggccgcgtgaagacgttgtggtgtgtcaacctcgtgctaggcgggaaatgaagttggcagtatagattaacgagtgctcaagtgtagtacattggctcgaagttgaagtgcatcgtgagatggaagggcctgtgggtctgtggagatgtgggcacaggtgtggatgttgtgtggtcaagtgtagacaagtgtgtgggatagtatgagtggagagtgtgttgataggtgcaggattcagtcgttacgcgtgtgagagcttgtctatcagatagcgtggactcagctgaagcagagaagagtggagccgcgccagtgtgtggtgctgagcttttcaggtgtgaggagcagcagttatgcgcatgagagtgatggcagcgtgataagggccagtcaaatgaagttggtgtgacacacgatgatccaatcttgcgtcaagatagggagcgccgcgaagtctggccttggcggaatatcgtctttgacagagcagcagccctgggagagcagtgaaaagtgaaagcgtaaggcgtcgagggctaattgtcccgcataggccgtggggtgacttgcgctggtcagccaaggcagtgcatgacatgttggggtttcctttaccttttctataatgttgtaccaagaacatccagcttatagttt

SEQ ID NO: 508452 - DNA, 489 bp, Homo sapiens
tatactcaaggtctctgatgtggacaagcgtacgggacaagagaacacgatcctatcactaatgacacgggccgttggagcaaggcagacattgcccgtatggtccaggaagctgagaagtacaaagctgacgatgagaagcagagggaccaggtgtcctcccaagaattccacttgcagtcctcatgccttccaacatgcacagcaactgctcgaagcatgagacacttccaaggccaagattaaccgatgcaggacaacacagacagattctgtgacaaagtgtacatgaacattatcaacttggcttgataaagaatcagactgctgagagggaagaatttgaacatcaacagaacgagctggagacagttcgcaaacccatcatcaccacgctgtaccagagtgcaggaggcatgccaggaggaaatgctgggggatatcctggtggtggagctactccctctggtggtgttcctcagagccacc

SEQ ID NO: 508453 - DNA, 796 bp, Homo sapiens
  misc_feature (401)..(401): n is a, c, g, or t
aactgtatgtgctaggtactgatggcatggtgttgttaactctgtgcactgatgggctgtgtgctggtgtgggtcccagtgcctgctggggctgtgtgctgggactgtgctgtggctgcctggctgccgatcagccagtagacatgactgagcatcaaatgcctttactgcttgtctactgcatgtgtgagcgtgtgagctgctgatgtggctgacaatggagctgctgtcaagcatatgatgttgctgttggatgtgctgcgtgcagtggacctctactgtggtgcaccaactgacttgcttctgtctaccacttcctgttgtgatgtgatgagggccatgttgcctgcttgtggccagccactgttcactgccaccaaacatgcttgcatgatgacacnttgtggcttcagatgaatgccctgtgaagctgagcttgctgttgcttgtgcctcatgcagctcaacatgtgcttgcttggtgcttgtgttgacaactccatcatgcctggtcaacattgcttgaacctcgatgccatgtgccttcggtggtgccctgcatcaatgggggcatgccactgtttgcacttgaactgagaaccctgttgatgtgggtgaccccttctgtgtagaatgttttgcgatcatctcttgtcaaacggcagaaccatccagattgtttctggtgtactgaggaccttggtgcagatctgtcaaggcagtgtgtctgactgccggagcagcccctcgctgtggcttgtggactggccacttcctgtgtctggctctgaccactc

SEQ ID NO: 508454 - DNA, 354 bp, Homo sapiens
tgtggccccccaacatttatgagaatggacatgtttgcatttccattcttcatccgcctgtagatgacccacagagtggagaactggcttctgaaaggtggaatcctactcataatgtgaggactatcctattaagtgtaatctcactgcttattgagcccatcaccttctccccagccaatgactaatcttcagttatgttcaggaaatggagagacagtaaaggaaaacacaaagaatatgctcaaatgattaggaaacaagttttatccactaaggccgaaacagaaaatgatggagtgaaggtacccacaacacctgtcggaatactgcattaatactaatgtgcctcca

SEQ ID NO: 508455 - DNA, 272 bp, Homo sapiens
gaaaaatgttttttaaaattcgagggccaggcacagtggctcaagtctgtaatcccagcactttgggaggccaaggcagttgatcacctgggtcaaggagttcaagaccagcctggccaacatggcaaaaccccgcctccactaaaaatacaaaaaattaaccaggcatggtggcacacgcctgtagtcccagctactcaggagactgaggcagaattgcctgaacctgcggggcagaggttgcagtgagtggagtacactgcactccagcc

SEQ ID NO: 508456 - DNA, 580 bp, Homo sapiens
cccggtggctgccgacgcttggttggtcaggcagctgcaggtcccgcctgttccagtgacatggacccgggcccggcccaccggccccctggcttgggaaggcgtgggccatcactggtcctcctctggcgcgtcccctaggcctccccgtcctctgtcgtaacctcatgcctctacactgttcagcggtggaaagattgatataacttttaaaagttacttactgctttgaaataaacggacgtttgagctcacgtggcggccatgcatggttagtggcggaagacggggcccattgcggatcccccagcgctgaagcacggggttcagcgtgtcccccagtgctgcaggtgccgccaggacgggccacgtgggccccccgagcctcccccctcgggcgcctccaacgacccggagtaggcgcgcctccgggaccattgaggactgacccaggcaacaattccaagacccaacaaagtggcttccaacaagactttttctcaccggggaaaccccacttgttgtcttcttggaaacgctattttagaataccacttactctaccaaagaaacagctaac

SEQ ID NO: 508457 - DNA, 1166 bp, Homo sapiens
ggacgcgtgggtcgaccacgcggtcgcgagccacgcgtccagcccgcgcggaagggccctggacccgcgcggctccctggtggataggtgagcaaggcgctgctgcagcctcggtgtctgccgtcaaccgcaggaggatgaagctagctgctgggcatcgccttgctggcctacgtcgcctctgtagggggcaacttcgttacatatgagctttctactcaacaggtctatccaggaaaatggtgcaactcaaaaattgacaagcacagattgaagcagatggttgaaccactaaagagcagaaaatcaagaagcattaggcaaaagaagctttacccagaaataccaccagtcaacgttttaatcagagaaggatcggaagacgactttggataacaggaggcgcacgggttcgtgggcatcccatctaactgacaaactcatgatggacggccacgaggtgacccgtggctggacaatttcttcacggggcaggaagcagacacgtggagacactggatcggacattgaagaacttcgagttgattaaccacgatgttgtggagacccctctacatcgaggttgaccaagaatataagcaacagggcatacaccaacatcccgttcaaactacgtgtataatcctatcaagagattcaagaccaatacgactgggcacatacaacatgtaggcgctgggcaaaaaggagctacggcgccggcatggcaccaggaccaccacatcggacggggacaggcgaatcatgaagacacactacaaagaggcagatacagggagcaccatacatcacataggcctcaggccggacagaaaaggaaacagattacaaaaaccaggcagcgaaccagaaacaagaagatgaaataccaggacacaaaaaacacacatggaccggcggcaacaacagaggccgacagacggacaagacggagagagggacaaggagaccacacgcgacacgcacgggaccacgcggagcaaaacatagaacaattagtagagaacaacaaaggcacgaaggcgggaacaaaacgcagccagcaacaagacgaacgaacactagcatgacaaacacagcgcggggcagaccatcagccgactcggtcactgacagcacgcaaaagagaagaaggcggagcgcac

SEQ ID NO: 508458 - DNA, 141 bp, Homo sapiens
gaaggttagcgtatcgatgggcagtgaggggcgcatatgatctaggctattatatcgggtatagtagcgctacgttacacggtacttagactatagtagatggcaattaaaggtgatatgatcggcgagattgtatgatga

SEQ ID NO: 508459 - DNA, 494 bp, Homo sapiens
ggtgataatcgatgtcactaaggtctgtgcattctggatcaggcactggagtgtgcgtgtgtgacttcttggcagagcaacgcataacatacaatagtggtggctgcgtcagtcagcctgggtcccgagcatcccagccaatataatggcaggtactgtgagagggaaataacttgtggtgtactaaggcacttgaaattgggcaggtgtttttttcacggttcggtaacttcagctcacatggatggatacgcacattgttttcatccaagataataataactaatagtacttgggcatatgctatgtgccaggtgcgtctgggttcacattttgcactaccctagaacatacatattattattaatctcatcatttagatggggaaactacggttagacatgttaagtaacttacccaaggtcacccagccagtaaggggaagggtggggatttaaacccaggtacacgtgacttcagagcttgagctctta

SEQ ID NO: 508460 - DNA, 353 bp, Homo sapiens
ctagtgcaggccttaaggtaatttctgtttgtgatatgaagtatggatccttgtttcctttttttttttggcatatcaggagccaattgtcctaccatcattggtggcaaagtcaacccttttttccgctgcccctttgtaaaagttcactgtcaatattcatgagtttatggctaaaccctgtattctctcccatcgatctattggcctgcctttatacaaatcccacagggttttgatcctaaacctttataataattctcaggatcaggtaatattagcccttcaccttgggccggttttaacagagaggttggttttggttttggtttttttgactaccctagggtatc

SEQ ID NO: 508461 - DNA, 423 bp, Homo sapiens
aacgtgatgcggttgggaaaagagcacagctttgtggctttgctatggactgaatatttgtgtctccccactctgccaaattcatatgctgaggccctcatccccaatgtaatgatatttggaggtgaagctttggcggggaggtaattaggtcatgagggcagagccatcatgaatagggttattaatgcccttctgataacagaagagacaagagagattatttctctgtctgccaggtaaggacatagccaggaagaaagccctcactggacaccaaatcttggcgccttgatcatggacttcccagcatccagaactatgagaagtagatgtttgttgtttaagtcacccagtttatgatcagtgttatacagccgactaagacaggggtaaacagacctgagttcaaatactggctcc

SEQ ID NO: 508462 - DNA, 890 bp, Homo sapiens
  misc_feature (2)..(2): n is a, c, g, or t
  misc_feature (745)..(745): n is a, c, g, or t
  misc_feature (833)..(833): n is a, c, g, or t
  misc_feature (849)..(849): n is a, c, g, or t
angaatcggcctaagtgttgtgtgcctgaggattttctgtgtttctgggaaccattttggtaactgagagttttctagaaagccacctgtttggtccctgttttctcgtggattcgcacagagtaaaagacagtgctcttaccattatttccatttccttgttctgcctgtagctatttctacttttacatttctgtttatgcttcctttttctggattagtttacacactgttttttgtctttttctttgtgagacaggatcttgctctgtctgccaggcttggagtgcagtggcacaggtatgattcacttgcagaactcctgggctcaagagattcacctgccttagcctctcatgtagctggggaccacagtgcttacggccacacctggtgcttacggccacacctggctaattttcttttcttttttagtggagacaaggtctcactttgttgcccggtctggtcttgaactcctgaaattcagcgatcctcccacctcggcctcccaaagggctgagattacaggtgtgagccaccatgcccagccactgtatttcctttttaatagtgtcttttactgatttggtttctacatattctggaatacttttaattgcatttttatgtttaattttttcagttgctcctaacttttagaaatcggtaggattttgtatcctaattacattttaataattctgaagtgtcaacgttactttctaatcatcaggaaagtcantgggtagcaaagaatatcccaagatttctctgcatcttcctctgagacattgagtaaagtcccatgccagcctcaggaggccttgcantgccggaggatcagcncacggtctgggcgttggacagcctgggtgttgaccacagcg

SEQ ID NO: 508463 - DNA, 465 bp, Homo sapiens
ctagaggatcttatggagacgggttcactctgttgcagttggaatgcatggtaagatcttggtcactgcaacatggtatctgacatatgcaactccagctcccgggtcaagagattctcctgcctcagctcccgagtagctggcactacaggcgcccaccaccatgcccagctaatttttatattttgagtagagacaggtttcaccatgttggccaggatggtctcgatctcctgacctggtgatctgctagccttggcctcccaaaatgatgggattacaggtgtgaaccactgcacccgacccacattttcccctttttataaggacaacagtcatattggattagggctcaccctgatccaggaacacctcattataactaattacatcagctatgacccttctccaaatcaggtcatgctctgaggtgctgggggttaggacttcaaaataggaattgtg

SEQ ID NO: 508464 - DNA, 480 bp, Homo sapiens
gactatagagcgtggtcatcctggagaaggccaccaaggtttaacttcaagcaagttagataccatggcaagcgtttatgtcaatgcgcagagctgacgctccgagcatgagaactacgatgatgccttgtcggttgctgctaaaggccacggacgctgtccatgcccgccgggccgagtactttgatggttctgagcccgtgcagaaccgagtgtacaactcactgaaggtctggtccatgcatcggcgacctggagagatgagcctcgagtcaccttccagtccaccaaggccgtgtacgaccgcctcctggacctgcttttcgcaacaccccagatcgtcatcaactatgccatgttcctgtaggagcacaagtacttcgagtagacgcttcataggcgtacgagcgctgccatctcgctgttcaagtggcccaacgtgtccgacatctggagcagctatcttatttcacaatcggt

SEQ ID NO: 508465 - DNA, 616 bp, Homo sapiens
  misc_feature (471)..(471): n is a, c, g, or t
  misc_feature (559)..(559): n is a, c, g, or t
  misc_feature (575)..(575): n is a, c, g, or t
acgttgacacttcaggctcgcacattaaagccactctagtttttatttatttttattttttagatggagttttgctctcgttgcccaggctgtagtgcagtggcacgatctcggctcaccgcaacctccgcctcctggattcaagcaactctcctccctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaattgcatttttatgtttaattttttcagttgctcctaacttttagaaatcggtaggattttgtatcctaattacattttaataattctgaagtgtcaacgttactttctaatcatcaggaaagtcantgggtagcaaagaatatcccaagatttctctgcatcttcctctgagacattgagtaaagtcccatgccagcctcaggaggccttgcantgccggaggatcagcncacggtctgggcgttggacagcctgggtgttgaccacagcg

SEQ ID NO: 508466 - DNA, 388 bp, Homo sapiens
aaggatcagtgctgccctaagtgaataaactcaattgtccatctttattttagagttttaatgaattcaaggaagggagcatagcatatctcggctcccccatttcctcctcaaatcggagagaggtgggcaggtttttatttcttccctttcagcatatgagatccttcaagccaatgtcagcgatcttgtattggagcccaaagcattgagatagataggtcctttaagtcacagcatcgggctcggatagggaagggtttgtataatgtttaagtgtcccctttaaccctttcatcatttcctgctctgtgtttgtcctagtaacccatgttaataaaaatgttcttttttctccatctgtaaatatgaacaaccttaaaatttc

SEQ ID NO: 508467 - DNA, 235 bp, Homo sapiens
cagacggagaaggccacgtaccatcgtcacatgctgacgatgctggcacagagcagccactgatgcatgccatccgtgcccgcatacatcgcccgggttaaagcacgacgctcgatattcgaaaaaattcaggccaagcgggaacgactcgcgcagttaaaacttgcgaactacacatgatgagcaaaagcccaaaacctgggcaaggtaaacaaatccccccgaaaagaatcaa

SEQ ID NO: 508468 - DNA, 173 bp, Homo sapiens
ctgtttaaatttctgaatccaacagttggtcacagaggtcaagtattatcaaggctcctttgtcagttctcaattttttttttctcatttattcttcaaggacatgcaaggctcaatagttttttataggcagatgcctgggtccatttaatatacagatgaaataggattat

SEQ ID NO: 508469 - DNA, 1521 bp, Homo sapiens
ctcagtccggccttgcggtaagccttcggccgcggctgcccggtagtcccggcggcggcggacagacgagctgacaggacaccagggtcgtaaggacggactccatcagatccggctgactgatctccacgaccgtggggatcgggacaaccgcgtccttctgacccgttccttatccccgatatagatcaccgcgtgacgaaacacgagtgacaggcagaatcaacgcagtgcagttacacaagagcacatggtgttacaccgcaaagtgaagtgacacgccgtgactgaggcactcggtgacatgatcgtgcaaaggacagggacaaacaacagacaaaacgacactgattatttatatgatgcctacagaatgaccaaacattgacaacgaccacatgatgacagagattcaagggatgagatcaaagaggatcaaaagacaaattccagagtaaaggggaagaattgtcataacacaaaacgagcacgaactgtgacacatgcgagacaccatatcgaaggaactcctagggacatggatgcgcatacggaatggcccaaagagactggacataatacaaacaggaccaacagtcgcatgaccaattaggactattaacacaccattatggcaacacacaacagcgtacgtcaggtcagagactcgaggagcttatggcacaaaaagccacagaccaaccacatggccatctgcaactacacggaactcgttggcgacgttaacagttgctccccaagatggccacatttagggcgcacgaaccttagggcaaatccaaggccgcactccactccttccacagaggtacacgacaacatcagttgggacatcaagctgggcacccaaacatgagatacacactgccgctgacgaagcacgggcagattaactacacgaggacacaacgacacaagtccatggatatgccccacacgaagtgcggaacggcaacacgacacatcaccacgacggatgggtggacaacacggcgggacgcggctgggaacagtgaccacaacccacaacgggtaatggagaagacctgcagcattacccccaacagccaacgaattcccacgcaacattgtcccccaaggaaagcacacaccaggcacacacacaacgggcgcaacataaaccccgcaccacacggcacacacggcgcaactggcggaccaacaggcgccccagtcacgtgacacaacacagtgtgcgcagacgtagctccacgcgaaacaaaggtggccaggagcaacatacccccaccagttgatgacgccacagccgagacagacgaagtcaggcggaccccagacgcagacgacgcaccgtaggacacagagctagcaagccaagcgcaacacgaggagcgcagaaaaagaacgagacggcggcgaacacacaactccaatgagcggcaccacacgacaacaccacaccagccacaggccaccaccgacgacaccgtaaatgagacaaaaagcgcaagcacatga

SEQ ID NO: 508470 - DNA, 204 bp, Homo sapiens
gagagatacagaaataggacgatgagtaaattctatagccatctaggggtggcttctcaccgactggtggaccacaagcagacatcacagatataaagatgtctcaggtctcttttacctttaatatactaatatagcaaggcaagcaccttcaaggagatcttacggatttgaaacactttagctctagggataaagcaatga

SEQ ID NO: 508471 - DNA, 163 bp, Homo sapiens
ttaaccatctcagtgaggggcttcggcagcccctcatgctgtacatggcatgtgtatctctgctctactccagaaggcaccaccacagctgcccacttcttggaatgttctatctcactgctgatcttggtctccacgaagctctggtgtccatgagttatgg

SEQ ID NO: 508472 - DNA, 188 bp, Homo sapiens
ctgaggcaagaagatcacttgacggcaggagtttgagtcttacttgggcaacatagtaatacctcattagaacaacaaaaaaaattagctgggcgcggtggcaggcgccggtagtcccagatactcaggaggctgaggcaggagaatgtcgtgaacccgggaggcggggctcgagatcgcgccactgc

SEQ ID NO: 508473 - DNA, 121 bp, Homo sapiens
ctctgctacgtaagatgagtaatataaacggaaatctataattgcaaggggcttaacgctgtgactttaataagctggaacagtccactgaatgggtataatgaattggcagtatatacgt

SEQ ID NO: 508474 - DNA, 240 bp, Homo sapiens
atccgcgcgattgacggctggagacgcgcttgcgagtgcaattgctggagcgcagcacccggggcattcgcctcaccgaagccggggcgaggtttatggcggactgttcacgcatccttgatggcgtgagcgccgccgaagcgtctgcccagggtgcgcatgcgcaggccgaggggaatctgcgggtgttttttccgtttctgttcagccggtatgtgatggcgccgctgttggccgact

SEQ ID NO: 508475 - DNA, 811 bp, Homo sapiens
caacacatataggctaggttgaggctcgtgtaatcggacgggctggctcgtcggttctggcagcccgcagcccctgccaggtgcatggctgattgtaccgcctggctgcggttatctggcatgggctgagccccttggactggcatcatgccgtagcatccagaccctgcgagtgcttagtggagatctgtgccagcttcccactggcatcgagattttgtagagcacagtgcccgcctgtgccattcagagggcatcacatctgtgatggaactgaggctgagaatactgccacactgaccctgctggagcagcagggcctcatccgaaagctccccaagtacaataactgctggctggcccgacagaccccaagggatgtggcacgagtagagagcaagactggttgatttgtaactccgttctcagctgggacacggggtaccactcccgacctgggtagaggccccgtggggacaaggttggggcaaactggaattgtccccagcttgatttccagcagagctgtggatagagaggtatccaggctgcatgcaggccgaacatgtatgtgcttccattcagcatgggtcctgtgggactccccgatgtcccgcatcggggtgcagctcactgactcagcctatgtggtggccaagcatgcgtattatgacccgactggggacacctgttgcttcaggccctgggagatggtgactctgtcaagtgtctgcgactccgtgggccagcccctgacaggacaaggggagccagtgaaacaaaggcgtgcacaccagaaaaaactgattgc

SEQ ID NO: 508476 - DNA, 265 bp, Homo sapiens
  misc_feature (214)..(214): n is a, c, g, or t
cctcaagtgatccacccgcctccacctcacaacgtgctgggattacaggcatgagccacctcgcctggccaacctcttttcttttaaattacccaatctcgggtatttctttatagcagggcaagaatggtttaatacaggggcccatccagcagcactgcattaccaggattccgctgaagaaatggacgtggccccaaaggccatagcctgnctgccaggtgccccagagtattgtcaactcagaggaacatctctcaggatg

SEQ ID NO: 508477 - DNA, 435 bp, Homo sapiens
  misc_feature (3)..(3): n is a, c, g, or t
  misc_feature (68)..(68): n is a, c, g, or t
  misc_feature (71)..(71): n is a, c, g, or t
  misc_feature (77)..(77): n is a, c, g, or t
  misc_feature (96)..(96): n is a, c, g, or t
  misc_feature (98)..(98): n is a, c, g, or t
  misc_feature (100)..(100): n is a, c, g, or t
  misc_feature (112)..(112): n is a, c, g, or t
  misc_feature (400)..(400): n is a, c, g, or t
  misc_feature (430)..(430): n is a, c, g, or t
ctnctgtttgagcccctctaccacgtccagaacacgctcatcccccgcttcacccagggcaagagcgnccngaccgngggtcagtgctaggcgccngngnacctcctgcggnctctacgactgcgacctctacttcctggagaactacatcaagccgccgccggtcaaccacaccaccgacagatcttccgccgcggggccagccgggtcctctgctcccggcctgtgtgcgaccctccgggccagccgacctgggtcctgggaggagggggactgtgtgcgcaagtgcgggcttacttcaacctgaccgtggcggccgaggcgttgccgggaagcgcagccacgttggccattcaagacggttgcgcgttgcccgaggttgaacgaccttgcgcgcctnggttggaaagaacccgcgattaaaactttnaaggt

SEQ ID NO: 508478 - DNA, 220 bp, Homo sapiens
ccgcagagcggctatcatgaagttagtgtccagtggcaacatgtcacaggcgagtatttattaggaaaatgtggaagcacaataaaggcaatcggttggttattcaattacattattttttattgggggtaggtatcttcttagaaagtccctagtcacctaattatatcttagtaggctgctctgtgattggctttattttactatctctttttacttc

SEQ ID NO: 508479 - DNA, 276 bp, Homo sapiens
cgatctgtccctttaatcttctgatgtacacctccttacgagctcttacttactccaacatatgcttacaacaatactctttctgcatctgagagggagcaaatattcagtaacttactgcagctagtcctcactaagaggagaatctgttgaatgccactggaaatgtacggatctcttgtgacagtcacatctcagggggaaactagtggttaaatcgtcacttctttgagtctgaaactatatcatttgcagtgcagataactgcctgatctt

SEQ ID NO: 508480 - DNA, 1665 bp, Homo sapiens
  misc_feature (962)..(962): n is a, c, g, or t
cgtggtttcctccacgagaatcttgtgtctgctttcctagcacgccgggggggtgtgtggaggggcgcgcgttcttctctgctctgcagagagttccgcccgctgttttggctggctactccactgtggcgtgttcgtgcagcgtgcctgtgttcgtctacaatcaggcacgaaaggctttctgttgggtgggctctgagttcctgcgcgtcctcgtaaggggtagagtttgtctgtgggacaaggggttggtaaccatacacggtggtagttcgtttttttcttacaggggtggagatctctccccgggagcgatcgtgttggttgtgatgtggtgggtgctgccccccctctcgggtggcgcactccggggtggggcccacagcgtgctgtgtgttggtctctttggggttgttttttttcgtgcaccaggggggtatatttcgtccttgggggggagttctcttgggaggagagaataataagaggggggggattttctccgccggcaccgagagaagcgcccgtctcttctagggggatattcccctagagaagaaaagttggtgttattagaagcgttccgtctcgcgggtgcgtcacgagctgataaaagatagtggcgttggcgcggttctcgtgatattgggggataaaataagacgctgtctcaggaggatagaagtggtgcgcccataaggagaaggtggggggcacgccacaacagagaagggggccccacacatgggggggaaattgtgtgtggggcggtgtgggtgtgtgtgtgggaaagaccgttgtcggggggggggacacagggtcgtcgaccctcgcgccaccaccccgggggagaggtggtgtaacaagaggggggcccacacttgagacaatgtgtggggcgcacccccacaccacgctggtgaaacacacagcagaaagagggccgcaccactatgtctgtngtttgtgtggggagagggatcctcgagaactattgttacagcggtgggagagagagacacatagacctcgcgggggagacagagagagtctcacacacacccaccgctggagaggggttttttttgtgatagaggtgggagtctcacactggggtgggttgtctctcccccccagggtgggagaccctcaccgcagagagtcctctggaccgcacgctggtgtttctctctcacaccaggcgctctctgtgtggcggctcagacggtttttgtctgtctctcacaggggtgtgtctggagcgccctcttctgtctctctctgtctttgagatcaagtgttctctctggcctctaactcttggggtgtgtgtgtccctctctggcggtgtggtggaaacacactctgggagagtgtcccctctctcctcgcgcctctgggggtatattgacatctcacacacaccagacgtgggcggatagccccgggtgtgttaccacaataaaaggaggataacactggtgtggggttctcagagggtctcaccctgtggtctcagcccacacacctggggctccctgttgccccccccgggttttgttgttggtgcatttgggcatccagacccaatttggaccccatccaagataacgggtttgaccctggttttggttttacctccaataaaaggtatagactcaccca

SEQ ID NO: 508481 - DNA, 372 bp, Homo sapiens
  misc_feature (205)..(205): n is a, c, g, or t
  misc_feature (313)..(313): n is a, c, g, or t
ggtttaaagcaagcgtttgcaggtaattggaaaaaagtgtttattgtttgtgagtgtgtgtgttctttatcgaatgatttaagtgcgtttaccaaggaatgtggctttgtactttcccgtttccttgtttactaattgccacgttagaacaaaaatctagatggaattttgatttatattggtaatcatgaataaattgatgcanaacctgaagaaaaggtcaagttatatgatcggtggatgtatcttagggattgtctttattacccacccttggtttgttacctttttctcccttacataatgagaactntaagggttggtcttaaactgggtaaaattcatttgtggttcagttttacaaaacctggt

SEQ ID NO: 508482 - DNA, 211 bp, Homo sapiens
tcattgtttgaattttttcgtagagctggggttatgccatgttgcccaggctggtcacaaactcctgagctcatgcagtccacctgccttggcctcccaaggtgctgggattacagacatgagccactacagccagggatttccttcaagaactttcctttgcattcacgtcttggctgttggtacaagagtcctagcgttggcctcttct

SEQ ID NO: 508483 - DNA, 161 bp, Homo sapiens
  misc_feature (6)..(6): n is a, c, g, or t
  misc_feature (14)..(14): n is a, c, g, or t
  misc_feature (36)..(36): n is a, c, g, or t
  misc_feature (39)..(42): n is a, c, g, or t
  misc_feature (45)..(45): n is a, c, g, or t
  misc_feature (65)..(65): n is a, c, g, or t
  misc_feature (75)..(75): n is a, c, g, or t
aagganacctagcnggtgtatgtgatgtgcttcagngcnnnngantgatttatcatctagtcttngtctattttncctttgatgttcaagtcctagtctataggataggcagtttaaatgctttactcccccttttaaaataaatgactaaatgtgctgca

SEQ ID NO: 508484 - DNA, 1396 bp, Homo sapiens
  misc_feature (51)..(51): n is a, c, g, or t
  misc_feature (63)..(63): n is a, c, g, or t
  misc_feature (65)..(65): n is a, c, g, or t
  misc_feature (71)..(71): n is a, c, g, or t
  misc_feature (73)..(73): n is a, c, g, or t
  misc_feature (82)..(82): n is a, c, g, or t
  misc_feature (90)..(90): n is a, c, g, or t
  misc_feature (101)..(101): n is a, c, g, or t
  misc_feature (103)..(103): n is a, c, g, or t
  misc_feature (108)..(108): n is a, c, g, or t
  misc_feature (145)..(145): n is a, c, g, or t
  misc_feature (175)..(175): n is a, c, g, or t
  misc_feature (178)..(178): n is a, c, g, or t
  misc_feature (181)..(182): n is a, c, g, or t
  misc_feature (189)..(189): n is a, c, g, or t
  misc_feature (199)..(199): n is a, c, g, or t
  misc_feature (202)..(204): n is a, c, g, or t
  misc_feature (206)..(206): n is a, c, g, or t
  misc_feature (266)..(266): n is a, c, g, or t
  misc_feature (268)..(268): n is a, c, g, or t
  misc_feature (280)..(280): n is a, c, g, or t
  misc_feature (322)..(322): n is a, c, g, or t
  misc_feature (334)..(334): n is a, c, g, or t
  misc_feature (339)..(339): n is a, c, g, or t
  misc_feature (351)..(351): n is a, c, g, or t
  misc_feature (364)..(364): n is a, c, g, or t
  misc_feature (370)..(372): n is a, c, g, or t
  misc_feature (374)..(374): n is a, c, g, or t
  misc_feature (376)..(377): n is a, c, g, or t
  misc_feature (379)..(379): n is a, c, g, or t
  misc_feature (394)..(394): n is a, c, g, or t
  misc_feature (396)..(404): n is a, c, g, or t
  misc_feature (406)..(407): n is a, c, g, or t
  misc_feature (412)..(412): n is a, c, g, or t
  misc_feature (415)..(415): n is a, c, g, or t
  misc_feature (418)..(420): n is a, c, g, or t
  misc_feature (423)..(423): n is a, c, g, or t
  misc_feature (425)..(425): n is a, c, g, or t
  misc_feature (459)..(459): n is a, c, g, or t
  misc_feature (509)..(509): n is a, c, g, or t
  misc_feature (555)..(555): n is a, c, g, or t
  misc_feature (565)..(565): n is a, c, g, or t
  misc_feature (575)..(575): n is a, c, g, or t
  misc_feature (716)..(716): n is a, c, g, or t
  misc_feature (719)..(719): n is a, c, g, or t
  misc_feature (721)..(721): n is a, c, g, or t
  misc_feature (723)..(723): n is a, c, g, or t
  misc_feature (725)..(725): n is a, c, g, or t
  misc_feature (730)..(730): n is a, c, g, or t
  misc_feature (732)..(732): n is a, c, g, or t
  misc_feature (796)..(796): n is a, c, g, or t
  misc_feature (812)..(812): n is a, c, g, or t
  misc_feature (897)..(897): n is a, c, g, or t
  misc_feature (988)..(989): n is a, c, g, or t
  misc_feature (996)..(999): n is a, c, g, or t
  misc_feature (1010)..(1010): n is a, c, g, or t
  misc_feature (1013)..(1013): n is a, c, g, or t
gaatggacatagcgtgagaggcggtgaggccagggttccagcctcgtgctntctcgggactcntnaccgtngngtgcgtgtntgcccgtntgtgactttcnantcacnaaggttgaagaaaggaaacggggaaaatcaaaagggnttcaaaccccacttcagtaggtggaggggngcnccnnccattgnttgtattttngtnnngngttttcggtgccgtgttcctaactactccatcccatgacctcgccacacctactggggcntntggctggtgccngctgccatggccagcccccactctcaccctgcacagggggtnttgcagcccccnggccnacagcctcgttnggaggacaggttncccctnnncncnncnccccccccccccccngnnnnnnnnnanngagantgntcnnnggnangcatccactaccccagggccccccacatgtcatngcaaggttggtagtgaatgggcctggttgggagcagcccctggcccattncccacccacccttctcactatgcaattcgagttccaagcaacattngctcctgccntggggccagntctgccccagccctgagaggggtggtgaggcagccccctggaccccagaaccccagacaagggggcaggcgggggaccagggcctctcctgtgggatctttgttttgtgtttaaccataatggttgtgtactgaaccactncanantngntatananaatatatatatatataatctccttaagactcagcctcctggtttacccccccggcctgggcatntgacctcccccacccnagtgtgatttaacatccaggaactgaggcctggaccattttgcatttccccctcctccagcctctgtagggccatggctgtatgnactgtcgctgtgtttttttgtttttttagaactgggtttgggggctgatttttatttctttgggggctttttttcttggcaaatactaatnntctcgtnnnngtaatttctgnggnttctattcagcttgggcttcatgttgtaaaataaattttaaaccgccctttttttttttttcatttttctctttttctggttctttttattcctttctttttgtggtccctctctccgtgcccacattaagaacattttgttttgccccctttttttgggcgtctttcttcctttcggttgtgtgggggtgtccctcccctcgccgtcggggggtgggcgcccgcgtccccatgcttcttttctttggttgcttcctctattccttcttttcaaccatttcctttctccctcctcttctctctcttttgccgtttttcccccgtctttcctttttgtcgctatttgtttttctccgtttcttcctctttgcattcacttatat

SEQ ID NO: 508485 - DNA, 1354 bp, Homo sapiens
  misc_feature (51)..(51): n is a, c, g, or t
  misc_feature (63)..(63): n is a, c, g, or t
  misc_feature (65)..(65): n is a, c, g, or t
  misc_feature (71)..(71): n is a, c, g, or t
  misc_feature (73)..(73): n is a, c, g, or t
  misc_feature (82)..(82): n is a, c, g, or t
  misc_feature (90)..(90): n is a, c, g, or t
  misc_feature (101)..(101): n is a, c, g, or t
  misc_feature (103)..(103): n is a, c, g, or t
  misc_feature (108)..(108): n is a, c, g, or t
  misc_feature (145)..(145): n is a, c, g, or t
  misc_feature (175)..(175): n is a, c, g, or t
  misc_feature (178)..(178): n is a, c, g, or t
  misc_feature (181)..(182): n is a, c, g, or t
  misc_feature (189)..(189): n is a, c, g, or t
  misc_feature (199)..(199): n is a, c, g, or t
  misc_feature (202)..(204): n is a, c, g, or t
  misc_feature (206)..(206): n is a, c, g, or t
  misc_feature (266)..(266): n is a, c, g, or t
  misc_feature (268)..(268): n is a, c, g, or t
  misc_feature (280)..(280): n is a, c, g, or t
  misc_feature (322)..(322): n is a, c, g, or t
  misc_feature (334)..(334): n is a, c, g, or t
  misc_feature (339)..(339): n is a, c, g, or t
  misc_feature (351)..(351): n is a, c, g, or t
  misc_feature (364)..(364): n is a, c, g, or t
  misc_feature (370)..(372): n is a, c, g, or t
  misc_feature (374)..(374): n is a, c, g, or t
  misc_feature (376)..(377): n is a, c, g, or t
  misc_feature (379)..(379): n is a, c, g, or t
  misc_feature (394)..(394): n is a, c, g, or t
  misc_feature (396)..(404): n is a, c, g, or t
  misc_feature (406)..(407): n is a, c, g, or t
  misc_feature (412)..(412): n is a, c, g, or t
  misc_feature (415)..(415): n is a, c, g, or t
  misc_feature (418)..(420): n is a, c, g, or t
  misc_feature (423)..(423): n is a, c, g, or t
  misc_feature (425)..(425): n is a, c, g, or t
  misc_feature (459)..(459): n is a, c, g, or t
  misc_feature (509)..(509): n is a, c, g, or t
  misc_feature (555)..(555): n is a, c, g, or t
  misc_feature (565)..(565): n is a, c, g, or t
  misc_feature (575)..(575): n is a, c, g, or t
  misc_feature (716)..(716): n is a, c, g, or t
  misc_feature (719)..(719): n is a, c, g, or t
  misc_feature (721)..(721): n is a, c, g, or t
  misc_feature (723)..(723): n is a, c, g, or t
  misc_feature (725)..(725): n is a, c, g, or t
  misc_feature (730)..(730): n is a, c, g, or t
  misc_feature (732)..(732): n is a, c, g, or t
  misc_feature (796)..(796): n is a, c, g, or t
  misc_feature (812)..(812): n is a, c, g, or t
  misc_feature (897)..(897): n is a, c, g, or t
gaatggacatagcgtgagaggcggtgaggccagggttccagcctcgtgctntctcgggactcntnaccgtngngtgcgtgtntgcccgtntgtgactttcnantcacnaaggttgaagaaaggaaacggggaaaatcaaaagggnttcaaaccccacttcagtaggtggaggggngcnccnnccattgnttgtattttngtnnngngttttcggtgccgtgttcctaactactccatcccatgacctcgccacacctactggggcntntggctggtgccngctgccatggccagcccccactctcaccctgcacagggggtnttgcagcccccnggccnacagcctcgttnggaggacaggttncccctnnncncnncnccccccccccccccngnnnnnnnnnanngagantgntcnnnggnangcatccactaccccagggccccccacatgtcatngcaaggttggtagtgaatgggcctggttgggagcagcccctggcccattncccacccacccttctcactatgcaattcgagttccaagcaacattngctcctgccntggggccagntctgccccagccctgagaggggtggtgaggcagccccctggaccccagaaccccagacaagggggcaggcgggggaccagggcctctcctgtgggatctttgttttgtgtttaaccataatggttgtgtactgaaccactncanantngntatananaatatatatatatataatctccttaagactcagcctcctggtttacccccccggcctgggcatntgacctcccccacccnagtgtgatttaacatccaggaactgaggcctggaccattttgcatttccccctcctccagcctctgtagggccatggctgtatgnactgtcgctagcgaattctcgccctaaaagaactcggtctcgtgggccaatcattattacttggcgccctctgtgtcttggcccaacctaagcacaagcccgtcatagacgaacaaagcgagccgccaagttctgcgctctgcggtccgctacccccagtggtatttcgattggggcatgcttgtgcagtgcgcccccaggtcgggccccttttgggcaacgcgggcattagtgcgttccttttccactttcatagccccccggaaccacaatgttgtgactgtgggacccctgccgtgaccccattgtaactgtttgagcgcccgttctttttggcccagctgtgaaaggcggaacagcgcccgtcccgttagtccttgcaaaccctctgccaccccggtaataccgttctccactctcgggctctcctgtgataaccgtgccgtgtaaatctagt

SEQ ID NO: 508486 - DNA, 304 bp, Homo sapiens
tatacacttctgatacagactactttgagatcacttcgtgactaatcttgtaacgaaatagtttatcatatgttgcatttgtacgttagtcattccatctttcactcaggatgaatgcgaacattgactgttcacagaacctcagtgatgtgagcatctgttgctcaggacgtgacaagttgctaatatgcacgaagggatgggtggtacattcttgcttctcatgatgcatgttactgtatgttaatgacttgtagggtagctattaaggtactagagtttgataaatgtctaataggtagat

SEQ ID NO: 508487 - DNA, 879 bp, Homo sapiens
  misc_feature (407)..(407): n is a, c, g, or t
cttatcacgcaggagcatgatctggagccaagagcagagtgaccatgacttgatgctgcgtgagctccacaagctgcatgcaggaggtagaggacccagcgcctaggactaggagctgtaggttacaagagacccgagaagccttggtgggacgagcatatgcagctgaacagatgtgaaggaatttgatagcgtgcatgaccaagcagcgtgacccgtggaggtggcaggcgctgcactaagtggacatcgtgcaaggccagttcgaggatgcagaagagatcagcgcagagccccggtctgccaagacacttcgaggaagaggcttgcccgtcttaaggaagccatttgccaggcgtcagttacatgcagtgaaagtgtaggaacagacaagcgtcgttgcatgnaggatcagactccgtcgaggcaactcatcaggtatgaagaatcaagaggggtggcagcgcctgtgagacagtcagaggtatccggagggtgtctgacgacgtgctaaggcaacctacgaagaagagccagagccagcacaggaccgagctggccagttccagaagcgtgacaggagacgcatgttctgcaagccttggacctgggggacaccaagagcacttggcgtctagcagtgctccaggcaggtcgccctttagaacagccatggagaggagtccagtctggatgtcaaatgtcctgcaaaggatagagatggagacatgcttgaagaggctgctgacaggttagcggcctggacaacgccaaggtgagcctggattgtggacgaagactctgtgacctgggagataatgcccaaggtcggacaagcatggtgatgcgggaagacgggcaacgtgactctaataccag

SEQ ID NO: 508488 - DNA, 459 bp, Homo sapiens
  misc_feature (431)..(431): n is a, c, g, or t
  misc_feature (447)..(447): n is a, c, g, or t
  misc_feature (458)..(458): n is a, c, g, or t
ggccctccggaggccaagctcatgcgtcagagcggcctctcccggcctggcgtttgctcctttgcatgggctccaggtcctgcacttcctccagtcggcctctccaggcccagctcttcctcccggcagcctctgcaggaccagactgtcgtcaagtaggcctgtccagggacagctcctgcctcccggcagactctgcaggcccaagtcgtcctcaagtcagcctccccaggcccagctccggcctctcggcggcctctccaggtgcaaaagttcctcgagtccgtctctccaggtccagctcctcctgtctcccagtggcctctttcagcccagcccagctcatgcctcccggcggccttcccaggcccccttttgactttccgcgacctctgcaggccccgaacttaacctccagtcggcctctgcangcctgggcttctggcnttccgaaaggnt

SEQ ID NO: 508489 - DNA, 259 bp, Homo sapiens
  misc_feature (154)..(154): n is a, c, g, or t
  misc_feature (238)..(238): n is a, c, g, or t
ggcacgagcagttatgagagtgatattgaggaggatattacccacccatcacctcataaggaggaggcatgacttgatgatgaagggtgagccagtggtaagggaggttttttcaaccagccaaaaggtcctatcctatgtttcctccccgagnggaggaattaaatgggatgaatatggagacattactcaacccaggggatccttagtccaaacctcaaccactgaggagaaaaangcaaatagactatgttttcca

SEQ ID NO: 508490 - DNA, 90 bp, Homo sapiens
tttttccctttctacattttgctaattatcctgtatataagtttaatatatcactttttaaaagaaaaaattctaccattaaaaaaaaaa

SEQ ID NO: 508491 - DNA, 144 bp, Homo sapiens
ctcatatttgtgcactgactattaaaaaaacaacaatgtgcacatcaaagtcctcggcacacttgtcactcttgggggatgctcgctccaacctgactgctgtcaccttcacctgttccagtttttaaatcctgagtcaatgcc

SEQ ID NO: 508492 - DNA, 292 bp, Homo sapiens
aggggggagggggggcccccccagggccaaaaaaaccaaaatgattttttgcccccggggggttttccccccctggtttggttttttagccaatggccgaaaccccccttttttggtttttcttgggggggggggggggggtaagggtttttccaccccggcctgggggggggggaaggttttttacccccggggttttttcaaaaagggaggggggcaaggggcccccttttcattttgggggggggtcccccaggggaccaaaagccaaaaaattttttcccaacccgga

SEQ ID NO: 508493 - DNA, 274 bp, Homo sapiens
agctgctcaagctcatcctggcaagtgcccatgtagaagctgttccttcctggaggggccccactggacaccccggcctgggaacgacgagcagaactgtcactggatgggttgaaggattgtttgctgctgacggctgaggtgccataatcgggagaacccatgcgagctaaagactgagtagaggaggtggctcgcaggctagcctgggaagcaggagcagactgggtgctgttgaacgatgagctggcgctggctggctcttgcacatcta

SEQ ID NO: 508494 - DNA, 120 bp, Homo sapiens
aggctggagtacagtggcgcaagtctgctcactgcagcctccacctcatgggcctaggcaatcctcctgccccagcctctcaagtagctgggactacaagcgtgcgccaccactcccggc

SEQ ID NO: 508495 - DNA, 449 bp, Homo sapiens
cccggtccctgccgggcccctctccgtgccgccgctcccccccctcccttccccgcgctggcccctcgccccgccgctgtccctctgttcctctccgcctggcctcccccccttgcccccccccgtggccctcccggtcctctgtgccgcccctggtgcggccggggcctggtggcgcgcccccgtggttgcctcctccgcggcgccccccgccgtgacgcttcgctccgtggcctccggcggctctccgcgggtgcccgtcgccgtgctccggcccctccggtctgcctttgtccccctgccgtttccgggcgccgccgtccttctggcccgtgtgctgcccctgtccgccgctgccccgttttccccggccgccgctgccgccctgcgcgcgctgccggggcctcccgccctgcttgctccggtgccccgttcccgtccccctggtc

SEQ ID NO: 508496 - DNA, 1088 bp, Homo sapiens
tgagcggggtgcgccggaaggggcgctgccgggcggtctggcggctggcctgttgcgctgatgctgatgtgcctgccaggcgaagtctggagaccagccgggccgcggccgcaatgttgccaatggactctgcccatgtctcccttgggcgcagtcgcccaatgaatgccgggtctgctccatgcccggctggcggcagttgctggagaaccagacggcgggatgctggagaacgctacgggcggagctggaggcggagctggtgcaggctggcggtcgtgagactggctgtgcgcttcgctgcccgggagctgccggctgcgctgacggagtgccgctcgggggagcgcgccggcggctggcttgcccgtctgcgctccaagtgtggacgtgcactaggcgtcagccgtggacgttgccgtgcagcctgtcctcagggacgatggcatggcgggaaccgcgaggcctgaggatccggggcagcatgctgcggcgtgcgacaggaaggcccgatgcaaggcgggacatgcgttgcaagcaaggcatgcgttgcgaccctgggaagccgcggactggcaggtgggatgcccgcccaatgccctgggaagacttgcgaatactgaccttggtttggggtccgaagggggaggcctcgcggtttgacacccggggagaccccacttgatagtcccggcccgacgtgtgtgccgtcgctgaccgggtgtacccgcgcgcgttgcaacgtcgccagcttgttctggccttgaccccgagaggatgatttgcgcggaccaacgttcgtgttgggcacgacgctgtcaaggggtgggaacgccattgcgcggtgggccggacacttcgccggctttaggtcttgccacgggccgggcggccgtggcccacggtttgggaatggcgtcccacgcgatctcgattcccgtttcagggatagccattccctgggcccccccttttcccgggtgtgggcacccccggaggttttgctcgcgtgggatcattcggtgaagccaccacaacggcctgtgtgtgcactttccacatgtggcatgaaacctcggatgccccca

SEQ ID NO: 508497 - DNA, 682 bp, Homo sapiens
ctgggggaggtttctttttcccgaagggggccaaaggccctttatgtccgctcggttggggcacttagcccttcccacaaaaaaaaaaatatatgttttatgctccggggagtggtgcccctttgataaattggaacccgcccccccccctgggacatttttcgccgggagcccaagaataacccccccctcactgtttgatgttgtcaacgaacacccggggttaaaaaagatggaagaaaaagggtgtcaagagttatcccccgtcttccgtgaaaaccctaatccggctcctcataaaaacaattttctttttgaacgggtgtaaaatccttgccttaggccacctcagccccgggggaatgaatatccccctatgaagagccccgggtccccaggcgggcaatgaaaaaaaatttttatccacgaaggtcctgtccctttttttttcttgggggggggaaacaccccccccctttcataaaacaacattttttttattacatggccttttttttggtttggggatatcaaaaaaaaattgcacgctttttctttttaataggtgttcatccgcgcaccgtgaaaaaccttgtaatttctacaaacttttcaaaacgttcaatgtcgcaacaatttaagacgttcaacaatgacccaaaaaaacaaaaaacctaaaaaa

SEQ ID NO: 508498 - DNA, 264 bp, Homo sapiens
ctcggaaaagggggttgtcgtgtctacatcagatttctatcttgactactgtgtgagtgagagtacatgaatcggcttgtagaaggaataactttctgcttgctcactggacaggtttacttggttcgaattagccaacggtctacacacttgcaatgataagcatgggaacagggacggatactgagataaagcctccatcttcatactcatccaaacaaatggcacatacatcatactcatctccttgcttgaatatatgta

SEQ ID NO: 508499 - DNA, 764 bp, Homo sapiens
  misc_feature (38)..(38): n is a, c, g, or t
  misc_feature (66)..(66): n is a, c, g, or t
  misc_feature (75)..(75): n is a, c, g, or t
  misc_feature (77)..(78): n is a, c, g, or t
  misc_feature (80)..(81): n is a, c, g, or t
  misc_feature (84)..(84): n is a, c, g, or t
  misc_feature (87)..(87): n is a, c, g, or t
  misc_feature (96)..(98): n is a, c, g, or t
  misc_feature (114)..(114): n is a, c, g, or t
  misc_feature (184)..(184): n is a, c, g, or t
  misc_feature (191)..(191): n is a, c, g, or t
  misc_feature (242)..(242): n is a, c, g, or t
  misc_feature (280)..(282): n is a, c, g, or t
  misc_feature (285)..(285): n is a, c, g, or t
  misc_feature (294)..(294): n is a, c, g, or t
  misc_feature (314)..(314): n is a, c, g, or t
  misc_feature (316)..(316): n is a, c, g, or t
  misc_feature (319)..(319): n is a, c, g, or t
  misc_feature (321)..(321): n is a, c, g, or t
  misc_feature (324)..(325): n is a, c, g, or t
  misc_feature (335)..(335): n is a, c, g, or t
  misc_feature (366)..(366): n is a, c, g, or t
  misc_feature (368)..(368): n is a, c, g, or t
  misc_feature (376)..(376): n is a, c, g, or t
  misc_feature (388)..(388): n is a, c, g, or t
  misc_feature (399)..(399): n is a, c, g, or t
  misc_feature (405)..(405): n is a, c, g, or t
  misc_feature (412)..(412): n is a, c, g, or t
  misc_feature (435)..(435): n is a, c, g, or t
  misc_feature (451)..(451): n is a, c, g, or t
  misc_feature (511)..(511): n is a, c, g, or t
  misc_feature (659)..(659): n is a, c, g, or t
  misc_feature (662)..(662): n is a, c, g, or t
  misc_feature (703)..(703): n is a, c, g, or t
  misc_feature (754)..(754): n is a, c, g, or t
cctccttccccttcttgcccccccttggtcgctttgcnccccctcccgtcgccccgtccgtttgcnggtttgttncnncnnttngtncctgttttnnngggtccgtgtcccgcnttccctccctgtgccccccctgttgcttctgccgtgctccgccggctgcctgcttcctttcttcttcgtncgccccnttgcctgcccccgttgggccttcccccctcctcccgcgcggtcctcccctncttcgccctttgcgtgtggctctggtgtctgctccccnnngtngctcttgcnccctccgccccgtggggggngnggngnggnngggtcgttgngggggggttttggttttggtggggggggggncncgggtgcntccccgcgcccngggccttcccncccccnggctgcnccgctcccctgggcctgcttccncctcccgggtgggtgngtgggcgcggggggtggggtgggggcccctcgcgggggtgcggctggtggggcggtgggntttggtggcttggggggggagggttccctggcccggtccccccccccggccccggctgcccctcgcgcgctggtccgttcccggggtccggctcggcccctgcccctgccgctcctcgctgttgctgcgtccctccggtgtggcggcnggnccccccgcctctgtgtctgtgctggctgcggtgcgcgtcgnggtcgcccgcctggccgttctgccccgtgcggggctggctcccccgccccngccttttctc

SEQ ID NO: 508500 - DNA, 291 bp, Homo sapiens
cgggcatatgaatagaaggaataaactgaggaaatggagaaaatgcaccccacagcagaacggctatttgggcagcggccacttgtatagaagatctggacttggccgagcgcggtggctcacgcctataatcccagcactttggaaggctgaggcaggcggatcatgaggtcaggagtttgagaccggcctgactaacatggtgaaaccttgtctctactaaaaatacaaaaattagccaggcgtggtggcgtgcgccagtaatcccagctacttgggaggctgaggcag

SEQ ID NO: 508501 - DNA, 101 bp, Homo sapiens
catcatggggtcctggattacatgaatacatgaatgagtgaacaggtggatacgatggatagaatgtgatgtgatgggtgggtgcatggtatggataaagt

SEQ ID NO: 508502 - DNA, 241 bp, Homo sapiens
atcgagcggccccttttccagcagctcgcaagccggtttcagctatatccgcagcgacctcaaaccggagatgaccaacacgttcgaggcgggttaccgcttccataatcgcgatctgcagctttcgctgaccggctattacgtgaagttcaacaatcgcctgctcgcgtcttcgatcagcgcgaccgtcgtgggcaaccagaacgtgttgcagaatgtcggcagcgtctcgtcgcgcggc

SEQ ID NO: 508503 - DNA, 137 bp, Homo sapiens
ggagctcggcccccctgacatattgcatagctagtgtaggaaaagaatcacttactccataggacgacgtagttgtctgagacaaaaacagtcacttggtggagttcaaatcacacagaaaaaaatccaacgccggg

SEQ ID NO: 508504 - DNA, 264 bp, Homo sapiens
ggctctagagatccctgagagaccgtgttgcatgaatcaatcagtcattaggctgggctctgtgactcatgtctgtaatcccagaacttggggaggctgaggcaggcagatcacctgaggtcaggagtttgagaccaccctggccaacatggtggaacccttgtcctctactaaaaatacaaaaattagccgggcgagtggtgcgtgctatcatcccagtactcagcaggctgaggaagagaatcattgcaacacggtctctca

SEQ ID NO: 508505 - DNA, 447 bp, Homo sapiens
  misc_feature (47)..(47): n is a, c, g, or t
  misc_feature (237)..(237): n is a, c, g, or t
  misc_feature (376)..(376): n is a, c, g, or t
ggcactgaggcaagacctttgtcagccatcacagtttgaaactttgnctctgttcagcaagagaaaaagcctggctaaaatcattccatatttcaggcacagagaaaggaagtaaaaagaaagaaaaggaacggcctgaaatttatcctccatctgattttgagcacaccatccatgttggctttgatgctgttactggagaattcactggcatgccccaacagtgggctcgattantacagacctcccatatcacccaactagagcaaaagaagaatccttaggctgtgctggatgtcccaaagttctacgcactccacacagtgaagccgaaatatctcagctttactcctcctgagaaagatggctctccttntggaacaacagcactgaataccctgggaaccgaagccccccagtagtgacagaggaggaggatcatgatca

SEQ ID NO: 508506 - DNA, 556 bp, Homo sapiens
caggtaccacactccaatgagcaaaacacatccaggtaatctgcagatgcaagagtggccctcagagaagagcagctcagattaccaactcaggaaggcaggtacaaccctgaagcaaacctcacagagaatcagttcctcggtgatgatcctccctaatgggaatggaaacacacacaactgacatacatggggcaaagtggggggatgctaaagaaactaaaaatcccgatgtaacaacaatattgcagtttccacattggcaatctaggacaactacatttatgaccatcaaatatcctcttaaatccccagaatgccttagggaatacttgtaagatagagtatgaaagtaaagaatatagaatttcagcactgaccctaccaagtatagactatgccaaggaggcgtggcagaaagaaagagcagttagtttgaaggattccattccataggctttgatttatgaaatctagagggaaaagaaagacatgtcttcaaatacttaaagtaaattataaaatgctccagtttgaatcttttaggctcaggtta

SEQ ID NO: 508507 - DNA, 370 bp, Homo sapiens
  misc_feature (269)..(269): n is a, c, g, or t
  misc_feature (282)..(282): n is a, c, g, or t
gcgagaccccgtctccaaaaaaaaagaagagaagagcaagtcattctactgaaaagacacatacactcacacgttcctcacaacactattcacaacagcaaagacatggaatcaaaggaggtgttcatcaacagtgggttggataaagaaaatatggtacatatacaccacagaacactatgcagccacaaaaaaagagtaaaatcatgtcctgtgcatcaacatggatacagctggaggccgttattctaagcaaattaaagcagganaagaaaaagcaantaccacatgttctcactttataaattgggggcttaaacgctggggtactccacgggccatagggatttggcaatattaggccacttgg

SEQ ID NO: 508508 - DNA, 772 bp, Homo sapiens
gttctagatcgcgagcggcgccctttattttttttttatttttatataggaaataaacaaaagaaatcccatatgtgattggatcccaggttctgggcagtaatcagaaagataaaaaatccttaaaaatgggggctgggacagtggtattacaccaaaccaggaacagattatatggcacatcacgttaactattggggtacacaattctttacgcacatcagtcaagatcattcttcatacactcggggtggtaataacactatctctggaagaaataagttctttctattaatgagattatcacactttatggatctctccaccctacaacctgagggtctaaatgtgtccctgtctagataattacactcctctgtgggtgaagagtcaaaatatccgtagaagggtcacatcatatcattgtgggaatatcccacgagatgttgaaatcaaccctaatgtgttataacatcctatatagataaacacgatcctaaaatgttgtgaggaaatcccctgggatgtgtggttctacaaacttatacacagaggattgtgttagagagaccccacgtgggtacaacataactgcgtggggcgaaaacgaataaatttttcgcagatagaatccatactcgtgttgggggacaaatgtgggggtacctgtgtgggtccccccgtggaaatccagtatgggggaaatatgtccccgagtaaaaattcaagaaaaaaacgcaacggagggtttattcacccatataattaaact

SEQ ID NO: 508509 - DNA, 234 bp, Homo sapiens
atggggaaacatcagtgacttctcagaaacgcacccaatcaacgaacattaatatcaaaacccatctacatacacaaaacaattactgatgcttcatcacagacatccaactagaatttgaaataactattatagaaaacaaagtaaacatgcgaataaatactacgggacataatcgttgacataggttatcattgtttcattttgcttgccaaatagctttaaaccagtaat

SEQ ID NO: 508510 - DNA, 440 bp, Homo sapiens
ctagaggatccccgctgctctctctgggggggggctgcggctgcgggcagttgagtgtggaggctgcggacgcgctggtggagctggaactgctgcagctgctgccgccgcggagtgaaccttgatccccgtgctccggacaccccgggcctcgccattggctgaccagttgagtgaggatcagattgcagagttcagggaggcatttaccctattgtgccttcctttatttcttaaagaaatgcccattttgtgcctggcataagttgaggtgctggggatgctgtgattagcatgacaggcagtgacctgtgttgacaggaacctaagttctggaataatagctcagcagtgccgagcacgtaatgtgtctggcagcatgccaaatgtgccccatgtgtgcttacggcgatcctgtccccaccgcaaagagagagggt

SEQ ID NO: 508511 - DNA, 418 bp, Homo sapiens
catcgcgcccagtgtgcctaccactattcacgtgtgtaaggacacgctcgtgggtgcacttctgaggccagacacgattgatttgccgctgcggattctggtcctcacccagagagctggtgccatcatcgtaccggagggcttgaccatctagaacattactgggcagacccagtcccggttcgatatccgtagaacagagaactctggagctgctgagaatcctgtgaccgtccatgccaccccatacgctacttatgaagcatgccgcatgattcttgaaatcatgcagagcgaggcatatgagaccacactagccggacagagtcctctgtagatcttgcgacacactggcttcggtggaagactgattggcgaatgcagacctttgaagaacattggacatgactcagggccg

SEQ ID NO: 508512 - DNA, 804 bp, Homo sapiens
gaggcctgggggcaatcactctaatggtctctggtgcagctctcagcgcgcagttggaggaacccgaaataacgttgttctcttgaaagatagagataaatacaatacttaaaaaatatatgtcactaggtgtgactaagatatgctaagagtacaagatttagaagggtaatatgaatagcttaagatttataccgagaaaatatgcaagattagcaagagtagcatgaggaaggacaggataaaaggtttctaaaacatgacggagtgtgagatgaagcttcttcatggagtaaaaaatgtttacaaagaaaattgagagaaaggactacagagcccgaatttaataccaatagaagggcaagtgctttaagattaaatatgaaggtgactttaaacagcttaaagttagttaaaaagttgtaggtgattaaaataatttgaaggcgatcttttaaaaagagtattaaccgaaggtgataaaagaccttgaatccatgacgcagggagaaattgcgtcattaaaaggcctagttaaggcattttactaaaggcaagaccgaataagtggacacgactactggggaagtgaaaggattgaaacaattgggcagaagatagaaggtttgaactgtgggaaaactgggaaaccagaagttaggggaaggggaagaaaagaactacggcagcttggcacaatagaagtaaaaccattctttaagaagaaaaaggtaatttaacctgaaagtgggacgaagaacaagacatgtagacacaaaagctatgggagaaaatatcaacaaa

SEQ ID NO: 508513 - DNA, 321 bp, Homo sapiens
gtgctggctacagtcctcatcactaccattcctcatcactaccattcctatgctgcacccgactgtcactgccgacggcctcgagactgctctaggtcagagcgactcacgtgccctgacggctggagatgctcggtgtcacttcactggcgcctccagtggagaggctgttcaggacactgagcgtgactctgtggtgtacgcgtgtcagtgtctgcgggtgtgcggcatggacatggagacttcactgactgtgctacccagtcagaccgctaacgcacctctcaatcggaaacatccgccagtcactctgcgcgctcg

SEQ ID NO: 508514 - DNA, 483 bp, Homo sapiens
ctgctcagagtaaaccgcagtggcaatgagataggatagttagtgaggattattaacctctgagcagtgatatagcataataaagccccgggcataattattattatttctttagttacatctattacaagtttagaaaaaacaaagcaattgtcaaaaaaagttagaactattacaacccctgtaccctggtacttatcaaatacttagtatcatgggggtagggaaatgaaaagtaggagaaaagtgagattttactaagacctgtattactttacctcactaacaatggggggagaaaggagtacaaataggatctttgaccagcactgtatatggctgctatggtttcagagaatgtttatacattatttctaccgagaattaaaacttcagatcgttcaacatgagagaaaggctcagcaacgtgaaataacgcaaatggcttcctctttccttctttggaccatctcagtctttatt

SEQ ID NO: 508515 - DNA, 236 bp, Homo sapiens
tcagctcggtaccacctatatcccagcactttgggaggtggaggcagggaatcatttgaggtcaggagttcaagaccaccctggccaacatggtgaaaccccggctctactaaaaatacaaaaattagccaggtgccgtggcgttggcctgtagtcccagctactcgggaggttgagggtgatcgtggggttgtaatcaacacaccacaatactatgggtgatcgtggggttgtaa

SEQ ID NO: 508516 - DNA, 395 bp, Homo sapiens
  misc_feature (19)..(19): n is a, c, g, or t
  misc_feature (46)..(46): n is a, c, g, or t
  misc_feature (67)..(67): n is a, c, g, or t
  misc_feature (106)..(106): n is a, c, g, or t
  misc_feature (154)..(154): n is a, c, g, or t
acagaatttgaaatgtatngaaatgcctttactacatggatggagnttttggcacacttgtgtagtncattgataggacagattacactgaggccatttctaatgnactacagtagactactacattagaagggagtacgatcattatattatntgtatgtagtactatcatactactacaataaatccaacttttcatagatttaaaatgtttatattacagtttctatattacttgattccgttgtgagttaagatattgtttaagatttttgcatgtgtttatgagtaaaggtaacccataataatccgtttttgtttttgtttgtttgtttgggtggagacaggctgctcactgttatcacccaggctgcagtgcagtgagccaagattgc

SEQ ID NO: 508517 - DNA, 337 bp, Homo sapiens
  misc_feature (186)..(186): n is a, c, g, or t
  misc_feature (211)..(211): n is a, c, g, or t
  misc_feature (243)..(243): n is a, c, g, or t
aagtgagtcgggacggtagctgtctcactaaatttagagcagatggtttgggaagaggcaggatggttttcaatctacttacccacctatttccattgcgcagtgcctcacataactaatcacctgtaaagcgtcctcacctgcttttgtttccagaactctatcaccgtctgggatgtttgagcnctatcttctgcagtctgtactttcntgcgctcagattcctgggctatgtgattcccnatcttaatgctagatcccgagtttaagctccagtatttcacgagaagctctcagccgtttctggtaacaccatgcagttactctcacgtttcta

SEQ ID NO: 508518 - DNA, 106 bp, Homo sapiens
cgatgaccacaggcaagtgatcagctccctgctgtctggggccctggctggtgcctgtccaaaacagcggtcagtccccgtgaccgaaccaaaatcatcttccaag

SEQ ID NO: 508519 - DNA, 1169 bp, Homo sapiens
gaaatggaatatgtttcatatgccgttaatccgggggactctggaatgatattgctccagttggcaatctactgtgtattcttgaacacggtcggatccgtcgcaatctgtcgtcgccgtacttccggttgtctggtcctgcatgcttgttcatctggtctaaccttgcggtcgttaatggaaacgtctgttccaatggagggcttgaagtttaaccgctttaaactattccttcagggccccgaaaatggcctttgtcttccggtccattccttgacttgccaactgcctagatatacgagtcactattgttcccatatttgcttaacatccatttcgtaggccttcccccgtgtgtccattctgctttgatagcagtcactccagttaccgtgtccatctttctcagacgaggaccctactgcgtgcccttgccatgggtgatgcacaactgtgaaatgagagtgccatcttccaatggtcttaggtgtctacagaaggtctcacaattcctgtccaggttgctggagtactcgacctttaccggggcatagtccgtccacctggactctctctctgggccagtgcatgtacttgggctgtccttcagccgtggtggcgagctgatttccgggtgtcatgttggctcctgttttaccacgcgggtggccatcagcactttccagaaagcaattcaggatacagtggagaaattccaggaagtaatgaactcctatcatgctcatctcggctccagccatcctgggcaccagtaacatgcctgatgctgtgccagccacacagccggggatgctgcagccacccatggtgctccgtagatttccgcacccctcgcctgtctgttctcaacgaatattctggcttgccatctcaaatgatcatgcgccatctgctgaccctgtggcaatggcgcaggatgtgactggggcacttggaagatgcccttgccaaggtaactaaaataatcatggccttctcatcgcgctgaataggctgctctgtcagcagcggggagcaagagctctttgtcacagttctgcaactgtcttcctggaagaccattgttccgtatttaaatcgctgtctgccaagtcctttagtccaccaagctcagatagcacagactttaactaagaggatgaaaattc

SEQ ID NO: 508520 - DNA, 260 bp, Homo sapiens
attactttcaagagacaactgtgtatacacatcgaaatatatatatatatatatatatatatatctgtataatatataaagagtggcactctgcctctctgtgcaccagcacagccctggtgacatggcaccactcagcagggctgtctctgtaggcatggacccccaggagacaggggggaaaacgctgctgctttaattacccgagaaacagctctttctgtttggatgctggagggcaggggccaccacagattaaa

SEQ ID NO: 508521 - DNA, 295 bp, Homo sapiens
cgtgtgaagaagagtgtggacagcactcatcgaggcatccagagactgtgaccgagtccgcgtcaatggctgggtaccctattcctccgaatcagcatccgcactcatcaacatggagaacaagaccatgtggttctctgtggacattgactcggacctgttggaggatctgcctgccgacaattacgctgtggctcgtgctggtgcccgtgggtacagggctgatggtgctggggctgatcttcctcctgctgtggaagtgcgggcttcttcaagcgagcccgcagtcgcgccc

SEQ ID NO: 508522 - DNA, 614 bp, Homo sapiens
taagttgactgaagacctaatctgatcattttggtatgaattgaatgagtattacactgggttcttatatataatacattttaacagggtgtagcatccctccttctatggaggagtatggtcctaggaaactatattagggagcagcgtgtgtaactggggatgggtgaaaactatggtccagtattgagaaacctatactcggttggccctcctataccagaggagagaatatagatatggcggtagtgacgttgacataatcagttcatacatgtctcaaagtatgtctccaaggaaaagttaatcttaacagtaagcacctatgaagcatcttccggaacctttaggtcggctttaaattaaaccttatgaatcggtaatatagtgggttaacttaagctaaagggggtcatgacgaagctctcggacagaatatatatatatgtggactctaaatcctacaattttggaatgaagcagccggttagtgtaaataacacaaaactcagtatcagtaaagtaaactgtgattaacaagtctaaatgactttatctgtactgatgcctgaataaggttactatctctcacaatattggcctgtggtaagacg

SEQ ID NO: 508523 - DNA, 181 bp, Homo sapiens
cagataaagatgagaagaagaagcaagatcaagtcatagaggctaaggaatcctttcagcgatgtcttgaaaatcatgagaaaatgacttctacaaccagatacaaaaaagcagagcaaatgtttggagagatggaagtttgggatgcaatatcagaacgtgaccgtctaggtagcgtaat

SEQ ID NO: 508524 - DNA, 276 bp, Homo sapiens
agaggatcccattctacgctgcacctggtctgcactatcacagatactgtgtcttttactaattgaaggtttgtggcaaagttgtattgagtaaatctattagtgccatttttccaacagtatgtgctcacttagtggtctctgtcttacatttgggtaattttcacatttcaaaacttttcttatatctgttatggtgatctgtgatcagtgatctttttttttttttggagacagggtttcactcctgtcacccaaactgttgcagcgtaaaag

SEQ ID NO: 508525 - DNA, 339 bp, Homo sapiens
atacagctggcctggtcactctgctcttcatcagcatccatgattattcttcacactacgagctggctgcatctcgcgcacagcgagagcagagagccaggcagcacgcggaccagctacagacgagagctagaagggaacacacagcacagacgcagcagcagcacacagcacacgcagcacagggcacgcagcaggcacagacggcaggaggcacagtaagggccctaggcacacgcaggggtagcacgagagcagcgcagcaggctagccgcagacagtgaagagcagtagcaggcaggcagcagagagagctagccgaggaccgcccacagacag

SEQ ID NO: 508526 - DNA, 224 bp, Homo sapiens
gtcatgtatcagtcacacataacctcagtcacacatgagagcacaggccgtttgatgcagacaggacccccccttgtgctatgctgcctagaagttcattccaccagatatgcactaaatcatcaccctcgagttcaaagtttcgcagatcttgagggcaaggtcgccctgcagccatgttctttgctacagaaaaacaaaacatacctttggcccttatcgag

SEQ ID NO: 508527 - DNA, 851 bp, Homo sapiens
tctcgctctggcgtcagagccgtcgtggctcgttccattctcggcggtggtacctgctcccggtggccctgaggacgtgtgggccagggcggccccgaaattaggaagcggagggggagcagtctgcaggtctgcggggctaagtgtcgcggcggctgcacctcgcgtcaagaatccggaggaggagactgcaacgactaggcccaggagtaactggagtccaaacgaggaactagcggcaaacaatctcaacggggaaaatgcccaaccaagaaaacgaacgcgaggggagcaggcccccacgcagaatgaagaagaatcccgccattctgggaggcgggctgaaggccagaagcctggcaggcacatatcaggcgggggcgagcttaggcgcacttgtccctaattttcgatgggccatacctaataggcactattgagcacaatgaagcgagcagatgactgtacaaacaggtccgctagcggcagactgactggacaactcccgcagaaagactacggaacagcacgatgaggcactatatgccgctttccaaaactcctgaaccctgacaacccattatgactttagcctcataccttgcaacctcctaccagtttccgctgcacggtcacacgtgaccactggctttaccagcttgctattcccgtgactcacatcttctgctacagcccttatcggcggctacacacctttaacccagggttctacctggcacacttagcaactctccttgactcatcgctcccggtcctcagcctaacacgttacggccacctactccgcttccaccctatcccaggaaacacaaccctcgcatcatattgaa

SEQ ID NO: 508528 - DNA, 1462 bp, Homo sapiens
tatgttttattgtgtgttttattatatactttgttttgtcttgttgaggtgatgtgagggcagaggggcgggcgggggcgggttattttgtgtttggtttgtgttgctagcttatcctcgacctgttcgttggtgtgagtgatgccggcggtgtcctccccttttttgttgttagtatcattgtcttgcctcctctcgtttgtttggggtttgttatattgttatagctacgtcatcttgtctgccgcgacggtgtttgtatgtggggtgtgcgccacaccccactttgttgtagttggagtaacttcttctgcctaggtagagggggaggctgcctctcaccgcccacccggcgggggtgttgggtgtggcgcccccgcacattgattctcccgcgcggcggtgtgttgttgtatattattcttctctcctcgggtcgcccctcctccgtcgttggtgttgtttggattgagcggcggcggctgctctctgttgggatgtgttttttgtgttgatgtggcttctctctcgtcggtgtggggggggcggtggataatatgtggttgtcggccgcgccaccacgacgatgtggggcgccccgctctactctcgctctgatatatgatgatgagattatgtctcttctctctcctcctcatctctctcttctgatgatacgtcgtgttgttgtgcttcgccctctacgcgcgcgtgacgagagcgtctgtgattatgagaggcgcccttcgacgatgagagcgcgcgcgcgtgtgtgtgtgagagagagggtgtctctcccacacccaccccatagagagagagaagatatgatatccccgcacgctctctcgctcactccactctctctcgcgcgcgcgcgcgcgctgctatgatcagcagctctcgtcgcgcgcgctctcgcgcgcgatgatcatagcaccagccccgactagttctctctcgtcgcgcggagagagagcgcgcgctcccgcgcgcgcgtgtttactccccgtcgtgtgtgcgctcctctctctgtgtctgttctctctctctcacaggtgttctccgcgcgcgcgccccgtcgcgggtgtctcgtctctcctgcgagagatagagagataagagagagacacacacacccacacaccacactctgtgtggttgtctctctgtgtgggtgagagagtgtgtgtacgacaccaccccctcgcccccccgctagtgtgtcacacacagcagcagcgctgctgtggatatatatacacagtgtgtgtgtgcgacacagcagctgaagaggggaccccgaggtccacacaccccggatttggccccgcgagaggagagaaaaataaagaacgtcatatatattttgtgggggtccccgaatacaaaatctttgtggagagagtcccccccaccaaaggggggatattttttactgaggccccccccccctttttga

SEQ ID NO: 508529 - DNA, 857 bp, Homo sapiens
agtgctgggcacacggcctgtgcgggttgagtgtataccagcgtttttgtttaccccctgtcttggcccagggttcttaacgttggagaagtggagagcgcggtgttccccctgtggtgggcccgtgctccctgggccccggtgggctctcccttgtgctcccttgggcgccttttcccatgagtcccctcaggggcaagctgcacagattatagatgggcggtgcacgtctgtcctcacagcccggggcgtatacccttattggggacggtgcgagtatctacttggaatgacaggcttaggccgggtatccgcgggcgaccccgggagacacccccggtgcacgagagtctcccaagaagcagggcaaaattaagggggccaaaccccgggtgcagcttcaaattattatgtaccctagtggggcggccccgaccaccccttccccagataaaaaggacatatccccgggaggagagcgctcacaaagcggcgccccccggaatacgggcctctaaaagacatctcccacaaggagcattgttgggaggcactaacgcaacgtgccaggcagagttcctcttttcaacagagcccctcttatgggccaggagtctgctacggacactgatcttgcgccgcacaaaacaacgtgggagcacacgctctagtagaccagagcattaatagctttgccactcatgtgggacccactctagggcagttgtgtaacacaacaataagacaccccacactggttagagactcccgccactcctctcggaaggtctttttagcgctcttctggaaatagtttcgggactttgcggcccaaagaatttcccccaacatagaca

SEQ ID NO: 508530 - DNA, 966 bp, Homo sapiens
aacctggagcgcgagcagtagctggcgtggtgcgccatggctgggatcaccaccatcgaggcgtgtgaagcgcaatgatccaggttctgcagcagcagtgcagatgatgcagagtgagcgagctgagctgcctccagcgagaagttgagggagaaaggcgggccctgtggaacaggctgaggctgagtgtggcctccttgcaaccgtaggatccatgctggcttgacagaatgagcatggaccgtgctcaggagcgcctggccactgccctgcctcccagctggcaagcaagctgacaaacagcttgctgcatgagagtgagagcaggtatgaaggtatatctgcacaccccgggccttaaacagcatgaacgacaaagcatggaactccaggaaatccacactcaaacgcaagctcaaagcacattgccagcaagaggcagctcgctaaggctatgcaccgcaggtggctcgtaacgctcgcgtgaactcactcgaccggacgaccttggcactgcacacgccggaacagacgcatgacactgcgccagagaatcctgtttgccgacgagactgccctgcgcacaactcacactgaattggcccaacacaccctgcacggctgtgggaagcgcctcttggacgacacacggacctctccaagacctacagataaataatgccggaagtacctccatgacttccccctgactccactctccggcggccgcaccacccgcagcacacctaggctgccgagaaatcgagacatccatacttagaacaccatacccctctaacacaccctgaaaaacatacaattatcacctgccacctaacacaccgacccaccatttataccctatcactacactcattgaccacacacctccttgaccctccactccacatctcaaacaccccaactacaccaccctcttctctcctcccctctagccatacaaac

SEQ ID NO: 508531 - DNA, 105 bp, Homo sapiens
gaaggagcctgggggcttctcgtagggtctctgctacctcatggtgcccccgggggccaggccagtggtctcgcctgggcccgctctcttggctgggggcacagg

SEQ ID NO: 508532 - DNA, 462 bp, Homo sapiens
gggacaaggtgggagtcccggatgagaggcgagggtggtagatgagggtggacccagtagaaagggtgagaaggggatggagtctgaagtttttgggagataaagccaaggagacgggctgagggatggcttatccctctttacacctgacggtccctccagctctcttcactccggcagggtccatccaaaaacactcggcccagggaaatctaatttcggttcaccccgtaataatgcccagaagacaaaaggaaacacggacagatggtcattatttatcaccccttggtttggcttggtaaattcatggtccggcctagcggttagcgtcttaatggttcaggtggacctttagaaacacattcaaggtgaataaggaggcctggctatattccaaaatcgtgtcagggggaataaccaaaaggattttattctttcactctcctttgggcgggcagg

SEQ ID NO: 508533 - DNA, 246 bp, Homo sapiens
  misc_feature (1)..(1): n is a, c, g, or t
ncagagaaaccaaaagacaggtaccaatgaatcctgccaagtatgtgaagaaaaagagaacccgtacactaatggtggaaatgtaaattagcacagctactatgaagcacagtatgaaggttccccaaaaaacctaaaaataggctcacgcctgtaaccccaacacagaagcccaagtgtggaaggatcacttaagcctacaagttcaagaccaacacggccaataaagtgacacctcatctctac

SEQ ID NO: 508534 - DNA, 769 bp, Homo sapiens
  misc_feature (31)..(31): n is a, c, g, or t
  misc_feature (297)..(297): n is a, c, g, or t
  misc_feature (367)..(367): n is a, c, g, or t
  misc_feature (392)..(395): n is a, c, g, or t
  misc_feature (503)..(503): n is a, c, g, or t
  misc_feature (528)..(528): n is a, c, g, or t
  misc_feature (557)..(557): n is a, c, g, or t
  misc_feature (752)..(752): n is a, c, g, or t
  misc_feature (761)..(761): n is a, c, g, or t
aagtagaatgtgtttatcaagggtgggggcnagggaatagggactttaataggtacagggtttgtttgggataataataaaaaagtgagatggggctgggcacagtggctcgtgcctgtgatcccagcactttgggaggcggaagtgggaagatcacttgaagtcaggagtttgagaccagcctggccaacatggtgaaaccccgcctgtactaaaaatacaaaaattagccgggcatggtagtgggtgcctgttatcccagctactcaggagactgaggcaggagaatcgcttgancccaggaggcagaggttgcagtgagccaagatctcaccagtgcactccaacctggggaacagtgggagtnctcaaaaaaaaagaaaaaaaaaagnnnnggccgggcgcggtagctcacgcctgttatcccagcactttgggaggcccaggtgggaggatcgcttgagcccatgttggacaacgctgtctctaccaaaaaattttanccgggtgtggtggcacacgcctgtngtctccgctaggaggctgaggtgggaggntcacctgagcccaggaagttgaggctgcagcgagctgtgatcgagccactgcactccaggctgggcgacagaatggggcccagtctcaaaaattacaaaataagaaaagtcccattgttcccaagatggtttcccgcctttaccccagatgtgtgaccctgagcaaaaaaacctttctgtacccaactgcctcanctataaaangggggtaa

SEQ ID NO: 508535 - DNA, 1414 bp, Homo sapiens
aaaggaacgctgttgagacagccaccaacacagttgtgtgtctccccgcaacgtttggaagcgggacacaatcttatatgtgtgtagaatgtttagaagacaggccgttcgacccaccgagggggggggaccaacacccaacaccacaagcatgtttgtgccattggggggccacacacccaccattgtgtcccgccggtcgtgtagtcgccgctttattgatgatgagtagaagacgcttgtcttgtacaacaaagggcccctcgcgggtgaaattataatagatgggaccgaacgggcgcctgtgatatatactaataagtaaatataagtgggagataaaacaagtgtggatgggatgaagaaacatgatttattgagatacacaggggggaatgttttattataacttcctgcggggcccacacattagttggtgtggaacaaaataatcaagagataaatatcttctcccggaatgggggcgcgccaaccatcagtctccaacagtaattttggaagcaggaagaagattcttattaaagaaagaagtgttgtagtaccccaacgggcgcccaacgggccacaaaagtgcctctccctctacgaaaaggggagaacccccttgttgttggggttgtctcctccccccccttcttgggagcgaattataatatggggttgtagaagtagggtattccccacaagaaaaaatagttttttaagggcacaacaacgggggagattataatgtggaaattgcccacaacggggaggaattgttataaagcagggcgccactataagggggagagattgtctcaattagagtaaatctggtgagagagagacgagtttgacacacttcctgtagaacccactgtgtgcaccaaagagcccccaactttgtcgcacactctaaaagagggggtgaagaatatctgaaatatctgtgatatgtgtgtttgtgtacattctgggaatattgtaatatcgccagtggaaatatttgtatatatgcacatataaattcccatggataaaatatgggtgtaatagtggagtgatataatatggtgtatagtaaaatcgcacgtacacacaaatgttgtgtgctaccctgtgtgttataaaagagtgttttcccgcacagaccacagtggcacttataatgggcgcacaatggcataatgtgtgttaaatggaggtatagagggaaacactcaaaataatataagtagttccttaattttcacgttgtgagaaaatgaaagtgggctataaagcacagaaagaagaacgttctatttttagttcttttaaaaaatgtgtgtgggtggtcttttttcctcagaagccccaagcacatgtatattttgttatttctccttgctatattcctgagactatacta

SEQ ID NO: 508536 - DNA, 446 bp, Homo sapiens
taatcatgttctatctctcgttacctgatgctctcatcttatatacatcgtcttagtgctgtccagattctaacgctgtatgatattattaatgtcattgatgtaaataaagttgagaaatatgttaccaggtctacagcaaagaatatggttcttttgctgactatacttggattccccactaagcagctggatctaactggagttaatggtctgcatgcaacttccagcaatgcactgtggtagttatatcagaatatacaggaacacttgaaacaaagggagccagtcttaatagataagggatgaacacagtgcaggcaagagagaccagctgcttcatgggcatgtgaaaaatctacttatatacagtcgggagaaattgacacaagattctctttttgtgcaagtaacaactataagctaagtaggagacaaagctagat

SEQ ID NO: 508537 - DNA, 165 bp, Homo sapiens
ttgtgagcgttggagggcgtgctctcgtgggctcacagaaggaatgatctggtggttaagataaaacacacgtcaaacttatacgagttgtccacatgtcagcaatggtgatcttcttgctaggacttgccatacctggacccaaagggggccatgggctctcac

SEQ ID NO: 508538 - DNA, 195 bp, Homo sapiens
agggataacaggggagtgagctgacgctcggaaggtgtcttgagacttatcatccgcgtgagggtggaacgcggcccccgacagacgctcggcagggtgtcttgatattatcatctgctgagggtggagctgagggtggacaggggagtgagctgacgctcggaaggtgtcttgagattatcatccgctgagggt

SEQ ID NO: 508539 - DNA, 419 bp, Homo sapiens
agtgggtgatctagaggatcccttcggttgtgatccgtctggtgtttctgcatatcatgaatatttatgagtgagtgagataagagtttccttaagatagtgatttcgataagcgtgaagctgtatctgttagctctgggctctaatgctctcctatttatacagtgaagcgcatggaaaataggaagaagctcagtatcggctcctcccaccataatccgcacttcctccactgcctcctggaccatagtttcctccaccatatggtccccccatgttcctgctaccaccaaagtttccactcttcatgggaccgtagttagaaggttgctggttataatttccaaaatcatggtaatttccacttccataatttcctcctccatagttgtcataaccacctccgtagcccccaccct

SEQ ID NO: 508540 - DNA, 1066 bp, Homo sapiens
gtttgcggttcccagactgaatcgtgagtgagcggagtatgaggtcgctgaggactgtccactgggacctagtctgaggatggacggccgcgattacctgtatgatcgacatactcgcgtgttggattgtcgcgtagtacttgaccttatgtagaatccatccagctatggtatgacctccatcatagagtaggcgtcacaacaacccggaatgtacatagagatgtaggttgaactctagtttctgctcgctgaagctatcagcgatctgaacgaatgcactccgtgggagtctcacgtctggggattttacacactctggacggcagcgaacacggcgctcaccaagtctacggcagtcgtgtcagtcatcctaatcggctgaattctctggactcctggatgccacgatagcagtcagggacgtgccagtgagagtgggacccaatgtatctagcttgctgcaactgattgctggcatttgccaaggatacttgcagcatcagctagatggctgcttcgaggattccttgcacagacaagcctcgttgcacaatgcgagcaatggccgctgtgctgcatttctcttcacctaacaacttagtgatcgcgcagaacaagcagacggcactcgtgcgactagcaaacgttgcggagccccacagttcctttcactgtggactctggtcatgtacatggctaacgtagacttcagggagagccagcttctggtgggcagcccctccctgcgaatagtgagtgaggacggatggcggagacagctagccaagctgcatcaccgaaagcatattgcactttataggtgcctaattgttctcaagttgcagctttcatcccctgaaggagtgattcgctgactcatctaaggacattaacataagcactggtgacggcaaccttgtcttcgcacaagaacaaactgagcataccttgacactactcatggcagttaagttccctagcataccggcaacttagaatacatgaacattcagtgtgtacacggaatctcgcggaatttccacatgagttcctggcccctaat

SEQ ID NO: 508541 - DNA, 198 bp, Homo sapiens
  misc_feature (155)..(155): n is a, c, g, or t
atgactctaagatccaataccgcgtcgaacaagtcttgtgtcggggagtatgttgcacgctaactaaggatgacgaggacacagagtgagctgcgttatttgaccacacggaactcaccggccgacacgacaggattgacagattgatagctctntctcgattccgtgcgtggtggtgcatggccgttcttagtttgg

SEQ ID NO: 508542 - DNA, 373 bp, Homo sapiens
  misc_feature (155)..(156): n is a, c, g, or t
gacgttttggtttctgcttatggtggggagcttgttcccgttcttcccacaagagaccgcaggatgtgggcacaagcttcccgtgcgcgtcttccttcactcagttggctacgcctcccatcctagctccacttccagaactgccttcaccctannggctgggggtcccatgtggtctatggtcttttaagagacagggtctcactgtgtctcccaggctggagtacagtggcgtgatcatcggctcactgccacactccaagcttcaccggaagatttcaaaacgccgaatttcctccttggcctcagcctcccgagtagctaggattacaggcatgcaccaccacgcctggctactttgtatatttttacg

SEQ ID NO: 508543 - DNA, 603 bp, Homo sapiens
ttaccaagcatgcactatagataactgtaaacggggcaaagtaccagctaaccgagaaataaccaggtgaccagtagctcagctcactgcgccccctccgaatccgagggaagcactctgtgcttggacagcagccttgtgtgcgatgatggcgaggcagggcgaggttagtatgtgcggagggacatgtatcgtatgctttaaagctacagccagaagtcgtagcgctcctgttcctgcttcactctctatcattctcctcagtctcaatactcattcaatcgcaccctctggccttgtctaagctaaatgtggttagagctaaaaggtcgggataggtaacgagatgaatggctgggggagccctgagagaggtcgtcccacatgttgcggaatagggtaaaacaagatctttgttgttgtaaggagagccacttcctcctccaacacagcgatgtggacacgcaacagggaaatcaggatcacccatggctaaattacccctctccgtcatgcccacatttatatggtccccagcactgtactcaatagcggggcaagctgctgaaaagggcaagaaagaacactccagcaaacacgtct

SEQ ID NO: 508544 - DNA, 81 bp, Homo sapiens
cgtctattacacttttctgatacaatataccacaacgtactagcaaaaaagaaaacagagaacctttaggtcgactagacc

SEQ ID NO: 508545 - DNA, 428 bp, Homo sapiens
  misc_feature (371)..(371): n is a, c, g, or t
ggtcgacaatcagttataggggtgcctgctaaaatcataacctggtctgtggcatttatgcaaaaattgttatctgattgattggactggtaggggtgagcatgaagctgtaatcttgccagttgttaacaccattgttggaagaagaatgtttccagggtgagatcttcttagagccctgaaaaaggcaaatgaagagcagggagggctccttcttaatcttgtaccatccagaggagaagggcaccaacaggccaaaaagattattcttgtgccctgagggatcaagttatttatgaggcacgggcgtcggcgcggccgccaaatttataataataagggggcgcttctaccgattaaatatcgccganttaaggaagggggattgggaggggaagattcttacccaaagtcaaattggggaaacg

SEQ ID NO: 508546 - DNA, 102 bp, Homo sapiens
ctcttactagtacccatgtccataggctgtttatattttgtgatatcctctggggctggctatccatgggctgcatgagggaaaggaagaagctaagaattt

SEQ ID NO: 508547 - DNA, 165 bp, Homo sapiens
aacttctataaagcgaatgtttgcctgttactacagatgcaacggcaccacagcagaacctttggggcgatggtgcctcgcccaaagagaaccgcccaccaagtcatgccattacactaattaagtgctctagcttgtacctgatcgttggtgcctcacgccaat

SEQ ID NO: 508548 - DNA, 399 bp, Homo sapiens
atgagtaaatcttgtgcttacttagtaaggcatttttacttcctgcagaaagggtacactcacaggcagtttggccatgagagtacacccaacaaaggagatagggtcatttataacctgacgcatctaccttactgctgtttccggtttcctttggctggaacgggacctcacattctgtattggtcccgattgattagtaacttagaacttttaaaagaggcaaaggtagaggggaacaaaggaaggaggaagtaacttgtggaatgttgagaaaggtaaaaacacttttaaataaggaagaggaacagggtatggactaatggttggttggaccaggctaaggggttgcagggccaatatttaggctaaattgtgggagccaagatttactcatcg

SEQ ID NO: 508549 - DNA, 413 bp, Homo sapiens
gatgcatcatacgctgcgtttgtccaccaggtcctggagcctgagaatattcttgcggacttcctcagtgtggtaacgtgagtaccttccacttttctctcgatgtatgcgtagacccttgacagcttcacacattgcgcttctgttcactttcaaattcaccttcaagttcacgaaccctggcctccagtttctggatctgcttcttcccacccttcagggccagctgctcagactcatccagacgatgctgcaggtccttcaccgtctgttccaggttcttcttcatccgctccagatcggcgcaggtagtcctgtaccttcttcagctcctcagacatcatggcagcatcagtgatggacttcttggccttctcttctgcattgcgagcttcctagctaaataatctcca

SEQ ID NO: 508550 - DNA, 897 bp, Homo sapiens
attccagaacttgggaggccaagatgggcttcaaacacaaggtcaggagttcgagaccaccctgaccaacatggtgaaacttgttctactaaaaatacaaaaattagccaggtgtggtggtgtgcgcctgtagtcccagctactcaggaggccgaggcaggagaattgcttgaacctgggaggtggaggttgccatgagccaaggtcacgcccctgcactccagcctgggtgacagagggagactctgtcttgaaaaaaaaaaaaacaaaaccaaaaacaagaaaagaaagggaaaaggattttcgaaatttaaagcctcaaggggtttataatgaacaatattttggcaaaaactagataattccagaagatatgaacaatcttctaagaaagcacgctatacctagccaattctgcttcaggaagaacataggaatgcggaacagaccaagttaacaaactaggggctttaatcagggattaaatttcccctaagaagaaaagcccagaaccagatggtttgtggtgaatttccaataaacaattcaaaagaaaatacctattctccaaaattagaagaaagaagactctaaccccattttgggggtccacccaccataatatcatgggcgagcacggagttcacgaacttggatgatggccattctattgaacatgcctacaactccggtaatctaccatttaatgggcgcattaaggtctaaccggaaaggattcccgggaaaacaggggcatggcatatgggaatcccgacgaaagggaacggattaacgcagaacctgcacccacatgtacactccacgtgacaggatagtagcggagaggaccagaggcagctgacaaggatgagacacagaagagaggtaccgacacgc

SEQ ID NO: 508551 - DNA, 177 bp, Homo sapiens
acgtcttgagtgcacatgctagactgagctccattgtaaaaaaacacagtgtagcaatgagacatgatcgtgttgtggtattcaagagtggaatagtgtacgtgtctcatctctctagctctctatctctagctctctctctgtgtgtatatttcacagtgtctctgtgtcactgtc

SEQ ID NO: 508552 - DNA, 149 bp, Homo sapiens
cgccagcctcgaacgcgacctcgaccttggtcagcgccagctggtggcacagcgggatcaggtcactggtgcgcttggcggccatgatgccggccacgcgagcggtcgcgatgtcgtcattcttgggtaggccgccgctggtgatgagg

SEQ ID NO: 508553 - DNA, 130 bp, Homo sapiens
tgaccgcgggtggcagcagaccctatttctaaaggaaaaaaagaacataatagtatctcgcatggtgaaagtaagtattactttgtgaaatatttaattcacctgttcgtgtaagtgtggactagagtgg

SEQ ID NO: 508554 - DNA, 432 bp, Homo sapiens
agtaggcgaatcaggtaaaggaaaatcaacaattttaaaaataattttaggaattgaagataattacaccggatctattttatgaaataataaagaactaaaaactattaaagaatctagtttaagagaaaatgtaagttttttagacggaagtaattttttatttagagattcagttgataacaacattgcattatgagataaacaattgaataaaaataaagtaaaacaaatgctaaaatactttaatttgactaaagaattaaaggattttcaacaatttaataaagaaaatattgtttcactttctgaaggtcaaaaacaaagaatcactcttgcaagattgatgtatacagaacctaaatttattattttagatgaagtatttgctaacttggacaaaaataacgccgataacataaaaaaaaaaaa

SEQ ID NO: 508555 - DNA, 654 bp, Homo sapiens
gagcgttgcgcgtgcgcactgggcctgtcagcggcggtggaaccatggaggccgcaagcccttcgcccgggagtggagggcccagtccctaacccctggcagtagggtgctttgaagctgcggtctgtgactgtggtactgtactgggttctaggttgaacgccagatttttgcagagaggaggacgtaacttatcaacgagtaccgtgaacctccacaatgactggggggagtatccccgagggtctaattgcgcttcatgacttggggatgtagctttattacggactgctagagcatggggaaaaaacatgttgtttacacataatatttatttacaagatgtacaaatggtccatcctaaattttatggtattggtgaaaatatgtgggtcggcctgaaaatgaattatctgccaggtattgctatcagaagttggcatgcagagaagacaatgtccaacattttgaaaatggcagttgctctggagacgtgtctaattatctttcagttgtgtgggaccacatcttacaaagttggttgtgctgttctccattggtccaaaaattggacattattatacatgcaggaattttcatatgcaatattgcgccaggaggaacatgaagagaaagaccttatgaaccaggaat

SEQ ID NO: 508556 - DNA, 334 bp, Homo sapiens
cgggcgccacagcttctcccatgatctgaattatgattttcctgttcaaaaaccacctctggccaaaattcacatttacgagccattactcgtatgttgtctgtcacagaacatatccacagttccagctttgaaggatctgatggctgaagttcggctatagtcagatttttggcaccacctgtccgttcaggctagcaaacctttctggagatatgcaatgtctaagggggtgcctgagagcagcttctgcaaaacgcttagaaacaccatgaacaaaacatgaacacagttgaggctgcctccatctgaggctgtgctttttcctaacaag

SEQ ID NO: 508557 - DNA, 256 bp, Homo sapiens
ctctagaggacccctctctccacactggtctccagtcagtgtcaggtagcctggctgctccacccactcccaggagaccaaacagccttcatacatctcaagttgggggcaccaaaaaagggggcacagggggggcacgaaggctcctcattcaaaatacaaaaaaataaaaaagtattaaggcgaagattaaaaaaattttgcattacataatttacacgaaagcaatgctatcacctccccagtgtggagagag

SEQ ID NO: 508558 - DNA, 305 bp, Homo sapiens
tagctgtttaactttgtaagatgcaaagaggttggatcaagtttaaatgactgtgctgcccctttcacatcaaagaactactgacaacgaaggccgggcatgccttttcccatctgtctatctaactggccggccaggaaaggaaaaactttcatgtttgtgaaagaaaaaattgggtggaagaaattgggtgggaccacaatgaaatcttgaagtaaaacacgcctgccccaaggtgtccttcaagctgtaaagcaagttaatccaagtggcaattttttttttgttcaaatgattttaattat

SEQ ID NO: 508559 - DNA, 810 bp, Homo sapiens
cggtaactttgctgaactaggctgttactactttatgaacgatacatgtcctgcctaatatactgtcagcatgcaaggtactcacgagtgagtgcaccacttcaagggctttactccgttaacgagattttgttggcatagtctactggcggttgggcagttttgatcgacaatgggctcaaccagatatagccgcaaggtgtcagggcagcctgctgggcagagttacagcttcctgtggtctttcatggtgtagttacccttatagatcttctgctgtaattagctgccaacttaatgtatgttacacaaaagataaactatactctagccgccagaccatagatgctagtattttttgctataacttggatttcctaatactgtcatcctcaaagaaagtgtacttggtttctttaaaaaagaaagtgtatttggaaataaagtcagatggaaaattcattttttgaaattcccgttttgtcactttttcttcgataaaagatggccactaattaccccttttcggccaccatgtatctcgagtacccccgatggagacgtgggctcaagataagataggtattggtttcacgcacgtgaggcaacttagacagctttggaagatggcataacgatgtctcacctggacttaagcatctggcatctaacttcaacagtgctcggtttctcctcactgtatccaggttccctcccagaggagccaccagttctcatgggtggcactcagtctctcttctctacagctgactaacgttttttctgaccagatgacttcttccacactaa

SEQ ID NO: 508560 - DNA, 282 bp, Homo sapiens
tggtacagcccgtgtggcaaacgacaatgctgatgcctccaagatatctattccctcctccttcattacactatctattttttatttttttgatgtgcggtgtctcgctcttgtatgcccagtgctggcgtgcaagtggtgtgatgcagctcactgcagcctcgatctcctggtctcaaagctgatcctcccgactcagcctcccagtcgctggagaccacaggcgcacgcccaccacgccggctacttgttgtatttactgtaaaagacagggtttcgctt

SEQ ID NO: 508561 - DNA, 311 bp, Homo sapiens
ccctgatcacctcagcctcccaagacactaagactataagcccacaccaccactcccagttgatttgttgttgttgttgagagagggtctcattatgttgctcaggcaggtctcaaactcctggtctcaagtgatcctcctgcagcacgggagttttgacctgctctgtttccaacctacatcagtttacccctcgaatagttttaaaaaacatgaagtggggccaggcgcagtggctcacacctgtaatcccagcctgggtgacagagcaagactctgtctaaaaaagaaaaagaaaaatcacaattgtc

SEQ ID NO: 508562 - DNA, 402 bp, Homo sapiens
cgaaggctctctcttactagaggtgcaacataaattggtaatgcttggaatggcactagggtagaatgagtcgtcaaaggcatatcttctatatctgaagagtatccttccttcagggatttaatagactgagtcagatgggtctgatcttaatcacaattgtctcttctgaggaccgctgataagcattgacttgctgtccccttaggaaatccgggcggatacaaagcgtttctttacttttcacttcaattaatgctgcgcttcgctaggtgagtgcgtactttttctacctgtacacattcctgcattcatgtattttgttaaagtagactaaagctatgttacatggaaaggatttagaagccttttgtttcccttgctttgttttcataaacagta

SEQ ID NO: 508563 - DNA, 171 bp, Homo sapiens
gatacaaagagcccaaatcccatctgtgtgggtctacctcctgggaccttcctacatataagcttcataacatacttgagaggctgatgtgtgagacaatcgatttatcccaggagtttgagatcagcctggacgacataactaaatctcatctctacaaggacgaggtgg

SEQ ID NO: 508564 - DNA, 204 bp, Homo sapiens
  misc_feature (33)..(33): n is a, c, g, or t
  misc_feature (75)..(75): n is a, c, g, or t
  misc_feature (160)..(160): n is a, c, g, or t
  misc_feature (178)..(178): n is a, c, g, or t
  misc_feature (189)..(189): n is a, c, g, or t
caagagctctctgatcactattacatatttttnctagaaaatctaaagttcagaagagaatgtatcactgactgnacttttattacaatatttggatggagtaagttttagggtagaattttgttacagtttggatttaatacttttgaaaagtaaattncttgtttactggtttganctataatactnctgttatactttacg

SEQ ID NO: 508565 - DNA, 234 bp, Homo sapiens
aatttgaagtaaaaacaaaccgacctggattactccggtctgaactcagatcacgtatgactgtaatcggtgaacaaacgaacctttaatagcggttgcaccatcgggatgtcctgatccaacatcggggtcgtaaaccctattgatgatatggactctataatatgattgcgctgttatccctagggtaacttaccccgatggtcgatcaagaggattaattgattatagcac

SEQ ID NO: 508566 - DNA, 263 bp, Homo sapiens
tctgttggacatcattgtccttagagtttggaaaactacacataatggaccttggaatacaggtatgatattggccaaacgcggtggctcaagcctgtaatcccagcactttgggaggctaaggtaggtggatcacttgaggtataggagctggagaccagcctgaccaacatggtgaaaccctatctcaactaaaaatacaaaaaaattagccaggcatggtggcgtgtgcctgtaatcccagctacttgtgtaaactgatt

SEQ ID NO: 508567 - DNA, 1617 bp, Homo sapiens
ctgaaatccgagagaaaatttaccatgatccccagctgctccgagagatcaaaggacacaagtgttacagaatcctgaggtgtcacttttctgcctgaaacctctggctggtggcacctttacctgtgttttgctcgggcccactgggttagttctgtccactcagctcatgctagtggtctggatcccacacctgccaagggcgagctgggtacagagcagtgaagggtgtgtgagcaagcgagcatgggatctggccactgcacacagccaagcatgccagccgcagtggggtgggcagctccaggcacaggtgccagctccctgtgaggctgcagctggaccaggccgactgcaaacagcttccactgtgggtatcagggaatgcagtggcacccagaagcttggagatgcaggacctgcagagccccaaagaaggtgtcacagccctggttggaggagctcctaggtctgtgttccctgaagggacacagctcttctctccttctctcttctcttcttcttgcctgcaatttggcaagaaaggatagcgtttcagccctgtttatgttacacctctttcagccctgctagttggcaggtcctgagttcttgtcctgagtccaggaaaaatgaggtatgtggacaagtagaaggtgagcaaggtgaagaggtgctttattgagccacagtacagctcagaggagacctgcagtgggtagctcctttctgcaggcaggtcatcccaacgtctgttcagctctcagcagctgagaggagacgcacggtgggtagctgtgcccatagtgcccaggcgttcgagctgaggagggccttccggccactgctgagccactcttagccacacctcagcctccctcctgtgcttgtcagtgcccaaattctggagggggccgaggtggcagggggctggcatgtcagcactgccctgagcttgcacaaaccaggccaggttgtgactgtgcccaggtttggcctcaacttggatctgaatttggagtgggctctggaagcagagagatgccagggggcaggaccaggtacaactgagcctgcgggacaggggggcttgctgggcctctgagagtgcagagatgcctgggtttgcagtcatggctggatggctgcagctgtgcctgggagggcggggctcctgcctgataatttagaaggggcaggtctcccacccattcctggctcccaccagctctgaggagtgcacagccccagccactcctccccactgcagccagtgtctccatagcaactgctccacgtgggccactgctgccatcataaatgggtcctttcaggttccttccttgtacctcagcactctgggggtcattagaagccttagcaacactgctcaccacagtatagctccagaggccctagcagtcctgctcccacggatcccacttctgacaccatctattaaaagaaaatcttcagctgaattaaatttaaaggagcttaattgagcaatgaaggattcacgaatcaggcagcccccagaatcacagcagattcagtgagactccagcacagacacatggtggaagatttatagacaataaagggaacatgatgtac

SEQ ID NO: 508568 - DNA, 590 bp, Homo sapiens
  misc_feature (330)..(330): n is a, c, g, or t
  misc_feature (491)..(491): n is a, c, g, or t
  misc_feature (514)..(514): n is a, c, g, or t
  misc_feature (525)..(525): n is a, c, g, or t
ccaggttctttgccagattagtttcttattattcctcctatttgagattaaatattacctaatttcttaaacagatttcctcttctctccttttttaaatacattttttaaactttttaattgtaaatttgtctagtgcatctctacccttactagagatacaaactctgcaagcaaattaccacgtcttcttcatttttttattctaaatccagtgtctagaacaatactctgaatatattaagctcttattactatttgttgaattaatgataatgtcatatgagactcatagaatcaaagaatattcagtttgagagctacaaaatnaaaagacctttataagcaaaccggcctgtcttttgtaaaagggggacatatgttatcaacgtgccttgcatttaagaagcttattaaacactgtgatgcaaaatctctccatttccttctccatcagctgcgtatttgtatatgtgtatgtatgagattgnatttctttcttaaaagtccttgnattaggcattntgcgttgctctaaaggaatacctgaaattgggtaacttacgggaggttttggctctggggtctgc

SEQ ID NO: 508569 - DNA, 536 bp, Homo sapiens
ggccacgctggccatcagcacacctccttaagacgggcagcgagagcagcatcgactcgcctcatgaagcagatctcctccttcatgtcaggaaatctcggatgaattcagatggtgggaggttgtccatggccatcagatgcccggtgtcgagcaaactatccgtcgtcaagacgacgtgccgtccttatgaactttgcctgttcacacatgcgtgcgggaaacgaggagtggcatttgaggtataacgcgcgactgtcgtgtggcacgtgcagtcatcagtccatcatcggaagagaagctcagagtagcaaaggtgagacagggcatgtcacatctgttgcgacgttcagtacgaggactggcgaggttcgacagatgctagggcaccacgtatgactaacatactcctgaggtgcagtgaggggccctaagatcactcagatccctcagaagtacatcctgattacatctatacatgctgagttggtcttgggaccgatgccggaggtccgggcatggtgctagtggagtag

SEQ ID NO: 508570 - DNA, 139 bp, Homo sapiens
gaccctcccgcccagctgtcaagaagtacttaatatttggtttcaacgttttttttcatacgagaaaagggcagcggggcgctttttaatctctcgcatgacaactcacagagtgcttccaagtctttcatgtactctc

SEQ ID NO: 508571 - DNA, 215 bp, Homo sapiens
caatgtttctgtttcttaaatttaaaacgggccgggtttgcctttttttatcaagagagcttaacagataaaaaatgaaattagtttattttttacttgccagcagaggatctgttttattttaggatgcagggtgaaacttcccattcaactgaacaactagttgtcaactaatgaaaataaaaaattttctctaagccaaaaaaacaaaaaaa

SEQ ID NO: 508572 - DNA, 308 bp, Homo sapiens
  misc_feature (180)..(180): n is a, c, g, or t
  misc_feature (295)..(295): n is a, c, g, or t
aagttgtagagattacaggtgtgagccaccatgccgggttaggatttgtatatttagtgatacgagtgataaaatcatgtgggtagtgatgggattcatatatgtgaattgtgaattgtcagatttgaccactgggtgtgattaaatttcagtaaggagggacagagatcgtgtgatgtncaatggctcttgtaagcccatggaagttttggtctcattctagtgtcaggaagtggtggatagaataatcaggacggttagaatgtgtccttaatattccctcagaagtgttggnaggcccttccctg

SEQ ID NO: 508573 - DNA, 665 bp, Homo sapiens
  misc_feature (297)..(297): n is a, c, g, or t
ccagtgggcaggcgggtctcgaactctggagctcaggtggtcggcggccttggcctcccaaatggctgggaattacaggtgtgagccacggtgtccagcctagtttgggaattcttcatatataaaaagctttttaagaaaggtaatatttgggacttctggctcctggggaacgagggacataggacgttttcctaatttcttttcttcataactaacaactaagagagcccgtgggctagtacattaaggaaagacacaggggagcctcgtgaaaagcggattgaggcagaccanaccaggggatctgggagactcgaggaattgacacagatactgagtttcctgtgggtttactttggctttatatatcccacgactgggagccaacagaaagaagctgacaacctgaaattggcagggggcccaaacacggaaggtgccaacaaaagctccccggtccagccagaagaccaggacacgggcagcccagtgaggcagaaaacttaaagagtcatggctctactccaggtccacaccatagaaaaaattatgcagccccaaatttacacccgcagaggtgactggggagcctagggtttgacaacagtctagcaataaggaagccactctccgggggcatggaggagcaggattgagggacc

SEQ ID NO: 508574 - DNA, 133 bp, Homo sapiens
caacaccttcgtccattccgacatggcaacatcgagacacattatccatcactatgcgctatttagtctggttcttcggcgtgtgcagtccactgtgacttttgcaccaaggtatggactctcggcgtgtgca

SEQ ID NO: 508575 - DNA, 191 bp, Homo sapiens
tctggaagcccataaatcccagagccaggagatagaggaggcagctgtcctggttccccctactactctcaaaggcagttcatcccttttggctgacaactctcccggccctttcacagttctagctcaacccacaccagtcaccattacctaccaacttcacactcatcccaccaaactaaaagcttaca

SEQ ID NO: 508576 - DNA, 1360 bp, Homo sapiens
ggaggaagcaatgctgagggggctggtttcctgagcttcgacaaattcctggtgtcgtcttctgtggtctcctcgagacttgccggggttcagcactgaatcccatcggagcacggagcgtgggttgagtgaggctagaccaaccgcgaaggcacgagagtagaggttatgcgtgacatgcacactgtacggacagactccatcttctccgtagccgatgtgactatcataagagactcttaccaggtggagcctcgacacacgtgacgcttggctcgtcttggctctacatggcggggacttgtggaagtcgtccttatctctcgccgttcatcatatcttattcttcgagtttagagatctatagacagagacatcaacgtaactcatgaagaacgagggagcatcaaggtgtatatgacgccaggggtgctaatagagcactcagtgcgaactgagcgttgcagtccccaatccccataactgtatgtaacaatagtagtcatcatgacgtgaatcccgtgcgaggcatggcgttgagattgcagataatatcgtcgtgccctaacggagccgtatgacacccacgacaaagggcatgcgcagtactgcgtacaggtccaagctttgaaagatgcactgggtggcgtaacgtaagcttaacaggagcacggtgaaaacgccatgcccgtgggaaaacgatgggaggattggagaaactgcttgggaatgcaaaagggtatgaaccatcgagcacccggaatgtcccaatcacagagggcgagagaacaccgcaaatactcagtagggtcagaccacatagagaccagagaagaccggaaccgcgagtaagaacaggcacaagttgggaaccgtagcaaaatagacaccaacatagacacagacaatggaatacggggacctttcgccgcagagaggaaagcgctagattacaccacaagaaagggcacagaggcaaaggagcacatgcaaatcggcaggggatacacagggtgccgccacagggaagccacgggccagatgccacgaacaccgtgcccataaaccaacgggattggacgcgacataccacgatgacccgattgaaacaatttacccaggaatcacagaaatgcaccccccccggtgcacggagagacgcacctatggaagccatttcggaagacccgagtaaagggaaaatgaacaccccattcacagacaacgtgggaggaaacagttgcacgctagaacatagggacacctagagtacaaacataacgcaagagagaacaatataccatgaaaaaaagaagaatgacccgagagaatgaaggcattggaatcacacaaatcaaag

SEQ ID NO: 508577 - DNA, 698 bp, Homo sapiens
cgcagtggctcatgcttgtaatcccaacactttgggaagccggggcgggcagatcacctgaggtcaggagtttgagaccagcctggccaacatggcaaaaccccgtctctatagaaaatacaaaaattagccgggtatggtggcgggcacctgtaatgccagctacttgggaggctgaggcaggagaatcgtttgaacctgggaggcagaggttgcagtaagccacgatcgtgccactgcactccagcctggtggacagagtgagacgccgactcacaaaagaaaacaaaacaaaacaaaaaaaggccaggcgtggtggcttacacctgcaatcccaacactttggaaagctgaggcgggcagatcacgtgaggtcaggagttcaagaccagcccggccgacatggtgaaactccctctctattaaaaatacaaaaattggctgggtgcagtggctcacgcctgtaatcctagcacctttgggaggctgaggtgggcggatcacctgaggtcaggagttcaagaccagcctggccaacatggtgaaatcccgtctctactaaaataccaaactcaccatgcatggcgggtgcctgtaatctcagctacctggggagcgctgagatggcgagaattgactgaacccggaagaacgggggtctgcagtgaggccaagatgtgcccctgccttccaacctg

SEQ ID NO: 508578 - DNA, 209 bp, Homo sapiens
  misc_feature (21)..(21): n is a, c, g, or t
gagaggtgggacacgggcccntgccaccacgcccagctaatttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctcccacctct

SEQ ID NO: 508579 - DNA, 117 bp, Homo sapiens
gagggagttcatatactcgctggacctggaccagctctttatctgggtcctgcgggagtacaatgaagtggagcccatcatcctctccgtgggcgaggaagatgaggtctccatcaa

SEQ ID NO: 508580 - DNA, 715 bp, Homo sapiens
  misc_feature (11)..(11): n is a, c, g, or t
  misc_feature (134)..(134): n is a, c, g, or t
  misc_feature (278)..(278): n is a, c, g, or t
  misc_feature (280)..(280): n is a, c, g, or t
  misc_feature (288)..(290): n is a, c, g, or t
  misc_feature (314)..(314): n is a, c, g, or t
  misc_feature (317)..(322): n is a, c, g, or t
  misc_feature (326)..(329): n is a, c, g, or t
  misc_feature (332)..(333): n is a, c, g, or t
  misc_feature (344)..(344): n is a, c, g, or t
  misc_feature (347)..(347): n is a, c, g, or t
  misc_feature (358)..(358): n is a, c, g, or t
  misc_feature (375)..(375): n is a, c, g, or t
  misc_feature (421)..(421): n is a, c, g, or t
  misc_feature (436)..(436): n is a, c, g, or t
  misc_feature (455)..(455): n is a, c, g, or t
  misc_feature (477)..(477): n is a, c, g, or t
  misc_feature (542)..(542): n is a, c, g, or t
  misc_feature (578)..(578): n is a, c, g, or t
  misc_feature (583)..(583): n is a, c, g, or t
  misc_feature (647)..(647): n is a, c, g, or t
  misc_feature (674)..(674): n is a, c, g, or t
cttttcagccntctttttcaatacaaaataaacatattcattttcatattttacatttctcacctctataacatatacaataaaaatcccagacattgttggctggctgattcttgcaaagagatgcataagtnaactagtcaagtacatcttaaccattttgggtgtcatttagtcagtcagtcatgaaacagtaatatggagacataattttgaaaattaagcaaatgaatctgttctctagaaatgccttttctcgagttatagtattatatttntnactattannntttattcaaatcagtcggttttcnttnnnnnncttnnnnttnncatctctagtngcngttacggtggngccctgtgtggtctggnatgtggcgacatcagtgatgatgtcatgatgtcccacgggcagggnctctggcccccttcncggggtgtcatcacttggncctactttctgcttattctgantttcctggacaacttcagtgccttcaattattttcctgtagtagggcacagatgggggacttgtncttcctgcaacaacataggacctttctgggtaagcnaagtnccaaaaccttattttcatatctgagccagctgttagtaggatagggtttcggtctgcggggctncagtggataccatggacgctatggggngaaggctgtaattcagaaagtggtggtgcactgctggccca

SEQ ID NO: 508581 - DNA, 124 bp, Homo sapiens
gctcgactgacccgcctactttgcgggatgcctgcgagttgcgatctgcccgctcaaaaattcgtctcacattagcagtgaggattcgggcgtcaccccgaatcgttagtcgacgcggccgcaa

SEQ ID NO: 508582 - DNA, 467 bp, Homo sapiens
  misc_feature (2)..(2): n is a, c, g, or t
  misc_feature (9)..(9): n is a, c, g, or t
  misc_feature (76)..(76): n is a, c, g, or t
  misc_feature (85)..(85): n is a, c, g, or t
  misc_feature (232)..(232): n is a, c, g, or t
  misc_feature (426)..(426): n is a, c, g, or t
anggttaancaagggtaaaccgaccaccatgggataaccataaccacaaaggtgattttccccctcccaatttggncacccttancctttccaaggtaccatgaaccccccacaattagtgtcatttgtgagaaaggtttagaggaaccacaaagtatgtatgatcccaaaaagcaagcaacctgctgggcacagtggctcatgccctttaatcctcagcaccttcgggagnccaaggcaggagggtcgcttgaaccccaggagttcaagacaagcctagacaacatagtgagacttcatctctacaaaaaaaaaaaaaataataacaggcatggtggcgcttgcctgtagtcctagctgcatgggaggctgaggcaggagaattacttgtgccccagaggtcagggctgcagtgagccatgactnatcactgcactacagccagggtgacagagcaagaccttgtc

SEQ ID NO: 508583 - DNA, 366 bp, Homo sapiens
  misc_feature (4)..(4): n is a, c, g, or t
  misc_feature (30)..(30): n is a, c, g, or t
  misc_feature (48)..(48): n is a, c, g, or t
  misc_feature (58)..(58): n is a, c, g, or t
  misc_feature (60)..(60): n is a, c, g, or t
  misc_feature (63)..(63): n is a, c, g, or t
  misc_feature (69)..(69): n is a, c, g, or t
  misc_feature (76)..(76): n is a, c, g, or t
  misc_feature (86)..(86): n is a, c, g, or t
  misc_feature (125)..(125): n is a, c, g, or t
  misc_feature (173)..(174): n is a, c, g, or t
  misc_feature (181)..(182): n is a, c, g, or t
  misc_feature (187)..(189): n is a, c, g, or t
  misc_feature (198)..(198): n is a, c, g, or t
  misc_feature (220)..(220): n is a, c, g, or t
  misc_feature (242)..(242): n is a, c, g, or t
  misc_feature (262)..(262): n is a, c, g, or t
  misc_feature (277)..(277): n is a, c, g, or t
ctcnatatctctgtgccactttctgaatgnaacttattttgtgcctanagctctcacncnctnataatncttattnccttctgggnatttatccaaagtgggatcaactgtacgcctttggtatntgaccataaatcttttctccgctgacatttggtgatgcttcacatggnnatataannaaaannnaaatctagnttaatactgcattatttatttncctaaggctaaagaggagcagncctatgcttttattcagcancctttatctgtgacntcatgtctgataactgcctttccttccttctgtgcctttgaatacaaatttcagttctgcaaaagtgaaacattaaacattgccaacgc

SEQ ID NO: 508584 - DNA, 754 bp, Homo sapiens
tgcagaccgtgctagtatagctccaggaggaagcccaggaggctgatgcctgccaggaggatgctggcactgaaggtggacagagcttgaaggctgagcctggttggtcttcaaggggctcatgatgtaactaaacctgttcggagctggacaccagaagatccaggagaaagccatgaacggtggatatggacatctgccgccgtcgatcgcatctatcaccgccaagctctgcgatgtggctcagcagcgcaactgcgaggacatgatccagatgttccagaagctggtcccatccatgggggggcggaagcgggagcgcaaggctgccgtcgaggaggacacctccctgtcggaaaggtgaggggccccgccagcccgatggggatgaggaggaggagcacagtccctcaggatcaagcgaggagatgcacgcgcgatgctcaaccagctgcagggacgatatgatttgtgaggacgactgtgacagcctgacttgggagggagacttgacgtagtaccctgcttgctttggggcaggatttctcaggctattgccatggcaagcttggagaggcccaaggtagagcagcaaggagtgatagcctggagaaggtgatctaaggatacggagccctgttcaaaacccgggataggagtatcaggacaccattggccagataaagctgaattggcaaggcaaaaacgcatgaacggacctgacagtattgggatttgaataaacggctgatta

SEQ ID NO: 508585 - DNA, 726 bp, Homo sapiens
tgtgtcgctggcactgcgggaccgccgcctggagttcctgctacgacctgggcatgggggcatgctggtcatcatggagcatgggatgccagtcaccctgtgtgagcctgtgaccatgggtctcactggatgctgaaactggccgcaatgggtgccctgcgtgtgtggctgactgtgcccccgtgtgttagggggagtcccctggttcctgcacacctgtcctcaacctgaatggatgccgctctacgtagtggggcgctccctgacttcagcaagctggccctgtgctgctgccgtgtcctctggcttcgactggtgccatccatgctggtctccctcggagtgccgccagctgctgacccctggagcacgtgctgctgtgcatgtgtggactgtcactgtcctttgcattgtcacccctgcaccctgggcctcaggccacccctgcctcaattgtgggcctcctgctgtccctgagggaggctgcctatgtgttgcctgtgtcccggggggattctcaggaccgcactgcgagaaggggctggtggagaagtcagcggggtgacgttggataccattggccttttgaccgggcggacctattgtcgagtacctcaacgcctgtgacctgagagcgagaaggcacctgcagaagcaaccacttttgaactgagcctggccactgaggcccccagggctggtgccctgagtggaagcccggactgg

SEQ ID NO: 508586 - DNA, 488 bp, Homo sapiens
  misc_feature (49)..(49): n is a, c, g, or t
  misc_feature (356)..(356): n is a, c, g, or t
  misc_feature (368)..(368): n is a, c, g, or t
  misc_feature (385)..(385): n is a, c, g, or t
  misc_feature (419)..(419): n is a, c, g, or t
  misc_feature (473)..(473): n is a, c, g, or t
gaactgtgcgaaccagacccggcagccttgctcagttcagcatagcggnacggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggagtctgactgataaattaactcaggcccagattttgactacatgaaatccccaactttcctcgaatacagtgccaggttcatgctggccgactggtgtttgggttcctgaatggcagggcctgtgtgangatgcagggcangttccacatgtatgaanggtacccactcttgggtgacatcccagtgagggnttccaccttcgggtgtggacacccggtagttcaccaatgcagcagagggtgaancccaatttggttggg

SEQ ID NO: 508587 - DNA, 357 bp, Homo sapiens
  misc_feature (162)..(162): n is a, c, g, or t
  misc_feature (173)..(173): n is a, c, g, or t
  misc_feature (184)..(184): n is a, c, g, or t
  misc_feature (196)..(196): n is a, c, g, or t
  misc_feature (216)..(216): n is a, c, g, or t
  misc_feature (233)..(234): n is a, c, g, or t
  misc_feature (274)..(274): n is a, c, g, or t
  misc_feature (313)..(313): n is a, c, g, or t
  misc_feature (332)..(332): n is a, c, g, or t
agttcgacggagactctcagtggagatcaccttcttttaatatgggggtcaccagttcagcaaggtacaaccaaatatggggaatatcaatggccatgtcatctgccaattccaaagtttctgaaaaacctttgaaaaagtcctgtttgctagagtttttcntgactgtaccnagctgatagangtagttggcccnatgtgatcgcctggtgatcntggctcgctttccaggnngtggactccacgtcccactctcacaagaaacatgtagtanggcccgtgggcatttcagctcttccacacactggcatgngcttccgttaaagatcatntaatgtgtagaaagttcatcgaatg

SEQ ID NO: 508588 - DNA, 795 bp, Homo sapiens
  misc_feature (653)..(653): n is a, c, g, or t
ggctgaggcagaaggaccaattgagcccaggaagcagaggtagcagtgagccaagatgcaccattgcactccaacctgggaggcagaaagagaaccctgtctcaaaaaaggacacgaaaacgacacggaccatacacgacaaacgacgacgacacacacctacgggacacaaacgacgcgacgacgaaaggacgacacagacaagaccgaccccgaccaaccgaccggaacacacgacagcgcaggaacagaaagaccccgaccacaccagcgaccccaccgaccacaccgtaccggaacgaccacccgaccccccgggaaccacacaacaacaacacagacaacaatacaacgaaaaacaacacacgtgtgtgtggtggcgcagcttacgcgtgcccctatgaaagaaaaaagacggttcttcatacaagagccccccattttccgcgtgttggtgggcgccgggggggcgcccccaaagggatgtgggttatcgtgcagcacctcgtgcgccccaaacagccgggctcccccacagagagagaacccgctgggcggcaaggagcatcaagcgcgcgcgtggaggcttctctctacacaaataataaaaaaaaacgccgccggggagcacaaccgagagcggcgctgtctcnggaaacaaacatcccacaaaggtggagggtcgaggcagggcgccacaacgcggcgacgtcatactacaacagagagaaggctcaccaaaggagagagaccggaaattaaaaaattacgccgcggacacgggggggggagcgt

SEQ ID NO: 508589 - DNA, 123 bp, Homo sapiens
  misc_feature (41)..(41): n is a, c, g, or t
atttcaaaaatgttgttaattaggacaagattaaataaaanggccaggcagaagtggcactttggaaggctgaaacaggagaatcacttgaggccaggtgttcaagaccagtctggcaacatg

SEQ ID NO: 508590 - DNA, 377 bp, Homo sapiens
aagtgctagtctcgccagtggtagagaatttgacaatctgaaccagagtgccttgtggctacgtgtggactgatccatccactccggtctgctcagcttccaggtcagaaagctggaactcagcagggctctggctgcctccagaatcccatgctttggacaacagccagaactgctgtgctcctgctccacagcctgacgtgcggatgtggcgggaaggatggtctagtgtgaggcagatgccagactcccagctagggtcctaccactacgtactgttcagacacggcagcttggccttgcaggaacatgtgtctcagctgaaagtcactgacaataacctcgggccttgtgtctggaggccgggaaacagcact

SEQ ID NO: 508591 - DNA, 133 bp, Homo sapiens
attgcttgaggccaggagtttcaagaccagccttggccaatgttggcaaaattcccattcttctgcttaaaaattacaaaaaatattagctgggcacggttggcacacacctgttaattcccaactacttcgg

SEQ ID NO: 508592 - DNA, 358 bp, Homo sapiens
  misc_feature (73)..(73): n is a, c, g, or t
  misc_feature (209)..(209): n is a, c, g, or t
cccccgagacctttgcgtttgttcgttaccaaagatttggtggagactctgagagcctgaacttagaaggccnctgagaggggaactgtcgtcctccggggagcgggcagcctgcccgcagagcgcccgggacccaggtccgccgtcctgccgagacagcggcagtatccagcactcaccgtgcgggattaaaaacggctctctggttnctacggccaccagccgtctccccccagcgtcagtttgaatttgttcaggccattcctagcccagactcaacccaacagtgtattgattgctgtgagctgaaggcttgtttgagagccaaataataaaattaacaaacctaaaaaaaaaa

SEQ ID NO: 508593 - DNA, 519 bp, Homo sapiens
agcccccaccaagctccagcatctggacacctcacgtccagccctcctggactttgtgctggggatgaggtcaatatgacagcccccctgaggtctggtcgctcccgcacaccctccacagtgggcagaatggtgccccccaaaaggcccacatcctaatcccgggactgtgaatgggtgacttttcatggcaaaagggacattgccagtgtgaccgagggtcctgcgatgggagactccccaggatcatgcaggtgaacccaatggcattacaagggcccctgtgagagagaggcgggggtcagagcagacgtggctcgaaagcagagggtgtggtgacgccccagcctgggactgaggcccagaacgcggtggccttcagaagccgggaaaggccaggagacggatctgcccccagcctccagaagaagccagccctgctgacaccctggctttagcccagcgcggcccatgggacttctgagcccccagaactctaaactaataaattggcatcgt

SEQ ID NO: 508594 - DNA, 119 bp, Homo sapiens
atcggacccacggagcgacagagcgagcggccctacggacgtcggcggcctggcggcccgagatgttatctgggaagaatggcggcagccgcggcggcggcggctgcagcgtgcaggca

SEQ ID NO: 508595 - DNA, 440 bp, Homo sapiens
  misc_feature (4)..(4): n is a, c, g, or t
  misc_feature (63)..(63): n is a, c, g, or t
  misc_feature (86)..(86): n is a, c, g, or t
  misc_feature (94)..(94): n is a, c, g, or t
  misc_feature (173)..(173): n is a, c, g, or t
  misc_feature (209)..(209): n is a, c, g, or t
  misc_feature (260)..(260): n is a, c, g, or t
  misc_feature (269)..(269): n is a, c, g, or t
  misc_feature (282)..(282): n is a, c, g, or t
  misc_feature (288)..(288): n is a, c, g, or t
  misc_feature (290)..(290): n is a, c, g, or t
  misc_feature (293)..(293): n is a, c, g, or t
  misc_feature (345)..(345): n is a, c, g, or t
  misc_feature (377)..(377): n is a, c, g, or t
  misc_feature (440)..(440): n is a, c, g, or t
tcanacagacagtataagttgtcttttttctaatattcctaccaccatttactttgggccaantatccacatcccctttcttattntaggtggntaaagatttttttgattcaaagtggttattatgggaagtagctcgatggtaaaaggacaaacacctatctatcttagancttaagcctgtatgtgcttattcccaagggagatanaggtgtttaatcacaaggacagcatgagttagaggacactggcatcaacanctgccacanccgttcacaccanggccanancanccccactgacatctgtctttggtcttgagatcaaatgcatcccattcttcantacattagaaggtcgacctccttgaagcagancaagtataacaagcctctaaaaggactactgagaaacagaatcagaaactctagaactctaan

SEQ ID NO: 508596 - DNA, 110 bp, Homo sapiens
tgtcgttcactgccttggtaagaggtactttggctcattaggctctagggacagaaggggatctcctacactgtaaatggagtttttaggaatatccccaagcccttcga

SEQ ID NO: 508597 - DNA, 297 bp, Homo sapiens
atccacctgccttggcctgtaatagccaccgcacccggccagatttaagtctttaatcccttttgatttggttttgtatattgtgagagatggggtctagtttcattctgcctgtggttatccagtttaaccagcaccctttatgggagagactgtcctttccccagtgtatgttcttggcacttttgtcgaaaatgagttggctgtaaatgtgtggatgtatttctgggttctctggtctgttccactgttctgtgtatgtgttttatgccagtagcgtgctgtttttggttacta

SEQ ID NO: 508598 - DNA, 343 bp, Homo sapiens
aaaaaaaaaaaaaaaaaaccccccccggggggatttttttcccccgggggaatttaaaaaaagggaaattcccccccaaacccccggggaaacaaaaaaaaaggggttttttttttccggggaaaattttggggccccccaaaaaaaacacccccccccctttttgggggggggtttaaaaccaaaatttcttttttaatttaaaagggcccccccctttggggccccgggttaaaaaaaaagggcccccccccccctttttttttccccttttttgggggaaaaaattttttttaaccccccctttttttttttttttttttttaaaggggcccggggttta

SEQ ID NO: 508599 - DNA, 796 bp, Homo sapiens
  misc_feature (2)..(2): n is a, c, g, or t
  misc_feature (222)..(222): n is a, c, g, or t
  misc_feature (266)..(266): n is a, c, g, or t
  misc_feature (320)..(320): n is a, c, g, or t
  misc_feature (327)..(327): n is a, c, g, or t
  misc_feature (329)..(329): n is a, c, g, or t
  misc_feature (335)..(335): n is a, c, g, or t
  misc_feature (370)..(370): n is a, c, g, or t
  misc_feature (436)..(436): n is a, c, g, or t
  misc_feature (438)..(438): n is a, c, g, or t
  misc_feature (454)..(454): n is a, c, g, or t
  misc_feature (487)..(487): n is a, c, g, or t
  misc_feature (496)..(496): n is a, c, g, or t
  misc_feature (536)..(536): n is a, c, g, or t
  misc_feature (559)..(559): n is a, c, g, or t
  misc_feature (602)..(602): n is a, c, g, or t
  misc_feature (626)..(626): n is a, c, g, or t
  misc_feature (633)..(634): n is a, c, g, or t
  misc_feature (644)..(646): n is a, c, g, or t
  misc_feature (651)..(651): n is a, c, g, or t
angtgcccagatcgctgcgctggcactgtcgtgccctcttccaccacaggggcacagaaacctgcaggagactgaaaacgattacaaacatcttcaaccagctctctggccaaaggcagcaaaagcagcctgaatacgcaactcacgccaagagggcagcagctctcctgacatccatgtaagaaggctaacacctaaaccacacgcaggcatcctgaactnagcagctctgatccaaggtactgagtggagacaaagcactcggnggtggcaagatgttcagcaaccaagtaagacacactggcaaggcatcccacccnaaggtgngnagcacnaagcaggcttggagaaacaaacagtcatgccaggngccgccagacatcctgctatacgccctgcccctagtaccccgcgttcatcacgtgctctggttttntntccataaagcacaganggcactgaccaccccaaaccagactcccaaggnatccttatngttggcatagggcctcagatctgctgcaggatcattttcnttttcaggtcgtggctgaacttnttcatcctgaagatctcactgtcataaaatgcagagaggttgnggatatagatctgacgagacttanacaccanntccttctcannnaactnaatagtgtcatgctgggccccaaagcggatgcgctgatatgtcacctgctctgccactaactgcttcagtatgaagagcaacagctcattgttgtcacgccggaaatgaaaggtagcgggcaaaagtcttgcgcatgctgcgcat

SEQ ID NO: 508600 - DNA, 165 bp, Homo sapiens
tcagctcatctcatttttatctgtctacctccattctgaagagggcggttatggtgtcccttagtcctctgggaatagaagatccatattgtctttgtgtacgagcaagcacgtttttccaccctcaactgtggttggaagagggggaatccatctagtcgtcgc

SEQ ID NO: 508601 - DNA, 835 bp, Homo sapiens
caaagggaaagtgctaaagtgcttgagaaaagagtttctcttaattaggttaaacactcccccactccccagcctcatttacaccattcatttgctcagcagactatggcttccaagagaggattcaagtaaaccctgtcctatccaggtgtacatgatcctaaaccacaaaaaaatggactctgaaatccagttcctgcaggatggagagggactaaatgggtctggttgggcctcaggcctgccctgcacccctccccacgctggccaggttttgagcatgtctcttggggtcactgccggtccagcctgctaggaaacaggcaatggaaacccagagcagaatttctgggaaatgcaagagtttctttctccactccagccatttctcttctgtcagagctctaatgaggttttagtgccaggagggaaagtaaatggaaagaaaacagcccaaagttgctaatgctatcgacagtgaccatgcttcaggaaacccttccttcccctggggccaccgcccagtgcatggtttgcctaaaaggaacgaaagagaagggaaaaacaggttccttgtaactacagagagagggattctccaagatccacttgtgcatgtgttgggggatctgaacattaaccctttctgcctcattagtttctaagtagtgctgagattaagagccattgctgggaacatgaagaggctgtttctgtaaggggagtcttgatagctcttccaggaagtcagagagacagccagtgggtgctgagcagcccaatctggctggatgtctatacttgtggccttccagctcttcatacactgagtcca

SEQ ID NO: 508602 - DNA, 346 bp, Homo sapiens
gggagccccctacgatgagctaataggtgcactgtcactagatacgaataatgctgcgatgatccattggcatggagcacgcgcgcatccactttctttgtttatttgagatggggtttcgctctgtctcccaggctggagtgccgtgtcttgatctcagctcaatgcagcctcaacctcccaggctcatgtgatcttcccatctcagtctcccgagtagctgggattactcggtgtgggccaccatgccctgctaattttttttgtatttcagtaaagatggggtttcaccatgttggtctggctggtctccaactcctgacctcgtgatctgctcgcctcagcc

SEQ ID NO: 508603 - DNA, 509 bp, Homo sapiens
aaccccaagaacgggcagcggtgagcgtgtggaggatcgtgcccattccacatctactttccccccgaatcccagcggaggtagtaggggcggcgagggctggatcctgggccaatatatatgccaacaacgactaagctctccaatgaggctgaagaaacgtgtgtgaagccacagctgttgtgagcgagagttctacagtgagatcctggacaagaagttcacagtgactgtagaccatgctggaccctggacctacatcgatgaggcttacgggctcgactttaacgatccgtcaagactcccgaaggaggacctagtagctccaagttttgggatggacgcttgacaggcgcaggggatggctgcgtgccggcataagccgcggccaggaccaccacaagctgcaaccgccgaagggacccccgagccggcggggcagccagtctacgaccaagtacaacggaattggccatccctagaggcacgaggcagagtgggtgggcctc

SEQ ID NO: 508604 - DNA, 144 bp, Homo sapiens
cagaagagaaacagcacacaggctaggacagcaggggctgggggcggccacaatcactgctcagcttctcctaggacgtcgttctgtttgcgcttcatgttctcaaagtcaaaggcagctccagccgtactggctggcgcgtgc

SEQ ID NO: 508605 - DNA, 923 bp, Homo sapiens
  misc_feature (381)..(381): n is a, c, g, or t
gaagctgtggaccgcgtgggctcgcctgccctgggatgtaggtttcacgcggacgttgctgatgatcaaatataaaggtagatcccgacggggccctaggctcaggcggaggcgtgttcctgtggagcgcaccttaccaggtagtcatgtctggtcaacccagagatgcctccgatcgcgcagctcccgtgggcgttctcgtccgcgctcactgcgtgaagcttctactgaagtgcactcaggtgaatagtcggttgtagagctatcaagcaggagttcgggcgcgtgcggttgaacacgtatggttcgacgagaagtgttggtccaatagaacgcgtacgaacagaacgcggcatctagtgtcgtttctggcatggcagnagactacttgaccacaatagaatggttatatcatgcgcaatctcgcgcatgtctagtgatgctcagtgacccgcaacatgtgccctctatgtcataataatcacccctcttagaggaccaggacccctgcgattgcaaaggaccgcaacgagacatcgcgaaaagcagcacgcacgaaccctgtctgctgagatatagtggggttcgatatcgccttccaaatgaaaggacaggtatcccaggcgagcgactatacctgattgatttcgccttggctagcgaagggttgcccccgatcgcccttgacccccttatgcacccttagtggacgggtgggctccctgtggttgagacgagccctttggaggctgtgcttgacctcggtatgccgaatacgccttattttggggtgccttgcgttgatgccatgggaccgaactttggggcttggtcccttcccttggccccaaaacacaacaactttgaaccgggccattctttccccaaggtttcccccaaggggcaacggccctttctttccc

SEQ ID NO: 508606 - DNA, 873 bp, Homo sapiens
tgtaccccaaactaagcctccgaacccctaaccaacccccctcctaatactaactacctgactcctacccctcacaatcatggacaagccaaagccacttatccagtgaaccactatcaagaaaagagaactctagcctctctatactaattctccctacaaatctccttaattataacacttcacagccacagaactaatcatattttatatctgcttcgagagccacaacttatccccaccttggtatgcatcacccgatgaggcaaccagccagaacgcctgaacgcaggcacatacttcctattctagaccctagtaggctcccttcccctactcatcgcactgatttagacctcacaacacacctaggctcactaaactattctactacatcacatctcactgcccacagaactatcaaactcctgagacaacaaattaatatgactagcttacacaagtagtattatagtacacagatacctacactaacaggactctagattatgactccctgacagccatgtcgaagcaccatcggcggggcaaaagatatcaggccgcaggaccactaaacactgaggggcggcgtgtcgtgacataatacgggctaaacaacacaatctacaaagccccatgaaccaaaaaacatagcctaccgccgtgacttgtagaatcccgatgacgcataactcataacacaggccaaactgacgacgagcaacagcacctaatcgtccgggcgccaacagcacgaagcaagccacgagaacagaccaccaacagacacgtaagatcacggcacaccgacacgcagcacgaaaaccagacgcacgaagacaacaaagaaccctacgaggaaaccctaaa

SEQ ID NO: 508607 - DNA, 976 bp, Homo sapiens
ccgtctttgggtgccgccggttcagcgagagccacaattggcggccgccccgcgatcacaaaagcgcccgggggaaaccaaagccccgccgtgtggaaggtaacggccgcccctcccgcgaaggtggaccccgcgtccgccccttgaagaagaatggttgcacaccgccggtgtgacaagtggcccgactgctcccccccagaggggggcggccctcctccaactacgacgagaagagggcttgttaaaatcaacaagtcatcaacaaaccgcgtgaaattgcagaaactatctcccaacaacgcgggggacatgcggtccaccgcttgtatgagagcccagcccgcagagtagtccaccctggtgttgagggatcagtacgaccagtggcccctgttcaagagcacagggctggaaaaatacaaacaagaggaagcaccactgctactagttggggccgcctgagtaggcccccatgcggagattaaggactttccccgcttctttgcacaaatgggccttgtccttacactatagtgtgacaagcgcacgatcattgttgtggtggttatacaggggaataatacctttaaagggtattttctcaccaccgcctcctcccactcttgttgcagacgccttctacaagcggcaccacggccctttgattaaattagttgcgccacactaaaccggtagctacttcgcagaatgtctttcacaccagtttaggcgcccaccaaagatgtatcatggtagagaattgtttctcttttaacgccccctctccgtgcccccgcaacactcggggtgaagctcggctagtttatcacgggataagagtggcccttcttcccacccttaaaagaggacatacaactccatcggggaaaatacacccccaatgtttcgaaagatacgggggacacccccactcaaaaaaattaaaaaaaaagccccccagcacaaaaaaaac

SEQ ID NO: 508608 - DNA, 444 bp, Homo sapiens
cagatctgcatgtatgttggtgtcgagagtggcatatggtatactgtcggaggtctatgggtccatcaggcatgtctagaggcatccagcccttgattgggcaactaacgttggtacacgtggtcagacggcatcacctagacagcctctgtagctatgcatagcagtcctgtcagccatgcattcatcgtcagatcaggcttcgtagtcaatgtgacgcaccagagggcttctagagcatgttcaccatcaagtcatctgaagattatcgttcagatacgcttcacagatgtagaaagtccttatttcatgaatgcatggcgcatactatggtccagcccagtgatctccctttgggctctcacgacatgtcaggctgcttatgttcccccagtatcacgtagcgtagtacgtttgtagagttgcgtgctcccctccatggcg

SEQ ID NO: 508609 - DNA, 327 bp, Homo sapiens
tcacaggattcctgggacgaccggatagcatatgtgaaagcctgacttgaatactgaaggggtccccgaatgtggaggaggaggaagaaggatggacgggagtgagagaagtgcagggtagacccgtagagtagatgcagagtagatgactgaccaacagaatatgccaaatggtattagacaaatgatggaggaatgttagcagttgcattagttatgaatcttgtcgacacaccagaaaccaactcaagatagcttaaacatagttgggggcagaggggaggatgaagagaggtgggttaaagggtacaaacatacagttagatc

SEQ ID NO: 508610 - DNA, 160 bp, Homo sapiens
  misc_feature (41)..(41): n is a, c, g, or t
  misc_feature (143)..(143): n is a, c, g, or t
tctagaggatcctgaggtggttgtgggtagaatctcgtccngtagctcatttcaacgcagatctcagccacctcatccccatcatgggggtggtagtcaaagcgcagggggggacagaagacggtagcatgcacctcgagaancttgggttttgtcccct

SEQ ID NO: 508611 - DNA, 1572 bp, Homo sapiens
gatggactgtcgagttgttccttctatggtgtatagccatagttggccaagcgctgtgactcaaacctcttgagctcaaacatgatcaagcctgattccgcctccagagtgctgggatttacctgtgctaagccactgtgcctccgagccattacaactggaacgttttataatgcattcgacggaccgcaaagtgtgctgaccgtaccatgacagccgaacataggcgtgcgatcaataacgacgctagccgagcagacgcagcaaagaagggaacatcgagcgagacgcgtcggcgctaagaagaaggcatgccacaagagcatttccgaacctgaaggctacgcgaggtaggtgcccttgtgaaagacgagactttacgaccatggcattgcttgagacgtcatcacagtgctagttaccctgtgactgggcgacctacgctagttagttcaagcgcaccagagagatgggcgtatgccctgtttaatggaccaccgatgaaaggtgtgctttgcccctcgtgaaggtaacactctcttgtcgacactccaagaaaaagcacaagcgggagtgatatcgccactccgtgaacgaaagaactgttgaatgcggagcattgacacgagacagagaccacgtcggtggagtgacgacacacggtgaacggtgcctcagaggtcagtcagagccaagagcgccccgaccttttccgagtgggagaaggccggcgaacactcgaggagagcaataccgagtgaatggcgggtcgcacttcacgtgtggtagtagaaggcaagtgtcccggtctacgtcggttgcacgcacgggagagcccgcagtctgaaaagccctttgttccactatgcgccaagaaaggctcacgtcatcctgggaggaaccctaggctacgactaccacctgtagttcgtcgcccaaaccccctgggggccctcacagggttcgatgcgagagtccggatccccaaacggagtaattgcgagactcaaagtgaacccaaccagggttggcgctgtcgcgcagagagcttgtccgtggggcacatccccggtgctccggctgcttgtagattgctacttccgacagaggcgttgaatgggtcgccaatagccaagatcgccttagtgcaccgaacaagacccctgggtgcccccgtttacctagtgagttaaacgccgtttggctcgcccaaagtagattccgcgaggtggcacaccgtcacgccgttgtccggcacaattagttacgacggtaccgcacgttgaaaccgtcccctacacgattgtcaacgattgtaaacaaccgcgggccttatgaaaaacgtgtgtctcccggatagtgcaacccgccacaggaatggggagggacattaaactgaacccgcggccaataggtaagtcggcacatacggatgacttgattggcccgtgagtaatgccatggaggaatcaagcgactgagtggaagggcacaagaggtccaaagccccacactttgtaaggcacattgtggtcaatagcagtgagacccaatcataggagagcgcaattg

SEQ ID NO: 508612 - DNA, 143 bp, Homo sapiens
agttgtgggtagtacatccccagtcgtggcctctggacagtggcgggctgcactcatgagtggcttccaatgtgctgctcccctcttaatactcaccaataaattctacttcccgccacaactgtacaagcctgccacaaggt

SEQ ID NO: 508613 - DNA, 158 bp, Homo sapiens
gcatccccccttctgcacgcattgacatgttgtgcttgatggattcggtgattgagcaaggaaaatataacaaactgcagctcatctccaaccatagaaatacaggaaaatggtgatgccttacattaaaattggagagccttcaggcaaggacaact

SEQ ID NO: 508614 - DNA, 469 bp, Homo sapiens
ggagatcaaagggcgtcgccaaagcgggacaggtccagcggttgtctgtgtgaagtcgcgcggttccacccacgcagtgtctacgtgaaggccagaaactcgctcgccatgtcggtgcagaggcggggggtgttttccgcagagccaaggggcaggaccctgcccgggttcccgcagaaaaggaaagcgatggaaggcccattctacttcatcctgggcgcagaccccacagtttgggctgatcaggcctgttccactggggacgtgtggacaatggcgggtgacaaagtgcgaaccggggagatccggtctaactgagcaagcggtcccaggccattcaacaaggttaaagccttagcccaaaaccaattccacctttattacccagacaactttagccaaacccattttaccccaggtaacaaaaaagaccatagacgcataacaaaaaacagtgtggtgcgggcgc

SEQ ID NO: 508615 - DNA, 183 bp, Homo sapiens
cgatcgtactctctatgacggaatcgacttctatacctcaattaacccgtgcccgattcgacgaatggaatgctgaccggttccgtggcacccgggacccagtagagaaagcccttcgagctgccaaactagacaagtcacagattcatgatatggtccgggtgggtggttctcctcgtctcc

SEQ ID NO: 508616 - DNA, 375 bp, Homo sapiens
  misc_feature (164)..(164): n is a, c, g, or t
  misc_feature (169)..(169): n is a, c, g, or t
  misc_feature (201)..(201): n is a, c, g, or t
  misc_feature (203)..(203): n is a, c, g, or t
  misc_feature (232)..(232): n is a, c, g, or t
  misc_feature (238)..(238): n is a, c, g, or t
  misc_feature (294)..(294): n is a, c, g, or t
  misc_feature (329)..(329): n is a, c, g, or t
  misc_feature (331)..(331): n is a, c, g, or t
  misc_feature (363)..(363): n is a, c, g, or t
agctagtagaaggggatgcaggggcaaagccctcagttgccaagcaaggaggaaaaatgtacgtgggctgtgtggcagtcccccccccctgccctggctttttcaggttatcgcccccctatggaatcctttgcagaatggtactcatataatggtttaaaacnacccnttcataattgactctgtgcaggatgtcccccnancagtttgggtttgctttattttattttanaaaaanattttttggtatcctgtcccttccagtgggtgtgaaaatagtattttaatatttgnccaaagtttaatttaattttaattgttctatgtananaactgcctttttaaataattaaaaaaaagttnttatgaaggcca

SEQ ID NO: 508617 - DNA, 693 bp, Homo sapiens
accgtgtgtcagaacctgtagataatccgcaatgggtactctgaatcgatgttgaattactggaagatggtgaaggagggcacccgtgtggtaagctcactggatggtgtcgtaacgcatggggtctggaccttcaatcaaagccttagatgggagatctcaagtttcaacaccatgtttggcaaaacgttcgatgccccaccagccttacctaaagctactagaaaggcttgggaactgtcaacagagctacagaaaagtcgtgtaaaggaccaagggacccctcaaacaagaatcagccaagcttttctggccaaaaagatgactgagaagactgtgacagcaaaggggctctgttccgtgcctcagatgatgcctatccagaaatagaacaacttcttttccgcttcaatcctctagacttgtgagagttttgaccctgcctgaagagcaccagatggcgcactccccttgagttggagtggcctctcatgatccttgaccgaggagagaagagtttgaaaagctgtttcagctgggcccccttcacctgtgaagatgccctctcaccatggaatccaatctgtggcagtctccttcagcattctgtcgacctggatgttgaattgccacctgtttgtgtgacatagcatattcaattctaagtgcttcagagttggggtatggatcata

SEQ ID NO: 508618 - DNA, 346 bp, Homo sapiens
tttttggggggcccccccccccccccccccttttattagggggggggggcccccccaaaggcccctttgatcctttttgagggcgggggggggttggggccccctttttttggccccttttaaaaaaaagccccggttttttttttaaaaagtttccccgggggggggggcccccctttcctgtgtgggacttttaaaaaaaaaaaggtttttaattcccccgggcccttttttttttttttttggggggccccccccctttttttggggggttttccggggttttggggtttaacccaggggggttttttttttgggttttttttgggaattttaaattaagccc

SEQ ID NO: 508619 - DNA, 269 bp, Homo sapiens
gggcaataataaggtggaatttgcaggtcagcccaggaattggcgtgaggagagtaggtgtgtgataaccctttgtggagaatgagattccccccagctgtgtgagataaatatacagctctggagtcttgttggtgacttcagaggtacgagagcattccaggaaagagagattccctgtgcaattgcaaatgtgaatcctagggggaaattggggggtgtgtctttccctgttgaaaatgtttggatgggaataaatatcttcagga

SEQ ID NO: 508620 - DNA, 132 bp, Homo sapiens
tgacatgattagaatcgagctggtaccaattcggccggggcatctctcatggaaaatggcagtaaaggctttagtcacagaacataaagcagtgttcctcactattaccagtaaaaattctttttatttttg

SEQ ID NO: 508621 - DNA, 908 bp, Homo sapiens
tgcggtggctcacgcctgcaatcccagcaccctgggaggccgaggcaggcggataacgaggtcaaaagatcgagaccatcctggccaacacggggaaaccccgtcgctactaaaaatacaaaaaaattagccgggcgtggtggcgggcgcctgcagacccggctactcgagaagctgaggcaggagaatggcgcgaacccgggaggcggagcccgcagtgagccgagatcgcgccaccgcactgcagcccgggctacaacagagcgagactaggtctaaaaaaataaaaaaaaaaaatttagccgggcatggtggcaggcgcctataatcccagctactcgggaggctgaggcaggaaaatcacccgaacccgggcctgggggtagacgcagtgtggggaggcggacgttgcagtaagccgagatcgcggcaccgaactccagccgggataacggagactccatctcaaaaaaaaaaaaataaagatgcacatgagatatttacagaggtaaatcgataagattgggtggacagatgggatgtgcatgtcagggatagaaaatctagaaaagctcctggctttccaaaacactgtttaatcaaatatggtgaattcagcaatccctctttttcagattcggggtggctctcaattgccgtcagaagctgtggtcccggatgctttagaaaggaagcgaaagtgttgtatcacagcagtggaaaccatggccagggttcacctatggtgcaatgggaaggtacttggattctcaggtacggggtagatctcagaaagggatgggaaatgtgcgcttaattcagtgagagtgatgatagtgtgggaagtaatttccaagaatcttaattgatggcagaattgaatagtttatggaggaggttgaaagagg

SEQ ID NO: 508622 - DNA, 154 bp, Homo sapiens
aatatattgtgatcgatatatatcatatatatttgatatgtgatatatgatatatagcatatgatatatttgataccctatatatatttgtattaccctatatatcctaatacattcatcctatatattcattatcttataaatcctattatgc

SEQ ID NO: 508623 - DNA, 444 bp, Homo sapiens
tctaggcctctaaggagccaaaactggcccttattccttcttagaccaaaccggagtagaaaagctatacctaaaacaatttcacagcaccaaatctccacctccatcatcacctcaacccaaaagggcataataaaacttaacttccttctcttccttctccccactcatcctggaccctactccttaatcacataaccatatccccggagcaatctcaattacaacatatacaccaacaaacaaggttcaaccagtaattactattaatcaaggcccataatcatacaaagccccggcaccattaggatcctccggaatcaacctggacccctctccttcataaattatccagcttcctacactattaaggttaccacaaccacaaccccatcatattcttcacccacagcaccaatcttacctccctcgttaaccccacta

SEQ ID NO: 508624 - DNA, 160 bp, Homo sapiens
agagtcctgtcggggtggcgggccagtggggcggagctcgtccgcgtggtgctgaagtggctgaggaccttcccaggtctccccaggggtccgtgcctttccctgtgtgaattttgtagtctggcctaaagtttccctaggctttcttgtctccggccta

SEQ ID NO: 508625 - DNA, 381 bp, Homo sapiens
tcggccaggggggggtgttacaaaaaggggtttaaaggccttccctttaaaatttaaacgctctttgtttttttgaaaagggggtgggttttaaaaaaaattgttttaaatcttatagaggagttgggggaagtggggtttttcaacatctgcgactagaaattgcggttcgcctttgggggggccccgaagaagccctctatagtctttcgtaaggggattcgtggatatagtaaagcatctggccggccgggggggggggtatcaaaaagtgtctccggttctactcgtacatcgtgtgtcgaatacattcctgtttaatatcttcctggataagccccatcggactacgaataggctgagaacgagcgaggggggggg

SEQ ID NO: 508626 - DNA, 943 bp, Homo sapiens
gtcgcgaaaatgctgtttttgtgcgagcaggccgtatatggtgggacgcaagacaagggctggtgagtataatacggcggaatcgttcccatgtatgagaaaagacacacggtggggtgagaaaattgcataaatggggcacccccgccgcggtatatatacatctgggagggcaccttgagagcggaagttttatggggtcggtgacccgaacggcccacagggcgcacacttagctcgtagtgcccgctagtggagttacaccgcctaacatgacgtgggtgctaatatcacttcgttacatggaattaacaaaatgtcccgtgaacgcagaaaccaacacttgtaaaacccttccacaatagttataaactcatctcccacgctgaaaacaatgataccaccctctcgtacctccatcataaaagaaaagtattacccccccccgcactcaccccgcccggtttttctgtgcagagaagtatcttcctctctctgtgttagcacacacttcctcataagattatcatttttccgtgccccgctctgccccctctcaaaatttttgtttcacacacacgcagtacttgacagccactgcacataacagtctaaagatttctcctcacaaaaaaaaagaatccctctaagggttcccacaatactgtattattcgtgcgtgcttacaccgtaaagtcggctatattcacccaatcaattcttgtgtgcatatataccccctatataacaacagtggggcacacctataattattctacgccaccattcttttatacaaaaaaaatactaagtagtggtgggtagtccttacacaccatgacgcaaatattgtctccatcggacacaaaaactgcagcaaaccaatgttggtggttcccacaacaaaaaaacaaaacggtttcccccccttccaaacaaaaca

SEQ ID NO: 508627 - DNA, 614 bp, Homo sapiens
cgacggctcaacggaacttagcagaagtggctccagtttgggtttgggtggttgggcctagggcagggactcagtccaaagcagtggtctcctataaatgtaacagatctattagtacttgaaagaaatgtcaaatttcatttagaagttaacaaaaatgaagatgtagctgttcagaccctttaaattcatccatgttcacagaccctctaaagtctatccatggaccccaggctaagaactgctggcttaggtggagcagccaggagaactgcatccccccggataggggatcgtaaaggcattagaggagggaggcacttgcctggcagaggggcaaactccaaaaaaaggcaaagatatctcccctaagtgtgaaattttaaaaaaatcaatagctaacaaatgaagctggaaaaaccacttgagacaattgggaaaatattaatgctgaaacgtaatagatgttaaggaattattgagttcttttcccttaggagtggtggttaaaataaaacgtcctagaaatgtatgaagatgtatacttgagatgccttggattagctttaaaatggttggaggacgaggaaagtaggagagtagagatgaaataa

SEQ ID NO: 508628 - DNA, 932 bp, Homo sapiens
  misc_feature (1)..(1): n is a, c, g, or t
  misc_feature (72)..(72): n is a, c, g, or t
  misc_feature (77)..(77): n is a, c, g, or t
  misc_feature (166)..(166): n is a, c, g, or t
  misc_feature (184)..(184): n is a, c, g, or t
  misc_feature (186)..(186): n is a, c, g, or t
  misc_feature (189)..(189): n is a, c, g, or t
  misc_feature (263)..(263): n is a, c, g, or t
  misc_feature (265)..(265): n is a, c, g, or t
  misc_feature (302)..(302): n is a, c, g, or t
  misc_feature (315)..(315): n is a, c, g, or t
  misc_feature (319)..(319): n is a, c, g, or t
  misc_feature (324)..(325): n is a, c, g, or t
  misc_feature (334)..(334): n is a, c, g, or t
  misc_feature (351)..(351): n is a, c, g, or t
  misc_feature (365)..(367): n is a, c, g, or t
  misc_feature (375)..(375): n is a, c, g, or t
  misc_feature (382)..(382): n is a, c, g, or t
  misc_feature (388)..(388): n is a, c, g, or t
  misc_feature (408)..(408): n is a, c, g, or t
  misc_feature (413)..(413): n is a, c, g, or t
  misc_feature (417)..(417): n is a, c, g, or t
  misc_feature (450)..(450): n is a, c, g, or t
  misc_feature (517)..(517): n is a, c, g, or t
  misc_feature (522)..(522): n is a, c, g, or t
  misc_feature (608)..(608): n is a, c, g, or t
  misc_feature (784)..(784): n is a, c, g, or t
  misc_feature (822)..(822): n is a, c, g, or t
  misc_feature (893)..(893): n is a, c, g, or t
naaaactttttatacactaataattaacatttttaaacaaaaatcaaaacaactaattataaaatactttanaaaanccttatcatctcccccaacctttatacaacaaatactttattcaccatatctacaaaaccataatttctttccacttctttcttctttntttaaactctcattaaananttnttaaaatcactttttattacttcttacctatatcttttaaaaatatatcttttctctataaactccattatttncnatctttaactcttcttttaatttcttcaatctttttntccccttcttttnatcnaattnnctttaatantcccctttcctatattnatcacattatattnnnttttcttnatttttntatatntttttttttttacataattnatccnattnttttctcttttctaaatccctctcttcttattnaatccttttctttaactccactcctttcccttaatcttttctatctttccttttatttttatttttnaattncctccctccccttataactaatttttaactccccttcccaaaccttttatcctcttccttctccactcatccttcatattaaattncctttcttcccccaatctcttaaaccctttttaattattttttcattccataatatcaaaatattcttaattccacaatacaaacttacatacacatacatacacaaacacaaaatttaactatcttcctcttccaattatcctcaatctcccatttctccatataatccatattntccctttttcatttttctattcccatattcaaccattnttcccaactctctcattccctctttctcttttctcctctcatcctttaatttcctttcctcacttcttttnctcctcttctcactcctccctcattttccaattttcaaa

SEQ ID NO: 508629 - DNA, 134 bp, Homo sapiens
  misc_feature (2)..(2): n is a, c, g, or t
  misc_feature (87)..(87): n is a, c, g, or t
  misc_feature (89)..(89): n is a, c, g, or t
gncaattaggagtttcttacatgtctggctgtagatcagtagccaaataagtaagtctaagaattgcgaacgtctggccgggcgcgngngcacgcctgtaatcccagcactttgggaggccgaggtgggtggat

SEQ ID NO: 508630 - DNA, 697 bp, Homo sapiens
agcggggacccgcaggcgggcgtgctgtgagatgcgggggccgcggccgtagccgcagagatgtgactcgcggccgatagggccaagctggagcggtcggcgctgcggggccgcgggggtcgaatgttacgtaggcatcagagagaacagatgacgagcttcacgctaggtgcgtctacgcttcctccgtgctcttcgtgatcaccgtctggttgggccgtctgaaaactgccatgcgacgatcccggacggctggtaaggtcttgtgaatacgtcgttgcgttactagtacgggtgatcctccgtgtgcgaacctatggagttgatgctcaaatcatgtagggacgaatttgcaatcggaggcaagtagcacggcgtgggccaggggtgcctagggtcggactccgtagtaggtcactacttagtcttcccagtgtagtcccaacaatgcccgttcacgtgggcttggcggagcttagggtcccttttacaggtccacatggaatcacatggcagcgaaattgaacagcgaagcctccttagtccggaggggcgttgcggcacattttatctgggtttgcacgtccatctagagaagggacaccgcgaaaggccctcaatcatggttcgtggcatggacgtgagtgagggcctctttgaggtcgaatccgacggggagggacgcgagaactacatt

SEQ ID NO: 508631 - DNA, 380 bp, Homo sapiens
agctttgcaaattctaactccaccctaattataactgccttgttctcatgaagttcactgtcagcaactgtttattcaccaggtacaatattatgcataatacactgggctgagaactgtgagggatacaatttggaaagacagggcccctggtcttaagatgccattgaaaagcacagactgtgttcgggaatcagtaagtccagtgtgtagatgacagcgttagtggggaaaaatggaatacagagttgaaaggtgtattggagccagattgttaggtttttgaatgcaaaatttatatgttaggatgctattatttggaaagtggggacttactcaattttttttaacattaaaagaaaataatcaaaaaaaaaaaa

SEQ ID NO: 508632 - DNA, 254 bp, Homo sapiens
attacgggcaagttaagctgtgaggcaggcagcccttcggtcacctgttggatacacagacccctcccctcgtgtcagctcagagcgagctcgaggcccccgtaccaactacttgcaggggtccctgctaatatagcgccccaccgccgtggtagttcgtaccgcttcctctagaacttctacagaagcctagctccctggagccctgttggcagctctagctttgcattcgtgatatttgaccttatcgacgt

SEQ ID NO: 508633 - DNA, 216 bp, Homo sapiens
aggtgcgaactgaagctcacacgtacctgcctggctagtggtagaagggctggctgaggtcatggaccacatgggataatcagtgggatatgttcctgcagctacaggacatggaaggcctagatcgttggctctaatactattggtaatcaaagcagatttgcacgcttgattggtctccgtgctattatggtccccattaatatagtcccatac

SEQ ID NO: 508634 - DNA, 946 bp, Homo sapiens
cccctgcccacctcagtccagaatctcgcccaccacgccagaagtcgtgttgacagactttccagaccctggatggtaagccagtacaacccggctcaaacagcagctacgtgcgttacgccaccagctgttacagactgctatgatccgccgacatggccctcggctgctgctactactccgattactggcgataggagaagtgcccgctgcgcagcccctggatgctccccattaccctccacgatcaggccacgcttcccccgtggccgggtctccaaagcagccggctgcgtggctactaccgctggccgctgctacaggctggcaccgatacgaccgcctgcacaaccgcccacacaggtgctcgcatcagatgtcgcgtgccatcctggaccaaggagccaagcctgatgcgagcggcagtagcagaccacacacatcctgcccgcacacagcccacctcgccccccctgcaccctgcctcccaaccccttactacagccaaccgtgcagacacaccatcctgcacccgcaactccccatggatgcgacaatcaccgcgccctcccacggacacaacccgacctgctccacccccccctgcccggaccccacaaaccagccccccgacctgcgaacacaagaaccccaccccccctggacgaccccccgcctgccccacccgcacggcagaccacagtcgcagcacccagaccgccccactacccccgcctcccgccctagacaaactgaacccgcacggaaccagcccccggaccaccaccccagacgccgaccgcgaccccaggaacctcagagcccagccccacccccccccccccccccacccacaacccacaacaaggcgccacacaggcaccaaccaccacccccgcccacacccccaaccccacgcaccccgccgcccccccccgcaccccac

SEQ ID NO: 508635 - DNA, 918 bp, Homo sapiens
  misc_feature (63)..(63): n is a, c, g, or t
  misc_feature (84)..(84): n is a, c, g, or t
  misc_feature (111)..(111): n is a, c, g, or t
  misc_feature (119)..(119): n is a, c, g, or t
  misc_feature (145)..(145): n is a, c, g, or t
  misc_feature (177)..(178): n is a, c, g, or t
  misc_feature (184)..(184): n is a, c, g, or t
  misc_feature (190)..(190): n is a, c, g, or t
  misc_feature (197)..(197): n is a, c, g, or t
  misc_feature (200)..(200): n is a, c, g, or t
  misc_feature (205)..(205): n is a, c, g, or t
  misc_feature (219)..(219): n is a, c, g, or t
  misc_feature (222)..(222): n is a, c, g, or t
  misc_feature (224)..(224): n is a, c, g, or t
  misc_feature (246)..(246): n is a, c, g, or t
  misc_feature (278)..(279): n is a, c, g, or t
  misc_feature (282)..(282): n is a, c, g, or t
  misc_feature (306)..(306): n is a, c, g, or t
  misc_feature (314)..(314): n is a, c, g, or t
  misc_feature (337)..(337): n is a, c, g, or t
  misc_feature (339)..(339): n is a, c, g, or t
  misc_feature (342)..(343): n is a, c, g, or t
  misc_feature (345)..(345): n is a, c, g, or t
  misc_feature (351)..(352): n is a, c, g, or t
  misc_feature (407)..(407): n is a, c, g, or t
  misc_feature (410)..(411): n is a, c, g, or t
  misc_feature (417)..(418): n is a, c, g, or t
  misc_feature (421)..(421): n is a, c, g, or t
  misc_feature (426)..(426): n is a, c, g, or t
  misc_feature (441)..(442): n is a, c, g, or t
  misc_feature (444)..(444): n is a, c, g, or t
  misc_feature (450)..(450): n is a, c, g, or t
  misc_feature (453)..(453): n is a, c, g, or t
  misc_feature (462)..(462): n is a, c, g, or t
  misc_feature (474)..(474): n is a, c, g, or t
  misc_feature (477)..(477): n is a, c, g, or t
  misc_feature (485)..(485): n is a, c, g, or t
  misc_feature (492)..(493): n is a, c, g, or t
  misc_feature (508)..(508): n is a, c, g, or t
  misc_feature (537)..(537): n is a, c, g, or t
  misc_feature (546)..(547): n is a, c, g, or t
  misc_feature (549)..(549): n is a, c, g, or t
  misc_feature (557)..(557): n is a, c, g, or t
  misc_feature (628)..(628): n is a, c, g, or t
  misc_feature (649)..(649): n is a, c, g, or t
  misc_feature (725)..(725): n is a, c, g, or t
  misc_feature (728)..(728): n is a, c, g, or t
  misc_feature (734)..(734): n is a, c, g, or t
  misc_feature (848)..(848): n is a, c, g, or t
  misc_feature (910)..(910): n is a, c, g, or t
gagatgtgaggggattaaattgtgtgaggaaataataggaaaaatggagtaaatttaaattgnaaatgttaaaatatttaaggnaggagctgatgaagagagagcagaganagctcgtntgaattcttttattggtgccatcgcnattggagaattggtaaagagaaaattgggaannaaaggnatgganaaaattnttntaagnagtggaagagatgnatntnttatggtaaaaaatgatggtgnaaatattataaaaaaaattggtgttgaaaatnnagnagctaaagttttagttgatatgtnaagggttnaagatgatgaagttggtgatggnantanntntgttanngttttagcagcagaattattaagggaagcagaatctttaattgcaaaaaagattnatnnaaagannatnatagngggttggagagaagnnangaaggntgnaagagaggngctgttgagttntgnagttgatnatggttnngatgaagttaaattncgtcaagatttaatgaatattgcgggcanaaaattatnntnaaaaattnttaataataaaaaagaaaaatttacaaagttagctgtagaagcagttctcagactgaaaggctctggcaanctggaggcaattcatattatnaagaagctaggaggaagtttggcagattcctatttagatgaaggcttcctgttggataaaaaaattggagtaaatnaancaaaangaattgaaaatgctaaaattcttattgcaaatactggtatggatacagacaaaataaagatatttggttcccgggtaagagttgactctacagcaaaggttgcagaaatagaanatgcggaaaaggaaaaaatgaaggagaaagttgaacgtattcttaagcatggaataaattgntttattaa

SEQ ID NO: 508636 - DNA, 165 bp, Homo sapiens
  misc_feature (49)..(49): n is a, c, g, or t
  misc_feature (58)..(58): n is a, c, g, or t
  misc_feature (113)..(113): n is a, c, g, or t
  misc_feature (160)..(160): n is a, c, g, or t
tgagaagtttacaagttaagcacctaagtagaggacgagatgaaggcgnctaggactnaagaagcatggtgccaccgtgctaccgccctgggtggcatccttaagaagagggncatatgaggcagagattagcccctggcacagtcgcatgccaccaagnacaag

SEQ ID NO: 508637 - DNA, 217 bp, Homo sapiens
ggcgtaaccatggtatcatccagagtgcatcccagaggcaaaagagggaggaggagcccaaggagacacaatctaacggcactccggacacttttactgtttgatctacgctgtctagtctacgacatactggtgccgtcttgttggaaatccaaggtaggtaacaaagtgttcatgtcgcattgagatgtcttcaatgacatcgcttgtatcttgt

SEQ ID NO: 508638 - DNA, 111 bp, Homo sapiens
tgggctgttgagggtatgagagtagctatatgaacagcgaagtatattcttctaggctagtaggaggatatgaggtgtgagcgaatactagtatacctagaaagtgagata

SEQ ID NO: 508639 - DNA, 302 bp, Homo sapiens
  misc_feature (147)..(147): n is a, c, g, or t
  misc_feature (199)..(199): n is a, c, g, or t
  misc_feature (254)..(255): n is a, c, g, or t
accgattctcacgggtgctattgcgaccactgaaaccaaggttttagagattccggtggagaccttgaaacaacaatacgagggcgctccgcaaatgctcaaagtcatcatcaagtccttggcggatcgtctgcgtttggcgatgancgatgtgcgttccagcaaacttgaaaaagactcctccccttgccctgaagancaagtggcgaaagtttttggcgctgttttccatacggccaatcacaagggcgacnntctcagccgggccgcgtggagcacccgttcaaccggccgagctgatt

SEQ ID NO: 508640 - DNA, 535 bp, Homo sapiens
gtatgaaggcatagtagtctcagggagctagtatgattctatattcgtatatctttgtttgggaaaattatggtccccaacagggtctcactcggtcacccaggcgggagtacaggggcacaatcacagctcactgcagcctcaaactctcaggctcaagctattcttccacctcaacctctcaagtagctgggaccacaggtgtgtgccaccacatcccgcataatatttttttgggtatgattaatttcaacttcaaagaaagtagttgagatcctgtgcacttccaagtgtgagggacccaggctagggtatccttgggtgggtggggcctcttcaaaaggttttaattcggttatagggaatatgataccttaagcttcaattcacggggaagagaaccatgattataagcaaaagttggtcaaggaatagggggagtcttggggtagattaaaatagttgagacctggctaaaaggtcagataacatggtaatccacctccgggttccaagagtttagaagctgccagca

SEQ ID NO: 508641 - DNA, 166 bp, Homo sapiens
acggaataatattcagagacagaccctccacccactggcagattgtaaacgcctggacccgctggtgaatgtgctcatagtactgcaaccagctctgagaagaacgggccttacagatgacacgcagcacgtgggggctccttgtggtactaccgctattggcagt

SEQ ID NO: 508642 - DNA, 134 bp, Homo sapiens
aagtgaggaggaacagccctaacaggcctccagccaggttgaatgagctccattttgttgtagccaaccagtaagatttgctaatgttctaaattaagtgccttctccaaagacatccctcaatagctccttgg

SEQ ID NO: 508643 - DNA, 309 bp, Homo sapiens
  misc_feature (13)..(13): n is a, c, g, or t
  misc_feature (65)..(65): n is a, c, g, or t
atgctcaccgtcntgcaggaaggtcctcgtcgattccacgtttttctcgaagggacagaactgancccgaacctgtttgacaggccgcagaccagtccgatccaagctagctgtgcgattcggtgatccgtctgtcgcgcggcataggtcacataccatggcttcgcggtacatgttctcgttcctttaagacatacgtggaatcgcctatgaccttctctgactacggtcagcggtgtagaaggtccgctccacaaactctcaagtgttccgtgactcgcggtacgtatgcattgatcggctcctatc

SEQ ID NO: 508644 - DNA, 828 bp, Homo sapiens
gagcgggggctgcgcccggtgcagcaacagcagcagcagcccccgcagcagccgccgccgcagccgccccagcagcagccgccccagcagcagcctccgccgccgccgcacgcagcagcagcagcagcagcctccgccgctgcacgccgcctccgccgctgcctcaggagcggaacaacgtcggcgagcgggatgatgatgtgcctgcagatatggttgcagaagaatcacggtcctggtgcacaacaatagtccataccaacgttcgtagaaaaactctttttgccgaaaacgaacagcgtgtcccacaaagaacagtatggagggcgcctcaacttcaactacagaaaacttttgggtcatcgtggcaaaacgtgcaacgaagtggtctgggcaacaccaatcaccaagatctatcagcagcaacttgctgaacaggtatcttcagcgagaaaactggccagatgacacgtggtttctaaaaaatctttctcttacttgcctggacaccagggatcttgctcgcaaggcaagctggcgctatgtcaacacgcttcagtgacaccttgccttcctggcatccaatttttgtggcacaccactcatctactcgccagtatctggacactatacttcgccccttatagatggcattccttgaaccctgggacaacaatttctaccaggattcaatccaagaacacgtatgcaccattccaaaatccctgggaaagcagagtttaccagcagtgggtataacaggtgcacctgtaacgccaggatctgctgcagatttctaacagaaacctgccgctatcacggccgcgc

SEQ ID NO: 508645 - DNA, 364 bp, Homo sapiens
gtgaggcctcaggccaagaacaggagctaaggaagccacaagggaggccattttctgcagaggtggtgaaccagtaagaacctggtcctgaaaaagctcttgtggaacaataagagccaggtgggaaagcttttcatcttgcaaagttggggcctaaggttcttccttgaatgtgggcatctgcacttcagctcaagagtcctgttgggtgaagtccagagtggcctttctgattcctgaagtagataaacaggcctgtcccaaggaagagcaggtccagcataaagaccccgaatccaatcaacatctggctctgtgcagaatcagagcgtgcactccattgcaacacggtctctcaagggat

SEQ ID NO: 508646 - DNA, 1270 bp, Homo sapiens
  misc_feature (284)..(284): n is a, c, g, or t
  misc_feature (293)..(293): n is a, c, g, or t
  misc_feature (601)..(601): n is a, c, g, or t
  misc_feature (646)..(646): n is a, c, g, or t
gccgcggcctgagcgcccggtcgcgacctccggccatggcggtgcatgcgtatacgagtgagaacagaaggacgtcggaccgaggaccggaccaggagcggatacgcttgcgtgctggaccacctagcagctccccgcgtacacaaaggcatcctccagctgcgaggcacgagcgccaagctaggcgactacgccgtgcgtcttcacgggctactcgcgcacttttgattcgacgctatgcgctcccttgcatcatgcatatgcgcgatacgcatttggcctgnaggttacangtgcgctacggccaacgatccaatgtcgatggctcgtcttagcctttgccaagtaccgcggacggagtggacccgatacgggaccgcccatgcaagtagcacgctagcgagtcgcggaccgcggctaggcgcccacggacgacgaatagccaaggccacactcccaggcgatttggaggcttcgcctgcgttggacagaccatggccatgtcgctttggaagcgcaccgatctttggaacacgtgaagcggctgggagccctagcacaggcttgtgcgcgcagatacactccttttaacccagaggancccttagcgggcgccgcgaacggcgagatgcgttgcctgggtggnccccgaacgatggagagtcgcccccaagtgtcgcctctgggtttgccgtcccttaggggaatcctctcgccgaagaccaaagggctaccttcacccaaagcgcaatttacaggcctttgaccgtgtgaaattgcgctataaacgaggggtcggacaaaccttctcttccttccaaggaaatccccgggaaggtcgaggagcacgcgacaaagaacggacagggaggggccttgcggttttgttaaccagagggttccggcggaagtccgcgcaagttgaaaacgcaaggcaagggggggcgtccccgttctgggggaacccaaggcctttcgttttcctttctccatatcattgcgtgtacagtaacgccccagtttctttctaaataacccttgggaagccaccccctcgctgtagtgggaggcccttcctccagagagttccccttgccaaattttgggccacggggccgttgtttaacttacccaagggattaaacccccctttaaaaccccctgtgggcttaagcgttaaaatctccaacaaaggaacggacaaacacaccacttggttcgaaaacggcaaacgcggagagggggaacggacaacggcaaggggcacacc

SEQ ID NO: 508647 - DNA, 863 bp, Homo sapiens
  misc_feature (17)..(17): n is a, c, g, or t
  misc_feature (19)..(19): n is a, c, g, or t
  misc_feature (23)..(23): n is a, c, g, or t
  misc_feature (25)..(25): n is a, c, g, or t
  misc_feature (29)..(29): n is a, c, g, or t
  misc_feature (33)..(33): n is a, c, g, or t
  misc_feature (348)..(348): n is a, c, g, or t
  misc_feature (515)..(515): n is a, c, g, or t
  misc_feature (739)..(739): n is a, c, g, or t
  misc_feature (744)..(744): n is a, c, g, or t
cgcctcctcgcgctgcncnatgntnggangagncggcctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtatgttattcccacacagacatcaaggtgcctgacttctctgaataccgncgccttgaagttttagatagtacgaagtcttcaagagaaagcagcgaggctaggaaaggtttctcctatttggtaactggagtaactactgtgggtgtcgcatatgctgccaaggaatgccgtcacccagttcgtaatccaagcatgagtgcttctgctgatgtgtnggccctggcgaaaaatcgaaatcaagttatccgatattccagaaggcaagaacatggctttcacaaatggagaggcaaacccctgtattgtgcgtcatagaacccagaaaggaaattgagcaggaagctgcagttgaattatcacagttgagggaccacagagtgatctagatcgagtaaagaaactgaatggttatcctgataggtgttgcctcatcttggcngtgtncccttgccaatgccgagattgggggtatacggccttgcatggtcccccatgatgctctggcaggcaacatgggccgctccctcactgtatcccacgttgttccagacaatggttggggc

SEQ ID NO: 508648 - DNA, 586 bp, Homo sapiens
ggatagtttcgactgttctagaaacctatgtggtattttctgaggcgtggtttgatctagagaatgaaatccatttaggcgatgggggatagattaatgtccgcgggaaattactcacttttttgaaacctaaagtgagtgccatgggcactgtgtgtcatgacagggattggtaaatattgtgaaaatacttatattaattgccatgataagaaacgcacttatgagctcacgggattcttggatggggtgcatagagtcaagcagcgtttacaggatgaacctttatgggttatactagctaaagtatgtctctctacatctgtcaatacaatgacacaggtatatgtgagcatgagctactgtgcctcaagtttgcactgctgcaaaaacttttgtagagagattctgctctaagatgttgatatcatatgaaccccataattctctcactagatttagaacaatggtggaagttacagcgtgacctattcttagaccaaaaaggattcttacgtttaaaaatatttaaaataactggggaacaaggcctttccttctacactggggtttcgctgtgtgaccc

SEQ ID NO: 508649 - DNA, 439 bp, Homo sapiens
acaggtggtagagccttaggctggtggtgcagcctattactcccgggctgcaaacctgtccagcgtgttactactgaatactgtaggcagttgtaacacagtgctaagtatttgtgtgcctgaacacatttagacatagaaaaaatatagtacagatatggtataaaggatgaaaattgcttcacctgtatagagcactcaccgtgaatggagcttgcaagactggagtggctctggatgggtcagtgatgagtgctgagtgaatgtgaaggcccaggacagtactgagcaaagccgagttttataaacagtcaacacttaggctgtactacgttgatttacaaatttttcctcaataagaaattaaccttaacttactgtaacttttttacgttttattttacttttaaattaaaaattctaaactttttaaaaaaaa

SEQ ID NO: 508650 - DNA, 346 bp, Homo sapiens
  misc_feature (17)..(17): n is a, c, g, or t
  misc_feature (19)..(19): n is a, c, g, or t
  misc_feature (23)..(23): n is a, c, g, or t
  misc_feature (25)..(25): n is a, c, g, or t
  misc_feature (29)..(29): n is a, c, g, or t
  misc_feature (33)..(33): n is a, c, g, or t
  misc_feature (312)..(312): n is a, c, g, or t
cgcctcctcgcgctgcncnatgntnggangagncggcctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggcccgtagcgccgtgccgtttgggtccggcctacctgataggtgccctacaacatagtcgccgtgnctatactaggtattaggtataatctccccgaacg

SEQ ID NO: 508651 - DNA, 193 bp, Homo sapiens
tcggtacgctgcagggtcttacgcgcaaggattacagaaaaggctaaactgaacatcaggcctccagaacagtgagactattgagtgcctgataaacgcaggtgggatcagaccagctcagagactacacagacccacccaggtgaaagagacccctccaaaggacttttcccagaaagcaaccctatactaa

SEQ ID NO: 508652 - DNA, 1180 bp, Homo sapiens
tcagcaccgggacactggacgtgatggatcccaagacgtgaattgtgatatcaacttgcctctacggagccattgacttgatgttagctttatgcccgtaatatctatttctccctagaccaccaatacggcacatggcctaattcacctgagatatcgctggcatgatgactcctgcacctcccaatgatggcttgctttagtctgtagaatccgacgcttagtttagtcgactttcgctcgtttacttcactaaggtcgaattagtggcctaatgcgatcgcgcttggtcgcgattgatttatgagcaagatacggtataatggcctgctgtaaagtgttgcccgcgtggccacagagcgcattccttgtatacatgtcccaggttgggattcgctgctgccactaactgcaatcattgttgatactcttcgttgcctgagttgggtagtctcttctcaccctggtcgaggatttgtaccactatcgagaacaatacgatcgcatgaaagatgaagtaaaccttcagttccttattgactcagactgtaccacttcgtaagacttgacaggttagtacgcttacctcagtacaaacgcataatttagacaatgaaaaaactactccctattggtctcttcaccaactcacatttgacgaaatcttcctctgacttcgacgtccaacgcggaatctcctggcccttgatattaacgacattactggaattatttacaaaactactcatttatacaaacaacaaacctctgcacgggcccccacctattgaactaccctaagagcgcaattatacaagcaccccatcggtcggtcaataatacttgcccgcacgacccctatacactactacgacccttcctcttattacgctaccactcatacttacacccctttacaaagcaactcaccgatcccctcactatccaatcctcaacgaggctcactatataagctcatcttcactccgcaacacctaccgagtgcccaactacacctcaacccacataccacctcaaacctcactcacgcactcaactacaccccactctcttccaaccactcacatatttcactcaccccacagcccttccttccttcctcaccaactatctgcaccacttctaaccacctcacctcctcttccacataccatattaa

SEQ ID NO: 508653 - DNA, 764 bp, Homo sapiens
  misc_feature (4)..(4): n is a, c, g, or t
  misc_feature (6)..(6): n is a, c, g, or t
  misc_feature (10)..(11): n is a, c, g, or t
  misc_feature (16)..(16): n is a, c, g, or t
  misc_feature (19)..(19): n is a, c, g, or t
  misc_feature (21)..(21): n is a, c, g, or t
  misc_feature (23)..(23): n is a, c, g, or t
  misc_feature (29)..(29): n is a, c, g, or t
  misc_feature (53)..(53): n is a, c, g, or t
accncnctgnnggacncangngncagcgngcatgcgcggggctgcggtggcgnaggcgccctgccgcgcccgccagtcgggaaccggttctccgagtccgagctggcggcgcgctgtttgcctgattctagagctcaatgctgcccatcaggtgtttgaagtcatgatttggtgaaaatgggacagtgaagacgttctgaaaaaaaaaaaggcatatgatgaggtttggacattgagaggtataggctggctgtaggagtcggatccctgcattgtcactgagtccaccatgctttacagaagacgacagatttagtctggaagctcttcaaacaatacataaacaaatggatgatgacaaagatggtggaattgaagtagaggaacgtgctgaattcatcagagaagatatgccaatatacacgatgctactaataaacacagccatctgcccagagaagataaacatataacgattgaggatttatggacacgatggaaaaccctcagaagttcactaattggacccttgaagacactcttcagtggttgatagcagttggttgaactaccccaatatgacgaagacattctcagagacaacacatgtcgacggaacgacacttcccaggatagcagtgcacgaaaccttcatttatgatctccccagttgaacatcagtgaccggagtcaccagacaaaaacttcagctcaacggcattggatgtcggacagccgggaactcgtaacacgcccacctcata

SEQ ID NO: 508654 - DNA, 413 bp, Homo sapiens
  misc_feature (17)..(17): n is a, c, g, or t
  misc_feature (19)..(19): n is a, c, g, or t
  misc_feature (23)..(23): n is a, c, g, or t
  misc_feature (25)..(25): n is a, c, g, or t
  misc_feature (29)..(29): n is a, c, g, or t
  misc_feature (33)..(33): n is a, c, g, or t
cgcctcctcgcgctgcncnatgntnggangagncggcctgtgaccggcttggcggttggagcggctgtcgccatgttgtcggtagcagcccgctcgggcccgttcgcgcccgtcctgtcggccacgtcccgcggggtgtgtgccactcttcaaaaattaggagaaagaactatcaaagcatggacagaaactcgccttagacaaagatttcccaaaggtgagtttgaataagtttccaagttaatgacagatcttacaaaattacacacggaatgctaacatggagatctgcttgaatagtgctgatgacagggcggacattgccaaaaatatctgtgaaaatcaagattcaatctacagtaaattgaaagaatgctgagaaaactctgttggatatgactgtatatgcgtgg

SEQ ID NO: 508655 - DNA, 617 bp, Homo sapiens
gtgatcaattatacgggaattcttacagagcctgttttttgtttaaagatcttggaatttctggaaaagattggtttgtccattccaaatattttggatgacctgatttcattctaactcccatccgtctttctatgcggtttgttttcgcatcttttatctcatttaaatgccgtagccatgcaggtggaaagcagaaatccatttctgcgtttatgttaaactggggctgagagacttgcccagggtcggtgaccgcccagggatccccataccagcgcgtctagctcccgcgttccgatcccggaagggaaaacccatgatcctggcgagggtccgtccacacgtggccagggtggctgatcttcccggctgctgtggttgtcaacaccacttctccggatcgattttcccttttcctcggctctgtcgtccatacgccactcacagcaaacccaggcggcgggccccctccgagggcgctccttgcgtccggacccaggttctcggggcgcccccggtgggtccccgcgaagccgccgccgcacaccttcctcagcgtagcccgccagtggaaaccgggggaggttctgcctccagcacccaagcggcggccg

SEQ ID NO: 508656 - DNA, 1269 bp, Homo sapiens
  misc_feature (4)..(4): n is a, c, g, or t
  misc_feature (6)..(6): n is a, c, g, or t
  misc_feature (10)..(11): n is a, c, g, or t
  misc_feature (16)..(16): n is a, c, g, or t
  misc_feature (19)..(19): n is a, c, g, or t
  misc_feature (21)..(21): n is a, c, g, or t
  misc_feature (23)..(23): n is a, c, g, or t
  misc_feature (29)..(29): n is a, c, g, or t
  misc_feature (53)..(53): n is a, c, g, or t
  misc_feature (151)..(151): n is a, c, g, or t
  misc_feature (771)..(771): n is a, c, g, or t
  misc_feature (784)..(784): n is a, c, g, or t
  misc_feature (795)..(795): n is a, c, g, or t
  misc_feature (798)..(798): n is a, c, g, or t
  misc_feature (1139)..(1140): n is a, c, g, or t
accncnctgnnggacncangngncagcgngcatgcgcggggctgcggtggcgnaggcgccctgccgcgcccgccagtcgggaaccggttctccgagtccgagctggcggcgcgctgtgggctgtgcgggagcgaggggagaagagggaganagggagcccgacatttgggaagggcaggcttgcctctgggatggggaggagccggtgcacggatcctgctgtgcctctgtgcagggcgcgcccagtagtttgggatttgcaagaaaatgcaatcaaacaacatgggcaaagtgcgatgcgtttatcctaagccaagaacacgcttagaatgcacgcccagagccagttctccccaagggatggcaacgcacctgtgtgccgggctccgcgcaagggctttccctgtttattctcccgccgccgctaacaaccttgtggggcgggcatggttggatccccaatttaaaagtggggaaactgaggacagattaacctgtctgcacgtaacacagctgaaaagtggtggaattgctatttctttcaggtttgcctgattctagagctcaatgctgcccatcaggtgtttgaagtcatgatttggtgaaaatgggacagtgaagacgttctgaaaaaaaaaaaggcatatgatgaggtttggacattgagaggtataggctggctgtaggagtcgggtaagtgccaaggaaaagggcctcagggtagcttatggaatggcgattgggccgacagtgcacggacgagaaagcttnggggtggtgagancaagggaaggnaangggaaaacaaaagcgtggaggtgggaaaggaaacctggggagaaaggtaagcgattgcctcatttggagtcttgtgtttatgtttggcttgcaaatagaagcatatataattctagggttgggcttttcttgccaaggaatggattttctcctttctgttcttaggtttatgctgtgatgcacagtgacacgtacctctctctgttcagcaaggttcattccggctattcatttaacagctggaaagttctatatctgtggcaaagatgatctgcggtggagggtttattcctggcccctggccttcctggccttggtcttttgagtgcttaagcggatcnntaattcctttccggttccagtagtgagaggaataaacacttaaaactccagtccaatacactctcaatgtcaataccctccctatctttaaaagaagaaaaaaaaatactaaatcatctttgtttaaag

SEQ ID NO: 508657 - DNA, 800 bp, Homo sapiens
ccggcgttaaagtgcaccaggtggcccgggtagttgaattgaactgtttgtgtattatgtggctgtggtgtcttccctgacaccgttgttgtaggtccttgtgggtgctgtgcttatgtttctcttaaacagatgcctgtgaaatttaccagtggttccagaactccacactcaacacaccgccacctgaggtgtatactacttggggatccgtgcacgttaacgattactaggactatgcagaaaccagagagtttaagaataccgcatggaaaacgtcccccctcctccctgctcctgccgccccctcccgcccccctcctttcctcttccccccgccgcccggctcgccccgtgaccggtcggccgtgcggacgcgcggcattctgcgtgtctcggcctcccgtccgcccctccccgccgcgctcggttcccccctcctctgcgtctctcttcccctccggcgtccgcgcgtctccggtgcgctcgccgttttcccccgtcctcgtgtgtgctcggcggcacgcggctgtcctcgcgcccccctcgtcacggctcgcggcgggctgtgtcgttcgccctcgcgggggtcccgccccggttccgtggctctctcgcgctttcgccgccgttctccccctgcgcctgggccgtcttgccttgggcgggtggctgcccggttggcgcgcgtgcccctgccgccgttctgctgccgtccgggccgccttcctcctccgctcctgtgcgcttccgatcggggctgctcgctttcttttcttcccggtcggtcgtccaggccg

SEQ ID NO: 508658 - DNA, 999 bp, Homo sapiens
  misc_feature (4)..(4): n is a, c, g, or t
  misc_feature (6)..(6): n is a, c, g, or t
  misc_feature (10)..(11): n is a, c, g, or t
  misc_feature (16)..(16): n is a, c, g, or t
  misc_feature (19)..(19): n is a, c, g, or t
  misc_feature (21)..(21): n is a, c, g, or t
  misc_feature (23)..(23): n is a, c, g, or t
  misc_feature (29)..(29): n is a, c, g, or t
  misc_feature (53)..(53): n is a, c, g, or t
  misc_feature (151)..(151): n is a, c, g, or t
  misc_feature (869)..(870): n is a, c, g, or t
accncnctgnnggacncangngncagcgngcatgcgcggggctgcggtggcgnaggcgccctgccgcgcccgccagtcgggaaccggttctccgagtccgagctggcggcgcgctgtgggctgtgcgggagcgaggggagaagagggaganagggagcccgacatttgggaagggcaggcttgcctctgggatggggaggagccggtgcacggatcctgctgtgcctctgtgcagggcgcgcccagtagtttgggatttgcaagaaaatgcaatcaaacaacatgggcaaagtgcgatgcgtttatcctaagccaagaacacgcttagaatgcacgcccagagccagttctccccaagggatggcaacgcacctgtgtgccgggctccgcgcaagggctttccctgtttattctcccgccgccgctaacaaccttgtggggcgggcatggttggatccccaatttaaaagtggggaaactgaggacagattaacctgtctgcacgtaacacagctgaaaagtggtggaattgctatttctttcaggtttgcctgattctagagctcaatgctgcccatcaggtgtttgaagtcatgatttggtgaaaatgggacagtgaagacgttctgaaaaaaaaaaaggcatatgatgaggtttggacattgagaggtataggctggctgtaggagtcgggtttatgctgtgatgcacagtgacacgtacctctctctgttcagcaaggttcattccggctattcatttaacagctggaaagttctatatctgtggcaaagatgatctgcggtggagggtttattcctggcccctggccttcctggccttggtcttttgagtgcttaagcggatcnntaattcctttccggttccagtagtgagaggaataaacacttaaaactccagtccaatacactctcaatgtcaataccctccctatctttaaaagaagaaaaaaaaatactaaatcatctttgtttaaag

SEQ ID NO: 508659 - DNA, 1629 bp, Homo sapiens
  misc_feature (421)..(421): n is a, c, g, or t
  misc_feature (713)..(713): n is a, c, g, or t
gtattacaagtggcccgcgcgttgccgcccccttcggcccgccatgctggtatgccgtgccgctgcgtgctcggtggctccatcggtcattggccggtctgccgatgcctgccggtcgtacttcaaatggagcgatgtttggcttggacgggagatggggtaggacttccctgctggatccgaatccaaacacaaggttcgagagtttgtggtcaagattccgtgtcctcaagttgtcctggggtaaggattacctagctggatgcacggatgggagacagggataagaggttcgcaggacaatgcctagggatggcgactggctttgtgattgcctctttgttcaggctcagtcgtgttcgtagcctcgttttcgagtgccaagcacacaggtcacatgcatgccgttgggttgcgttgnctacggtgtcaccgggcgtgaacatacctagtgtaggcccagtaaatcattcggtaacttgatgcgagcgggcgagacttattggcatgtacatgcatgggtggttccctttcacatcatgctcttggcgcacacagagcaacataggaaccaattgctccacgggcagggacgtgctagcaaaataaccacaaatatgcgcatagtgtcatgggtacccttggaccaatccttgttgggcccccattgtgcgacccaagaagaagagggtatccatagtccacttcctgtnccaaagctaaaaccgaaatgggaggcacacggaaatccggtagcctaggacttccgaacaaccgcgggaaccgtgttctcggttttgtgacaaaacgtgcgcttagtactggaccgtttttggcccaaacaaacttcatggtttacccatccacctatggcactttttgtttgcttgtggcccatggaaccacaacaaaccctaaatttgtaagcgggtcgccacctcgccatttttggcaccctaagacaagtgtccctagggtgtgtcggcacgttcaccgggggcctttccctttttggcgccaccctgaaacgcaatgttgggttggaaccttctgcccctgtgtccaataccccaataggaatgcaagtcaagcagctgggattaccttggatggctcttcaaaagaaggccggtaacggaacctggtggacatggagcccggaggcgcacaagggaattccgcagtggacatctcaccgagcagggagagttcccataaggccgctgaaattgtcactctggggaacaataggccgccgggtgagtatgtatttccattgtagccccatgtaaattgtttccaagtgcaaagactcctgggggtacactgggcatagttgacagcagagcacgttttcacgtgcgaaggtggggtgactaaccccccccatgttgagatttatcagagagccccccttgtgtgtagaatcggggcatagatgttagagaccaccgcgactcaactatgaggatgcaacaatattatacatagcgggcccggtgggtatctccacctcacgatgatgtttagtagcccgcgagaatataccgcgcacaacaaattctatttcgttgtcacatacaaatatagtatgtgaggcacggaactacctggtgaaactatatgcaa

SEQ ID NO: 508660 - DNA, 202 bp, Homo sapiens
ggtgtgtcatgcaggagcaattcgtggtattcccatgagcagcagagtctgagtgttagatgtgcaggatccatgagcggggagaggctggcgggagttgggggcctggaggctgggcgctggttacttggtgacgtgcagagttctctctggggggctgcggctcatcttggggggagctggactcagatgcccccgtagg

SEQ ID NO: 508661 - DNA, 522 bp, Homo sapiens
tagactatgaataccaaagaggcaaaaaatggaatgttaattattgaacaaaaaagctggtggaataatgtgatgtcaataatctgtgtgagtcttagaataagatagccaaatcagagtatgtacacattcccagattataatatttccacaatacaaagaaattaattctcaagtcttaatttgtagaacatcctaaatttataattattcatatcactttaaatgaaatttttacagagataattgtaaatttatatacagtcctaagaagtaatacagaaagactatgaaatgctgctgaaagaaatcatagacaacaaacacatggaaacacataccacgctcatagatgggcaggctcagtattgtgaaaatgaccatactaccaaaagcaatctacaaatttaatgcaattcccatcaaaatactaccatcgttcttcaccgaaccagaaaaagacaatcctaaaattgatatgggactgaagaactgcctgtatagctaaagcaagactaagca

SEQ ID NO: 508662 - DNA, 219 bp, Homo sapiens
ctcgaggccaagaattcgccactacgagttcagtgatcattctgacgtacccaacaacaatgttaatgccctgatcaatggctttgtttacggttggcatggccaagtctgttatatggacatcatgactgccacgcccatgaaggtgggcctcttaccccccttccccaacatcgtcctttcgctactcagtgagctcaacatctctgacatacacga

SEQ ID NO: 508663 - DNA, 398 bp, Homo sapiens
  misc_feature (101)..(101): n is a, c, g, or t
  misc_feature (242)..(242): n is a, c, g, or t
ccagttccgctttcatttcctacataatccatcacataccgagaaccaatgacataaagccacatgattatctcaatagatgcagacagggctttcgatanaattcaccaccacttcatgctaacaactctcaataacctaggtattgatggaacgtatctcaaaataataagagcagtatatgataaacctacagtcaatatcacactgaatgggcaaaagctggaaccattccctttganaaccagtagaagacaaggatgccctctctcaccactcctattcaacacagtagtggaagttctggacagggcaatcaggcaagagaaagatatagagggtattcaaataggaaaagagggagtcatagtgtcctcgtgccgtattcctgcagcgcg

SEQ ID NO: 508664 - DNA, 184 bp, Homo sapiens
cctttttcccccccccccccctttttttcaaaaggggggcccaaggaaattaacccccccgccggggggggttttatttaaaaaatttttgggaaaaaatttaacccccaaatggggttggggttaaagttaagcccccgggcctgggaaaagattaaaattcaaaaaaacccttttttaggga

SEQ ID NO: 508665 - DNA, 330 bp, Homo sapiens
ctgcactcggtaccagaaaaaggtattgaattcaatgaaagtaagaaccaggccaggcgcagtggctcatgcctgtaatcccagcacttggcggaggccgaggcgtggtggatcacagagatgaagagttcaagaccagcctggccaagatggtgaacccacgactctactaaaaatacacaaaaaaattagctgggtgggggggcaggtgcctgtaatcccagctactcggattctagtgaggcaggagaatcgcttgaactcagaggggggaggttgccactgcactccagcctgggcgacagagtgaggctccgtctcgagagggta

SEQ ID NO: 508666 - DNA, 700 bp, Homo sapiens
  misc_feature (357)..(357): n is a, c, g, or t
acaagaagaccaagactgagtacttggcggaacgaagaataaggagattgtgaagaaacattctcagtttattggctatcccattactctgtttagtggcagaaggaacgtgataaagaagtaagcgatgatgaggctgacgaaaaggaagacaagaagaagcaaccagacagcagaagagcaacagcagtcggaagactcaacctgaaattgcaagatgtcggttctgatgcaggcaagcacagcacccgcaacggactggtgcaccccagcacagtcacagcaacgcacacgcaacgcatctacaggtcaacagacgctacgaatccgcagtgccacaggcacagaacgcttccnagaacctgaatagacccaaacatagtctctcaaattcctggggaacctccaatgcaaagcagttcgcaccggcaaccggaattcattttgacacgtgtaacactggcagcggcacggttaccggggcaggaacactttcctcattgcagaggacagctttgcactccaaatggacctgggaagatcacgtgtggccagtgaaagccattcttctcaagttcgaacggacccagtttggccattcatgagcccttctattttgtcccaccgacgtggctccctttttgatcttgtttgaaaacactagatcagaacatacgaaacaatatcaacacttgtaatg

SEQ ID NO: 508667 - DNA, 669 bp, Homo sapiens
aaactaaccggtatttttgtccaaaggagcgcttgtttagatcggctctttcttccaataattggtggaaagaaggctttctctctgaattcgcttagtgtaaccagaggcgtatattttttaggcgccttttcaggatcctaggtagtaatattcagtggtttaaatcttattttatgcttaagctcaaactggttaagactaccttagttgcttatagtgaaatacttgattgcacaggtgttctctcgatttggagctaatttttacttccaccgtcatttgtaactgttaaaaccaactcagttccatcatggtgatgttcatgaagatcaagtcttttgaggtggtctttaacgaccctgaaaaggtgtacggcagtggcgagaaagtggctggacgcgtgatagtggaagtgtgagaagatactcgtggcagagccttaaggatcctggcttgcggagtgcctgaagtgccttagatgcagtgatcccagcagtgcaaacatatttcggagtaccttgactttgaagacactcttcttctggaagactagtcaacaggtggagattcagatggtgatcatgacatcttgaacacatatatgtattcattcggctattaacttactccagggccctgtgggaacatccctcggaacattggggc

SEQ ID NO: 508668 - DNA, 596 bp, Homo sapiens
aactctaaggatcccccacagaacatgaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccccccccgcccctggggtaccatttgcatgggggtggggtcctcctgtgctatttgtacaaataaacctgaggcagg

SEQ ID NO: 508669 - DNA, 156 bp, Homo sapiens
gtgctcacgtaatttcttctggctggctccagctctgctccagccaattaccatcattgttatcatccacccaacatcccgtcgcttccatcatttctcacatacagcagtcacacacatcatcgtcgtccaatcatcagcatcaccatgttgtgc

SEQ ID NO: 508670 - DNA, 497 bp, Homo sapiens
tgtccatagtctattaatggaagcacaccctaaagtgtcaaaatgattaacgacttccattttttttagacagcgggttggctttacaccaacgaaaaataaaaacagatgactttgctctggagctccaatcactttctcttattctcacggtaggctgagatgctggtaaatgtcatgttctatagcctaaggcagcttgacttgcaccatcaaggaatttaccctcctcgggaaagcggggatgcttatcgcctgccttgaagtacttctctacaaaagctgtgaaacaatacataacaactttcagttgctcttttgttgcctcgggcttgagtgacacaggctcaacaagtgcacccttgcatatagatgtggctctccttctcagaaagcgagcatatatctgcatggaaggtgaatgtttcagcattaaactctatgagaacgtatgcttgattgacttccagagctgaaaagcatgcccacctgttaaa

SEQ ID NO: 508671 - DNA, 645 bp, Homo sapiens
caacatgtacacttggctaatcccagagaggctatccccacataggcaagtccccacactggcaatccccacactgaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccccccccgcccctggggtaccatttgcatgggggtggggtcctcctgtgctatttgtacaaataaacctgaggcagg

SEQ ID NO: 508672 - DNA, 368 bp, Homo sapiens
  misc_feature (167)..(167): n is a, c, g, or t
gagtatctagaggatccgtgaggtaccaaaaggacagatggaggatgtatgcagtacaataattttaatgtaaaacattgatgaagggggaagaaaatagtccgagtcttaggagaggtctctttaggagcataaatcagtcagctttagggcaaggctgctactgngaaatcaagacaataaaaaaatgaaacaaaactctaaagcaggagaaaatcccagggagcagacagctaaaggggaagtcctgagcacaagttacggctgtgaatttttaaaggcaaaagcgaagtccctggatgtggtaacctgcgtcctgaccatctgccataacatttgctagtctgaatcacttcagggcctattcc

SEQ ID NO: 508673 - DNA, 559 bp, Homo sapiens
tgatctagaggatcacccagtccgttcgactgagccacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccccccccgcccctggggtaccatttgcatgggggtggggtcctcctgtgctatttgtacaaataaacctgaggcagg

SEQ ID NO: 508674 - DNA, 379 bp, Homo sapiens
  misc_feature (33)..(33): n is a, c, g, or t
ccgaaggtggggcctggtgtgtttgggttctgngggtggatcctcatgggctgggtgccatgaaccactcaccacagtgagttctcacgagatctggttgttgagaagtgtgtcatcctcccccacaactctctgtcttttgttccggctctggccatgtaacaagcctgctcctccttcgccttctgccatgactgtaagctttctgagggctgaccagaagcccagcagatgccagcaccatgcttcctatacagcctgcagaaccgtgagccagctaaacctctcctcataaatcaccgagccccaggtttatctttacagcaatgcaagacctgactaatacagcaccagctccccaaaataaaaagaaatattc

SEQ ID NO: 508675 - DNA, 586 bp, Homo sapiens
ataagatatgagtcagagtcggagaggcgtgcagtcatgagggcttgacgtaggtgctgatgagtcgtggtacgggacaaccctgggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccccccccgcccctggggtaccatttgcatgggggtggggtcctcctgtgctatttgtacaaataaacctgaggcagg

SEQ ID NO: 508676 - DNA, 500 bp, Homo sapiens
gggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgcaccagtcttaggcccccccaagacccagccctacccatgagcagactgatagccatgacaggaggtaaatcctggcaaccaactgggctgggggccaatcctgataccagtgtgcccacagtagtctgcccttggccatgcaaagacaggtc

SEQ ID NO: 508677 - DNA, 387 bp, Homo sapiens
gggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccgtagggactcagtaacaagatggatagagtcaagtacgtatgccaccacatggattgtgagaggatctcgcgaccagtaaatgacaaggtgctaca

SEQ ID NO: 508678 - DNA, 168 bp, Homo sapiens
gcccgtcactctgctccatgtcctacggccctcttattgttctcaatctcctctagtcactagcctcatgcggcctgccgtggtctcgcctccagcctcgtcgttcactagggcgtctctctctcttctcccactccaatcttttgctccatgcactcatctcatgag

SEQ ID NO: 508679 - DNA, 114 bp, Homo sapiens
gaagttaactctatgcacagcattcactatcttaacaagctttgagtgcaagagatagaagagttcaaatctgaccaagatgatgatagtaggataagagaattctctgctaag

SEQ ID NO: 508680 - DNA, 100 bp, Homo sapiens
tattgtatatggggtatttatgctacataagaaaacagtaaatcagaagaccacaatctacgaaattcaggatgatagaggaaaaatggagggtaccgag

SEQ ID NO: 508681 - DNA, 694 bp, Homo sapiens
ggggaaggtggctcggggggggggggggggatcccaaggcccaattccccgaaccacttcagggttccgtggtggacagctcaccttaggtggcaagggcatccagggtctcccgggacgtcacctgcatcctgggactttggcccgtggttcttgcactgcccgggatttcaaggaggctggtgccgatccaaacggttccgtatatccaggctttttgggaccaacgccttatggctccagagacccattcgggcgacacccagcgtggcccatgtgtacaacgctacacgaggagagtgtggaaggaaaccgtatttcccaaagagggacgcagcagagtatattgaccaattcacgtggcaatgtgaacatcccaagagaccgtcacattcgtgggtatactccagaaacatcaatagattcagcggaaagacgcccttgccaacgcaagtgtgggagggaaacaagcgcccaacacgaggaagagaattccgcacagtcatagagacggccgtgaccatcccgagcagatattatccacggtgagcgaggcagacaaatcgaaagagatccgggagagacgatgagagagggccccccgagatggggggaataccccctacgaagaggaaggagtaagtgggtaccggacgcaaagagacaacagcgtgggggtgtatatgagaaaacc

SEQ ID NO: 508682 - DNA, 337 bp, Homo sapiens
aaagggcgatccttaatgtatattataaatggatcttaattattgctgataaacgtattcatatttattctctagaatagagtatcctattgtctgagataaatctagtttccctatatcatagtggctatttatcttccagcccagaagtttttcctttgtaagataagttcattttgtgagtttatagatttggattataaaatatagatcggtactgttagactaatttggcccagagattctcatgggtccacttgggagaaataggagtaattctcaaaatcatattgagaaactccatgtttcacaaagaaaaattagttcttagctgaag

SEQ ID NO: 508683 - DNA, 312 bp, Homo sapiens
tccaatggctgtcatgcagcaggctcagatgtagctgcatcccgggacctaatagctgtctacacagcagggtccaactgcagctccgtcccaggacttaatggccgtctatgaagcaggctcagatgtagctgcatcccgggacctaatagccatctacatagcaggctcgaatccagctccatcctgggactgggacctaatggccgtctacacagcaggctcgactccagctccatcctgggactgggacctaatggccgtctacacagcaggctcgaatccagctccatcctgggattgggctatcaa

SEQ ID NO: 508684 - DNA, 358 bp, Homo sapiens
aaaaccaacagttatttgttcttgcactggctaagccattctgttatctctgtaaatactgtgatttcttttctattttctctttagaactttgttaacagaaattctaaacatttttaacacacctgctctccacaataaagtcagcaaacactaaactaaccattacttccacagtaaactacttacttctctctcctttctctggctggtgcggccgaacgccaattccacaacaccggggatctttcaacacacggcgtcttaaaagcctcttcctaacccgcaacttacttacttttgggcagcacacagcaacgccaacaattgcacaactcagcagtagcagcttcatgct

SEQ ID NO: 508685 - DNA, 347 bp, Homo sapiens
ctccattaatgtgtgcccagagtgctacagggattcctctagttaggttaatagagctcgtggcgtaccagcctgatatagttcatgggaaaactcgacctgttgaggggtctctgagcttgctctgagtcttgctgtaaatatctctttgatggttgccagtaaaataaagttaaaaaaaaaaaaaattaaattagccaggcatggtggtgcacacccatggtcctagctacttgggaggctgaggtgggaggatcgcttagacccaggaggcggaggttgcagtgagtggagattgtgccattgcactccagtccagcctgggcaatagagcaagaatctgtctc

SEQ ID NO: 508686 - DNA, 328 bp, Homo sapiens
ggaaacaggggtctctctctgtcaccaaggctggagtgcagtggtgtgaacacaggatcactgcagttcaacctcccaggtcaagaaatcccttcccccataacctcctgaggagctggtgctactgcaggtgcataccaccacacctagcttttttttttttttaaattttttgtagagacagggtctcactatattgtccaagctggtcttgaactggactcaagggatcctcctgtctttggcctcccaaagtgctgggataacaggtgtgagccactgcacccaggccatctcatttcctttagtgcccttctgtcgtcttctc

SEQ ID NO: 508687 - DNA, 904 bp, Homo sapiens
  misc_feature (42)..(42): n is a, c, g, or t
  misc_feature (730)..(730): n is a, c, g, or t
  misc_feature (737)..(737): n is a, c, g, or t
  misc_feature (743)..(743): n is a, c, g, or t
  misc_feature (753)..(753): n is a, c, g, or t
  misc_feature (765)..(765): n is a, c, g, or t
  misc_feature (773)..(773): n is a, c, g, or t
tctcatgcctccttgcataaggggtttctctcaagccagttncaaagccccctccccttgccgtccccacacctccacggagagtgaccccaggcctggtgctgctgtgctgactcgtgaaccatgcacaaggcgaggctgacccatagccccttcttgctctgcccttggtttatacgcctgggatgtgggtaaaatccgtatcatgtagagcaaagtcttaagtgggctgcaacacgtatgtgctttcaaacacttgtaaccccagcatttgggaaatggaggaggtcaacctctactccatagcatgctccaggccagcctgggctaccccaaaaccaaaccaaaagccaaggaaaatggagctacccaggagctgcccacgagagcccgacttggtctcactcaccctggttttacttttcaaccttattcttgtgaagtgacttgaaatctggttgcaccctctttgctgactgaaaattagagctgcacaattcctgggaattacggcagtgcactgactggccactgctgcctttgaccggctcttcccacgcgtgctcaccattaggtgaacattatattccactccacactctacctgcacaggcattgtggtcatttttgtatggactaaatggtatagatctgtagtgtgtcaggagcataggcagtatcaaaatcgtgctatttacatcttttctatgtgtaatgcttatggcatgangacttgnttcganccagatggtnttgacggtctanatgcctangatttttttacccccaaaaaataaaggattttataccggagttcctatctcgaaagtccgggcataactgggagtaccgggttaagggtgcacccgcggtacaaatgttgttttaaaagggggttcgcgca

SEQ ID NO: 508688 - DNA, 139 bp, Homo sapiens
ctaattcgtcacctgttacgtaacgggtacgggaccgcgacggttgaccctgtatacgggtgacgaccgaacttacttcgacgatgctactacggacgctatgtaacggtgacggtacgcgactgacgacgtaactacg

SEQ ID NO: 508689 - DNA, 939 bp, Homo sapiens
  misc_feature (1)..(1): n is a, c, g, or t
nggcgcccggggtaacacaaaagggggccccaaaggagccgtggtcgcccgcgcgcgccttgaaggggccaccggctggttcccaagaagctgccggtgagattcggtccagctgcaaaacaacggggccaccaaacctcggcatgtggcgccaggactctccctgggtgacaagtcccgcgcgctctggcagtacaattcacggggcccccccccattggcaacccagcgtaggcgtctggggacgagcccgccaccggtggacacggcaagccaacgaggcgcaacagggggtgcaatacacacacacatgccaacgactgcgtctcctatcagggctcgcaccccaggggccaaccaagccaaacagcgcggattccacaagggggaggaaaacggggcagagcacacagcgcccagtaaccggcgcgggtaagtcgcttcccccaaagagatgagttccccggggccaagtccctcaaccaccacagcgttcttgtgaggccaccccccggagtggcgactccagcgccgcaccagaaaagcagggccacaacgtctctggaccccacccacacagtgcctcgtccccaagagccaccctgggagcaaccccctcctgaggaagtcacccctgtcttgcgcgcgcgcatatcttctatggtacgcatccttctcctgtcctttggagagagtggttcacttcccgcatggaggaggggcgcccaatgtgtacaacgaacccctatcaggagggcaacgctagcaggcacaacgatcgctctcttcttgctcgcccctcggttcacgtcggggaaggcatcctcccgcgcttagtgggcgggcgacgcccgcccgaatccaccgtcttgctgacacgcttgccccctattcctcctctgcgccaaaaaaacgtttttttttcgcccaaacaaaaca

SEQ ID NO: 508690 - DNA, 121 bp, Homo sapiens
tacttttcccagcagcactcctgtgggtgcagcgtgatatgagggcagacaagaatctcatatgaagtgaagaggacagggtgcttgtggacccacagtggtgctctgtgtgacagtgcaa

SEQ ID NO: 508691 - DNA, 113 bp, Homo sapiens
gagtgccagaacgtgacgctcaagcacacgcacccacacaggagagcagcacccactccccaggccccgcccacgccctctcacctagagaacagcaccagctccccacagcg

SEQ ID NO: 508692 - DNA, 136 bp, Homo sapiens
cacggtgattaccaaggaggttcccaaggcggctacgaaggaggcggctatcggggcggctaccagtgccacccggcgggccgtcacgagaaaggccgctacgcgagcatgtatggcggttacggcagcggtcagt

SEQ ID NO: 508693 - DNA, 379 bp, Homo sapiens
  misc_feature (31)..(31): n is a, c, g, or t
  misc_feature (92)..(92): n is a, c, g, or t
  misc_feature (127)..(127): n is a, c, g, or t
  misc_feature (147)..(147): n is a, c, g, or t
  misc_feature (151)..(151): n is a, c, g, or t
  misc_feature (166)..(166): n is a, c, g, or t
  misc_feature (188)..(188): n is a, c, g, or t
  misc_feature (191)..(191): n is a, c, g, or t
  misc_feature (232)..(232): n is a, c, g, or t
  misc_feature (240)..(240): n is a, c, g, or t
  misc_feature (308)..(308): n is a, c, g, or t
  misc_feature (339)..(339): n is a, c, g, or t
  misc_feature (377)..(377): n is a, c, g, or t
aaaactcgaacattaacattcttcaattttntgtaagctctgcagtccggaaaatatacaaacttcaaacagctgccaaaatagtgtctttnggagacaatagagtctctacatcgatacatgacanataggcatttttctaatccntccngccctggggcggccngcgcgtctagcctcgccatttnccncctggcggcatgccagctctcctcccccctccccccctggngctgggcnggctgggctgctacttaagacaatctttagtcagggtgaaagcgagatgaaaatgccacttgggaaancacttgtttcctccctctgccagccgctganttggtcaagtgttatggcccgttaggtgtctttggtcngc

SEQ ID NO: 508694 - DNA, 482 bp, Homo sapiens
  misc_feature (84)..(84): n is a, c, g, or t
  misc_feature (242)..(242): n is a, c, g, or t
  misc_feature (334)..(334): n is a, c, g, or t
taactggggccggcttattacagcttgtgtgtacgcgcgggtgtgagccgggttattgaagtaaaaatgtccagaaaaatccanggaggttctgtggtggagatgcaaggagatgaaatgacacgaatcatttgggaattgattaaggaaaaacttattcttccctatgtggaactggatctgcatagctatgatttaggcatagagaatcgtgatgccaccaatgaccaggtcaccaaagntgctgcagaggctataaagaaatacaaccgtggggcgtcaagtgtgctaccatcacccccgatgagaagagggttgaagaattcaagttganacaaatgtggaaatccccaaatggcaccatccgaaacattctgggtggcactgtcttcagggaagctattatctgccaaaatatcccccggctagtgacaggctggggtaaaaccatcatcatttggccgacatgcttatgggggcca

SEQ ID NO: 508695 - DNA, 457 bp, Homo sapiens
tctgatatctgcttataccagttatgcttttgataatagttatgtaaacttaaaaattagcacataatccatgaattatgaggatgaaaagagagatgtttctaatgaaactgaatgcattggaaagactgaatgaatgcaagacatttaaaaacatgtttatttggtgtggacaagatcattctctaagtttggagaaaaaaatatgaaaaacaaaaaacattctcttctaaatacaggttatttgaaaaaaattagctagttatttatcttaaaaaaatggagactggaaatcatagaatttagttgcataaaagagaaacctaagccactacaaaaagatgatggggaactaaaatctgcctaatctaagtaatggctgtggctatgcatcccaagattgtaaataaatatattttccatgtataaaattaaaataaaatgtttaagatgtaaa

SEQ ID NO: 508696 - DNA, 191 bp, Homo sapiens
ttcttttcgtcctccattattgttggtttccccattactcccactgtatttccccctcgcttatccctcgcgttccccctcctatggtctctgatctgtccttcgttggcttcctgtgaccgtgttctgccgaattcctcgtccttcctcccctcgcccctcatcctgtctttctcgcgtctctacgtctc

SEQ ID NO: 508697 - DNA, 522 bp, Homo sapiens
ttgctgatgatttgctagtattttgttgaggatttttgcatcaatattcatcggaataatggtctgaagtttctattttttgtggtgtctttgtctggctttggaatcagggtaagctggcctcatggaatgagcttggaaatgttccctcctcttcatttttttggaagagtttcaggaggattggcgataattcttctttaaatgtttggtagcattctccgatgaagccatctggtcctgggcttttctgtgttgggaggtttttgattactgattcaatctctctcattattggtctgatcagactttccatttcttcatgattcaatcttggtaggttgtgtgtttcctctagaaattggtccatttcttctaggttattaaatttgtaggcatacaattcttcataatattctcttataatcctttttatctctgtcgtattggtagtaatgttccctctttcatttctgattgtagttattgaatgttcttttttttcttaatctagctaaggat

SEQ ID NO: 508698 - DNA, 139 bp, Homo sapiens
ggcagtatacagcgtattatacaagcatatttaatgctgagtttaactaatatgtttacatatggtaattgtagggtaatacccacaacaactgtagttgcttacttggccaagagtatgcttatttacagtgttagac

SEQ ID NO: 508699 - DNA, 867 bp, Homo sapiens
  misc_feature (860)..(860): n is a, c, g, or t
aaatttcgtgcattttgtttcccaccggttaaaagggggctagttacagtgtccaccctataaggtttttagggccaaaggagttccaggatgtgaaccccttagattcgcccagccaggtggccaccccttatacccccggtcgggggggggcttaacccgggttttttgacccaggctcggtgagaccctgtctctaaacatttttttttttttaattagctgggcatgatggtgcatgcctgtggttccggctactcgggaggctgagatgggtgaatcgcttaagcctgggaggtggaggatgcagtgagccgtgatcatgccactgcactccagcctggtagacagagccagaccttgtctcaaaaaaacaaacaaacaaacaaacaaacaaacaaacaaagaatgatgatgacacatggagccactatataaacgtttgctcttcttattagtggttaaaatgtctgaagtcaagtataggtttaaatccttgttttaccacatactggctatatgaccctgggcaagtatttaatctctctattaaaaaggtaacggttgcaccaactttctgtggttttcagaagattaaatgagacaaagtccataaattgcctagcatgctgcctgatcttaggcagcaaatggtggtgatgacaattagatgacagcaggtcagttctggaatgggaggccctcacccagctcctacagtgaaacgtacagcctgggctgctgctgctttgcaagccccaggtttttcaggtgtagcctccccggggggtccacaattaccagctgaatctactttgttttcaggaaccttggacttatgatgggtcaacttggccctnaaaagct

SEQ ID NO: 508700 - DNA, 730 bp, Homo sapiens
taattttttgtatttttagtagagacggggtttcaccgttttagccgggatggtctcgatcacctgacctcgtgatccgcccgcctcggctcccaaagtgcccttctttcttttaagtctgtttgcttaggtctttcttttgaggtcttcttactctatacgtaaaactgcaaccctaccccacacagccataccctacaagattccatttctccctctattctctatttttttccttggcatttatcactgtagagcattctatacatttgtttatttatcttctttattgtctacattgcccctagagtgttagtttcccaagggaacagatttgctttcatctattttgttcactggtattaccccaatacctggaatagtctctgaaacaaaccaagtgttttctatatatttaataaataaaggcctatatatcgtattattctgtttccttaatgtctcatttgccaccaccctcattcagggcactgtgacttctgggctacaggattgatgatgatgatgatgatgattttgagaccgggtctcgctcctgggcccaggcctggagttgcagggggcaatctcagttgatgcaactccactttctaggctcaaagtatctctactcaggaagctgaggccaagatcacttgaacctggaaggcggagttggcggaacctggattgttccctggctcccacctggggaaaaagagatccggta

SEQ ID NO: 508701 - DNA, 136 bp, Homo sapiens
tccgaatcgagccgttacccacgaccgtttccaacgggcgtgctgcatgtggttgaacggcgttactcactgggcgtcaagagggccgagctatgatcgagattttgcaacagtattggcagtcgctgctgtggag

SEQ ID NO: 508702 - DNA, 341 bp, Homo sapiens
ctcggacctctccctacgtatctagaagtttgtttttttgagacaggtcctctctgttgcccaggctggagtgcagtggtgtgatcacagctcagtgcggtcttgacctcctgagctcaagcagtccttccgcctcggcctctcgagtagctgggaccacagatgcacgccacaacacccgactaatttttgtactttttgtagaaatggggcctcactaggttgcccaggctggtcttgaactcctgggctcaagcaatcctcccacctcggcctcccaaagtgctgggattgcaggcgtgagccaccgcaccccaccatggtaggatacagtagggaga

SEQ ID NO: 508703 - DNA, 726 bp, Homo sapiens
attgtgcctattgccatactagtctttgccgcctgcgaagcaggggtgggcctagccctatagtctcaatctccaacaatatggctagactagtaataacctaaacctactcaagtgctaaaatagtccgtcccaacaattatattactaccagtgacatgatttccaaaaaaaccacatatttgtgatcaacacaaccacccaaagccttaattattagcatcatccctctactattttttaaccaaatcaaaagaaccttattgaggttgtccccaacctttccctcggaccccataaaaaccccttcttaatattaaaattagctgatttccttacccccttcaagaaatcaatggcaaagcccaacgccccacttaatccgagtggaaacccactttaatcacgggaaaaaaaaacaaacacgcaaaaaacaaaaaaactgttgtgggggcgcgctcggccacaagaaaaaatttttatcaaacacactctggttgggggcggcggcgcccgggatgagataatgctgaacgagcgccgaagaaggtcgccaaggagaaccggggcaagacaatagggggggcttcccaccaaaaaaacggcggggacaacggggtttggacaaccagggagtggggacctcggacactacagggggccagagcgaatatgcccgccggggtaaacaaagaaaggagagaaacgggagaagaggagacagcg

SEQ ID NO: 508704 - DNA, 983 bp, Homo sapiens
atttctagcaggtatcagctcctagcagcttatgaacacatatgcttgctatggccaggcaaggtggtgtgtgcctgtaatcccagcactttgggaggccaaggcatggtggatcacttgcagtcaggagttcaagaccagcctgtccaacgtggtgacaaccccatctctactaaaaatacaaaaattagccaggggtggtggtgcacgtctgtaatcccagctactcaggaggctgaggcaggagaatcacttgaacccgggaggtggcacggttgcaatgagccaatatgacaccgctgcagtccagcctgggccatagagtgagactctgtctcacacaaaggaaagaacaaataggctgggcacagtgactcatgcctgtaatcccaacacctttgcggaggccgagtgccggtggatcacgaggtcaggagttcaagaccagcctggccaagcactggtacacaacctcgtctctactaaaaatacaaaacattagccaggtgctgcgtgcgcaggctccctgtaatcccagctactcaggacgctgacgcagaagaattgcttgacacccaaggaggcacagttcgcagtgagccaccatcacaccactgcaactccagcttggaccacagaagcgagaactcctgtcttccacaatcataggcccggcattggtggtcaacgccaggtatcccagcacactgggcaggccgactcgggagatcccacggtccggaacgtacgacacagcccgaccgaccaccttgctgacgctccgcgtgttaagacccacacttagccagggccgtcgagccggcccggttccccatgatccccaccgcttgtgcccagcaaccgctgtcaccagggccaccggcgcccgcgcctaactccccgcgccttccgtgcgcacaccgcacttgctcagcgacaacaaacttgactcatattcccccgccaccaacgcccaccacagg

SEQ ID NO: 508705 - DNA, 590 bp, Homo sapiens
gagagagagagagagagagagagagagagagagagagagagagagcgctagtgacagacacgctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccataacatcctctccaaatgctgtgagtgtgcctctgaagattgcatggccaaagagctgcctgaacacacagtttaactctgtgacaatttatccacaaagaactctaagtttgaagactggtgccaagaacaaacagccatggacgtttttgggtgcacttacttcatgccagctgcccaacttcccgagcttccaaatgtacagttggccacaaacaaagattggtgggatccacgatacaccgtcatggataagtatacattcggctacgcggacgggcttatcttccggaggtttcctccgtcggtccttc

SEQ ID NO: 508706 - DNA, 336 bp, Homo sapiens
ggcacgagcgcccagtgcagagtacctagaatagccacaacagttctgaaaaagaacaaacttggaagacttaagctgccttacttcgagacttgatataaatctactataatcaagagagtatagtattggcataagaataaatacatagccgggcatggtggctcacgcctgtgatcccagcactttgggaggccaaggtgggcagatcgcctgaggtcaggagttcgagaccagtccgaccaacatggagaaaccccgtctctactacaaatacattaattagcctggcatagtggccgctgcctgcaatcccagctacttgtggcgctcgtg

SEQ ID NO: 508707 - DNA, 425 bp, Homo sapiens
ctgtctgtgtgtgactcgtggtgtttgggccgtgtagcgtgtgctgttctgtgtgtagctctctgctagtgtgatggcggccgctgtttgcgggtgctgttctgtgtcttagctttgtggtgctcgtgccgtgtagcggatgctgaggagtattcgatgttcgtgcttgctcggtgcccgtgtccctgagctcaagttctgtagtctaaactacataatgctcgctatatgcatccgccgtagggcaccgtgatagtaaactactatcatgctggtggcttataaccagatgaagttcatgtgtcgtgagcgttacggatgactagaaactctgaaatcaaggatgcagtagggacaggctcccctcaagatctggtggggaggagccttccttgttcttcccagcttttggtggctccaggtgt

SEQ ID NO: 508708 - DNA, 393 bp, Homo sapiens
aggttcctggtctcccgagttcagaggtcacggtgggggcggaagccagcatggcctgggtaaagagacgcgagcagggagaggcaacaggcgtcccctctggaagcagactttggaggagagtggacatggagggtcaagtgtttacccatctgaattagaggctccaatgggaaaaggattcgtgccagtgagggctatggagatggtacgctcagaaagccaccaagctcatgtccgagtggtgtcttttcaggtggacagtgttgctgagggggcgcaggaaggaatgttctgaggagcgccctaattgttcagagcagcccctgaagccgtcaagccagagtgtgcctgggcagccttgggccccgcgccttagatcacacagccctg

SEQ ID NO: 508709 - DNA, 274 bp, Homo sapiens
acccattaaagtgtgagaataggtgagatcgtccggggggagacctctacatcactacgctggagcggataacactgcgtgggggagggtgcgtcggagtctgcgagagcgccagttatcctgagggaaacttcggagggaaccagatagtagatggttcgataagtctttcgcccctatacccaggtcggacgaccgattggcacgtcgaggactcgctacggacctccaccaggagttgcctctggcttcgcccggggcacacatgatggag

SEQ ID NO: 508710 - DNA, 199 bp, Homo sapiens
aaaaaattcccccgggggacctttaacccccggggccgttttcccctttgccctttttaaaagacccccccggggttgggggggggggccggcccccccccccgggggaaaaatttagttttgccccgttcgggtttccgaaaatgggggttttttcttttggccgggggttttttttttttaaagctccccccgccca

SEQ ID NO: 508711 - DNA, 193 bp, Homo sapiens
gtaaatcaacttatagagaataaagtctcttcaactttgtactgttctctatccaggatgatgagtcaacaggtttcactaataaatgtcatgctgtagcatgtgtaagatttgtaaatgatgaaattcaaagaaaactttttctatggctaggagcctgccagaacaaaggccaatatataatgttgtgaca

SEQ ID NO: 508712 - DNA, 160 bp, Homo sapiens
aggatcccctctctccacactgggagataatatattaatttaatgatcattatatatgtgggggttaatatgtagttttgctgtccctttaaagtctttacatgtaatgtagctgaataatcgttatttttcttttgcatcttaagtcttagaaattaag

SEQ ID NO: 508713 - DNA, 903 bp, Homo sapiens
acgccgtgtgcagctggggtgggcccgtgagtgccctggtggccctgggatggggaaccgctggtggcttccgctggaggtttctggcagtggcattctggtggcctggggtctgcgtgcctgtggactgtgtggccggggccgaggccgcggagctctgctggaggcaaggccgaggataaggagtggattgcccgtcaccaagttgggccgcttggtcgaaaggacattgaagatcaagtcccatggaggagatctaatcgtcttctccattgcccattaagggaatcgagagatcaattgcatttcttcctgggggccttctctcaaggattgagggtattggacagattatgccatgtgcaagaaggcagaccctgtgccggccagctgcaccatggttcaatgtgcatattgtctgctatcgagggactacaagtgcgccactgtcggtctggggtgtataacgtgctccatacggacgcgttggccactcgtggccaattccgtgtgaggcccatcatccttgtgccaaagctcttccattcgtaccccagttgctgcatgagggcatactggcggaggaaacaacgatcgggcaaatgccccctcacgtgtccctttgcaacggttgacatgcgcctgtctgcggactcatgatgcttgggtactcccttcattcccttgcacccatggggggccactgtgcattcggtcttccgcaaccttttgcccttaagcaacagccttggttccacttgctcgcgctgggttattccgactgaacctggttactaccttcaggccccggggcgcttagcacttggccgaccccttgggcggcaaactttcgggccattgggccccagctatttgcattgcccattttctaaaggaccctta

SEQ ID NO: 508714 - DNA, 248 bp, Homo sapiens
  misc_feature (38)..(39): n is a, c, g, or t
  misc_feature (216)..(216): n is a, c, g, or t
aagtgatactcctgccccaatctcccaggtagctgggnntacaggtgcacaccaccacagctggctgatttttaaattttctgtagagacaggggtctcgctatgttgctcaagctggtctcgaactcctggtctcaagtgatctctagcctcagcctcccaaagtgctgggactacaggcatgagccaccatgcctgaccttttatatgattctnatgaggattaaatgagtgaacatttatataaa

SEQ ID NO: 508715 - DNA, 488 bp, Homo sapiens
  misc_feature (77)..(77): n is a, c, g, or t
  misc_feature (446)..(447): n is a, c, g, or t
ctgagacaacaagaacaatccctcctcttcctcctcctcctcagcctactcagtgtgaagacgatgacgatgaagantttcatgatgatccacttctatttaataaatagtaaatatattttctcttccttatgattttcttagagtttcttttctctagcttactttgtgtgacaatgtagtatataatacatataacatacgaaatacgtgtttttgtttttgtttttgttttttgagatggagtttcgctcttgttgcctaggctggagtgcaatggtatgatctcagctcattgcaacctccgcctcctgagttcaagcgattctcctgcctcagcctcccaagtagctgggattacaggtgcccgccaccacacccagcaaattttttgtatttttattagagatgaggttgagaccttgtctagaaaagaaaagaaaaannaagagggggaaggaggtgaggggagggagacgagggaaggg

SEQ ID NO: 508716 - DNA, 304 bp, Homo sapiens
gagccattgaagggtatgcttccaaggatcagagatagaacttctggcactgatctataggacactggtgtcatctgcatataaaaaaagagaaatgtgcatgttgtccctcatcttttccagtgaaagagtgctgagctgctctaatcctatgtgtggggagggaggagtgcctgtgtagatggatgcaaggacatacaatgtatagccgatgtcggctctccttgtcttccatcccgctcgtgttatatcgaagagcacaatggaggagaatgtagagccgagagacagggtagagcccgag

SEQ ID NO: 508717 - DNA, 93 bp, Homo sapiens
ggtcggtctctgcgttcaacacgttgtggacggaacagatccggggactctgctgccacccttccgaccgccctccgatttccctctcgcggc

SEQ ID NO: 508718 - DNA, 316 bp, Homo sapiens
  misc_feature (34)..(34): n is a, c, g, or t
  misc_feature (44)..(44): n is a, c, g, or t
  misc_feature (92)..(92): n is a, c, g, or t
  misc_feature (183)..(183): n is a, c, g, or t
  misc_feature (297)..(297): n is a, c, g, or t
agttacaaaatagacatttttaaagtttttcaantccttgttantctttaaagctctaaattttaaaaatttcatttggccaggcaacttgngtacgcctgtagtcccagcactttgggaggctgaggcagaaggatcactggaggccaggagtttgggaccagcctggcaacatggtgagantccatctctacaaaatcaggaaaaaaattagctgggcatggtgatgcatgcgtgtagtcccagcttgggcccagggagtcaaaggctgtagtgagctatgaatgtgtcactggntccaccttaggcagtagag

SEQ ID NO: 508719 - DNA, 635 bp, Homo sapiens
agcggttcaagactagcctggccaacatggtgacatggtaaaaccctgtctctactaaaaatacaaaagttagccagggctgggcacagtagctcatgcctgtaattctagcactttgagaggctgaggtgggtgaaccacttgaggtcaggagtttgagaccagcctggccaacatggtgaaaccccacctctactaaaaatacaaaaattagtcaggtgtggtggtgcatgcctgtagtcccagctatttgggaggctgaggcaggggaattacttgaacccaggaggtggaggttacagtgagccaagatcgagccactgcaccccagcctgggctacggagcgagactccatctcaaaaaaaaaaaaaaaaagttagccaagcgtggtggcacacaccggtaatcccagctattcaggaggctgaggcacaaaaaagggtttgaacccaggaggtgaaggttgcagtgagccaagatcgtaccactggcactccttgcccgggcaacagagcgagatgtctcaaaaataaataattaagataaataaaccggccaatagcttctatgacccaaagatgagatgcccctgggcacctctaaaatctcctacaagctgatgtacctatgagaa

SEQ ID NO: 508720 - DNA, 410 bp, Homo sapiens
  misc_feature (45)..(45): n is a, c, g, or t
  misc_feature (63)..(63): n is a, c, g, or t
  misc_feature (164)..(164): n is a, c, g, or t
  misc_feature (192)..(192): n is a, c, g, or t
  misc_feature (201)..(201): n is a, c, g, or t
  misc_feature (214)..(214): n is a, c, g, or t
  misc_feature (239)..(239): n is a, c, g, or t
  misc_feature (261)..(261): n is a, c, g, or t
  misc_feature (271)..(271): n is a, c, g, or t
  misc_feature (324)..(324): n is a, c, g, or t
  misc_feature (371)..(371): n is a, c, g, or t
  misc_feature (380)..(380): n is a, c, g, or t
  misc_feature (385)..(385): n is a, c, g, or t
  misc_feature (393)..(393): n is a, c, g, or t
  misc_feature (395)..(396): n is a, c, g, or t
  misc_feature (407)..(407): n is a, c, g, or t
tctccccgcccgtgtcccgcccgacccgcgcccggattgctggcnttgcgctgcggctcccgntggctcggctgctctccgtcccgcgctccgtgcctgctgcgcctccccgcggcccggcctgcagcaagggctccggcgacccgtcctcttcatcctcctcngggaacccgctcgtgtacctggacgtgnacgccaacnggaagccgctcgncgcgtggtgctggagctgaaggcanatgtcgtcccaaatacaagctnagaacttcanaagccctgtgcactggtgagaaagggcttcggctacaaaaggctccaccttcnacagggtgatcccttccttcatgtgccaggcgggcgacttcaacaancacaatggnacagnccgtgaantnnatctacggaanccg

SEQ ID NO: 508721 - DNA, 347 bp, Homo sapiens
gctgtttgagagctggaggaaacagacaggaatacagcatgctcttgaggaattcaagagtgagctggtgccagtttctgtggctcacgtcagtaatcccaacactttggaaggccaaggtaggaggatcacttgtgtctaggagttcaagaccagcctgggcaacatagggagaccccatcttcacaaaaaaaaacaaaaaattagccaggcctgggggtgtgcacctgcagtcccagttaggaggctgaagcgggaggatagcttaagcccgggaggtcgaggttgcagtgagccatgatcacgccactgcactcaacccaggcaacagagcgagactccatctc

SEQ ID NO: 508722 - DNA, 297 bp, Homo sapiens
  misc_feature (105)..(105): n is a, c, g, or t
  misc_feature (118)..(119): n is a, c, g, or t
cattatcctcctgcttgcactatagcaacagccttcataggctatgtcccccgtgaggccaaatataatatgaggggccacagtatttacaaacttactatccgncgtcccatacacnngggcccgagactctagttcaatgaatctgaggaggctactcagtagacagtcccaccctcacacgattctttacctttcacttcatcttgcccttcattattgcagccctagcagcactccacctcctatttttgcacgaaacgggatcaaacaaccccctaggaatcacctcccatt

SEQ ID NO: 508723 - DNA, 469 bp, Homo sapiens
gccgtccctccccagccttccccgtgagcggacgcggagcgcctctgtctcgcttttgcttatttttcccccctttcccctttcttttttttggtctttgttgttgtttcatccccgcatcgcccgccacatgatcaccaattgttcacccttagaaagggagaatatcccagagtgaagggggaaggaggacgaacactcaaacaaaacgcgtgggaagagataaaattagaccgtactaagggcaaacaagtggaacaggaatgtgcgacaacaatacccacaaggagcaaacaccaataagagtacacccaaagagagaaaacaagtgtagaaaaagaacatagaaacaaaaccggtgtaacagaggtgacaacgcgagcaacgaagcgtccccacgtcgcccagacacaaaacaggagcacaacaaagaaacacacacttagcaagaaaaaaataacagccaaga

SEQ ID NO: 508724 - DNA, 176 bp, Homo sapiens
aagccaagttacacatacccttctactctcttactatccaacaagtatatcgtcatccttccctcgtctttcccactcgggatttactgtaaaccccctttctacctccaccactgaaaacactactgccacaggcgagcttgcctgctcactctaccgcagactaaccatcctca

SEQ ID NO: 508725 - DNA, 181 bp, Homo sapiens
tgtagttgtccgggttatcaggcattggtaggagatcggcgggttccagtgctgcttcgataggaaataagcgggcttgctaaggttaggaaaataagcaaccaccccaaactagtatgctcttttgaaaggagcatgagaactcaaatcaagattacgaactacctctcaagattgaact

SEQ ID NO: 508726 - DNA, 1019 bp, Homo sapiens
atagaaatacacatggtggtcaggcatggtggctcatgcctatggtcccagcactttgggaggctgaggtgggaggattgcttgagcccaggagtttgagaccagcctgggcaacatggcaagacctctgactctataaaaaaatttttttttttttttttttttggaaaaagcgttcttcacattcttctgtgtcacccagggtagagtaggtgtgactctggggcgttattaacaacattccgccctcccgggtttcaaggagatttctccgtgccttagcctcctaagctagcgtgggatttgtgggcacgttgccaccagtgccgtggacttattttgtggattttttaggttagaagacgagttttcaccatgggtttggccaggcgtggtctggaacttccgtgacctcaagtgatgtaagcctgccttcaaccctcccaagtggtgctgggacttacgggggttgagccaccgcgctgtggcccaaaattttggtttttcaactatcggcgtgggttccccatgtgatggggcccctgttgctctcacgctgttcgggcagggctgcgcggtgggcagccctcgttggaagccccgggagtttagaggctgacgtgagctgtgcttgggtcccagtgcccttgggccgtgggcatctgagcgatgacccgtgttgacaatcatggcacccaatgacaacaacctcccggcaggggtcttcgggggcagagcgcacccgacctcgcaggagggccacgcaaccctgggactgtgtgcgcccgagggccacgggaataggtcctttcaacgccagcgcagctgcgctccccgagaccaccgccgtggtgtgcggcacaaccagtgggaaggggccccacccacgccaagggatcggtacggaggcgccgacaccgcaccggaacggaagccaagacaggactacagtctagagaggtcaccgatagaagaacacagggcttagcacccacggagtaaataggaaaccgacacag

SEQ ID NO: 508727 - DNA, 740 bp, Homo sapiens
tggctagtgtgtcacccggcgccggacttcattgagcggctgctgacagtgcacggggagcccgtatgactgcactgcaggccctgaggcacccgtgggtggtgagcgtggctgcctcttcatccatgaagaagctgcaccgctccttatccacagaacctccttacacggtgcctcctcgcgctgcaagagcaccaaatctgcccagttccacgcgtccagccgctccacacgctccaataagtcacgccgtgtgcgggaacgggagctggggagctcaacctggctaccagcagcaatacaatggctgagccgcctggctgtgcacacatgcagcaggaaccagacctggcccacacactgtgtgtgccatctgggtcctgatgccctctctggagatagggctatgtggacccacagtacggtgaataatgtctggctccatccctttctctgtgccttcatcagcccctgttctcaccatgggcctgggccaggtgtgacagagtaccaggtagcacgatgggggctgtgactccccctgaactgggagcctggtctggcactgatatcccctcttggtgggcacgctgctctggtggagtcgggacagggagtaggacctggccttcagctgtctccccttgccctttgacttgtccccgtatcaaacgggaatctgcgtgctgggtggagtgttctgtggcctcaggaccctttgggaccgtacttcttggacc

SEQ ID NO: 508728 - DNA, 805 bp, Homo sapiens
  misc_feature (61)..(61): n is a, c, g, or t
  misc_feature (125)..(125): n is a, c, g, or t
  misc_feature (207)..(207): n is a, c, g, or t
aataccagaaaacaaaattcaaaaggtaggcaaaaaaaacaaaggaagctggatggaaaangcaaagtctcaagcgcgtggaccggggaagcagagccaagaataattaccatttcttccagagngagccaaccacagacaaggggaaggacaagcaagagccgacagcagaccggagcgggggccacgacagagcagcagacgacnacgacgacaacaaccaaccgacacagaacaccaacgcggaggcccaggagagcaagccggattgttatcatcttgacttcatttggggcctggatgcctctttggaggctttataataaaattatgaatctaatgaggaaatatcagttaaagctggacttgagctgtgtaccaccaagttaatgattatgtcattgtgaaaatgtgattgcttcaattcatagtaaacacttgttttttctttcccagggctattagtgtttgatatttcaagaaaatgataactttgatgatgcccagttcactctagtataaattagcaaacatactaccgattttttctttaataaaagctggaattaagaagccaatggctcagccataaaattgaactataaaagtcttttaaatatcaatgatgagaaaaaaggatattatatcctcactgtgtagaaatttaaaatattcgacttttgaccattatatcgaaaaattttttgatgtgttgtaattcgacaaatgggtctactatggggaaaccagcacttaactatagaaagaaatatagaacaaaagtatatagccagcccaaaataac

SEQ ID NO: 508729 - DNA, 339 bp, Homo sapiens
atgttatcctcctcctgctcagcctgcggcttcttattctcttcccgtgaaccttctctttccgtggtgtgtccttatataggtagggtctctgcaaactttttagcatacaactgggccatcttctcacaacagtttcacttcgcccaagacagcccggaactggggctggttattgcaggtgaggaaccagcggttggtattgggacacaggctggcggaaagaagggtctagaacctgcttatagagcccacaacagggtgcagacaatttgtgaatgtcaggccaatgtcactcgttcgcccaccataaaagtcctcgtcttcaagtcagcatcc

SEQ ID NO: 508730 - DNA, 872 bp, Homo sapiens
  misc_feature (80)..(81): n is a, c, g, or t
agcggaacaccctcaggacctggtatagacgcagaatctgtttcacacaacaactgctatttgaaggaaaaaaaaaaaannaagcaaatgatgcggggaacaacgcttcaatacccgagtactcccactcaagaagatgtttgctacggattgaaaacaatacacggtgagattgagttcaaaaacccggcccaaggcagggctcccaagactcttcgaataaaccaaaaagatacttccgaaacactctaagcctatacactggtgtgcccgccaggtcaaccttccttcaatttccaagagggcacactaggggactcggaaatccacgccatctcgtgtaagagcggaggcttccactaccaagaaagggaaacagggacggacgggcaccgtgccagcgccccggcccaaacgaaccagattggcacacaggggcaagagtcaggcccacccccaaacggaagcacgaggacccagcggaaggaactctcaaaagcggccacgtgaaccacgccctcggtctccgtggacaccaattggattgacaaagcgccaaactctacccccctgcgcataacagtcacgggactcacacaatcataatgccgggggcaacaccagccgggtgaactggggacacacgcgcggaaggctcacatggtgcccaggggaagggggggccccgggcacgccgactgggagtcacctccggacagaggcaccccagagggcgtcaggcacacaactgggcaagcgaaaaacagcggcacgacggaaaccatgccagagcaccagtacatcaaccgacaaacggtcatcccagaaggcggacacaagcgcgcacccagcacggacaaacaaacaacctc

SEQ ID NO: 508731 - DNA, 486 bp, Homo sapiens
  misc_feature (208)..(208): n is a, c, g, or t
tgtgtgggtagagggcacactgacatgactgggtcattgtcacggctgctgaggacaggactgactcgaggcccattatcacatctaccccgacaggttagcacaggtacattcccaggtatagacttggacttctggacaactcatcttaggcgctggaatccacttggaaggacatcacaagttagagtggtcagcgagagtcatntaccaagcagcgggcattacgccgttcggtcatgatcttagagcagatctcatgcaggctggtggcgatgttcttggcaggtgcctcacagcgaaacacgtggcacttgagcatctgggtcagcttatcacgagctacgtaggcaaagtcccttccactgtcccgcccgacgccccacacgcggatgctgatgatgggttgggcgtgcagcagtgcctggctctgtggctccactagctttagtgtctcatcctccagctgcagtagcagatccgttc

SEQ ID NO: 508732 - DNA, 744 bp, Homo sapiens
ggcagcacgggggctccgcagaggcgccacgcaccagtgtccataagcatccttgcttcctcctgtgaaaccgcggcgccaggtgtgagctgcgcgctccagcgtcatacgccaccgacccgtccgggcccgctgcacatcgatttcattcatttcgttccacaaatcgccgctccactcattagctgtggaaccttggggaacgttacctaatctttttccgaagcctcggttatcctccatatctgttctttctgtaaagataaagatagataggctgggcgcggtggaacacgcccgtaatcccaacacttatgggaggctgcggccaagaggttcgctataagccaagggagtaacgaggccagcctgggcaaacaaagcaagacctcatctactacaaaaaaatgcaaaaaactaaccgggcgtggaggcatgcggacgggaagataacttaacgcccgagaagtcggggcacgcacgagagatcgtagatcacgaccaatgcacaacaccctgagcgacagggcaagaactgcctacaaaactactactaggctggcgagcggtggatcacgcctgtaatccccagcacttgggaaggccgaggtgggcggatcacgaggtcagagatcgagaccatctggcaacatggtgaaccccggtacactaaaatcagatagctgcgtgtgcgggcgcctgttccgtgtgggactctgcagcgaatactgaccgagcagagtg

SEQ ID NO: 508733 - DNA, 321 bp, Homo sapiens
tgtttaaggatacttcctggggtggcccccatggcaccatcttgccgcaggtggctgggtctgctgtcactgagtagacctggcctgcattttctctacatgtgcatgtctgtgttacacgccctcgccaccgccagcctttagcagggggcacgtctcccaggagcagtgctgatgtggtccccttggtggggtggccagggcacaaagaccggctgccgtgtcatgctgccctctggcgtgcccagcctgtgtgggctttggcccaggcactgtcctgccagttgttggctccagggtgtacaacccttctgctggtgc

SEQ ID NO: 508734 - DNA, 442 bp, Homo sapiens
tgcagagaggagcacctctttggtctaacttacttcccaccacgatcaccttttccttcagaatgtctatgagcagctttcggtggctgtccttctggtagagggttgcgtgcaaaaggatcgcacctccgatgatatggttgatgaatctgtccacagagaagagtatttctcggagctctcgtcggttctctacagtgttttccaccctgatcctccgcagtcggtcccccatggtccccacccattgatctgcagtcagcatcccctttccattggcaacaacgctctgggcaatttatgagagccccttaatctgcccttgggtcacagcttgaaatcgttgggccatggttacaggtatttgcccaaaaacctctctctctagatgtccaaggctgtgtgatagtcaacgctctaatctcgtgcagaattcgtacac

SEQ ID NO: 508735 - DNA, 113 bp, Homo sapiens
acgagatttaagcttacagtgagactgaatgataatcggtggcacagatgtgcattaagttccttccgatgttcaggatgctgtacttagtgctgattgcggtaaaggagtga

SEQ ID NO: 508736 - DNA, 634 bp, Homo sapiens
ggccgtgttgccgggggcgtcttccctgcggtgcttttttaggggggttcctcccccatatggcctggccaggttccccgcccgccttcttttgtgtgaccgtgttttgaacggggcgacactgtgtcgaagagaccccaaggggccgtggctccaggttctgtcaagacgggttgggttgcgcccccgttgtcgcgcgcgtcgcggtgagacatttcctggtgcgcccactagagcccgcgcactgctccatttccaccactctgtgctatatctatcattctgcctcctgcaccgaggaaaggcaaaaaaagccgttcacacacgttgggtgcgagagtcagagaaaacaatggggagggtcaaaaaaaatgtgtggtggtgggacgcaccaccccgtgataatttcttagtcagggttaacacacccaccacgtcgcgacgcacacaggggtactcctcccgccgagctgttaatcccctggattattatctactggttctccccattttttattcttttgtctctcacacatgcgatctttgtatatctgtattggagaatcccccatatttcttctttatatatacgcccaaacataaaaagttttcaaacccaccaaaatcaaaacaa

SEQ ID NO: 508737 - DNA, 508 bp, Homo sapiens
tgcatagcaattaaaggtgtgctattggtcagtagccattttttggcagtgattggaagaccaaagtggttttacagctgtgttaccgttaaaggtttcttttttttatgtattaaatcaatttatcactgtttaaagcttggaatatctggcaatcttggccaaggtacttttttatttaaaaaaaaacataacttggtaaatattacccgggtaatattatatatagcttaattaaaaccattttaagctcaaaagaagaaaaaagaagaaaaagaaaaaaaaaaagtgtgtgtggggcgcggcttgggagcccttgggagagagagtttttagagaagacacaattgcgggtgtgggcgagcgcgggggccccccacaaggagaggcaaaggcgagaacagcagtggggccaaagagcggggtgtacccgagggagaacacgcgggggcacaaggacacaagagggggcgggggaatttcaccacccaataaaaaaaagaggccg

SEQ ID NO: 508738 - DNA, 263 bp, Homo sapiens
gctaacccacgcatgatgagggaactgggaacggaacttggaaagacctagagaagagaagctgataaaaggagtcgcagctctgtagatgctccaattctgcatccagtccatctaattgattaaaacacggcagagtgcatgtagagttccccgttataggggagggcctcaggtttcaggaatatactgttagagcatcacgggtgaaattgtagcccccaggagtcccaggtaccacggcgtgaataagctacatcatg

SEQ ID NO: 508739 - DNA, 105 bp, Homo sapiens
tagactttcttcctttgttcataagctagtatctggttagtagatgcctaggaatagctagcagttattttcgctaccccgcctgagaatgaaattatctatgta

SEQ ID NO: 508740 - DNA, 1426 bp, Homo sapiens
gcctttccgtctggctggtcagccatcaggtaagccaagatggcgtgcatacaagtacatccaggacgctactggataaagaagcagtctgattgtcatgcgcattttcttctagagtggtccagcatggcgtggcaagtacgcgccagactctctgcattcgtccatcatggagctccccgtgctcgcacctcgtgacctgaaatagtacgtcgcgcctgacctggtgtctcaccacagggcccagaggtcacacgggttatcgattaatacagtatgcgatgtctgtggtttctggccgttggtagtgcactgaaatagagctggctccaagtgacctacggtggttgactagcttatcgggcggaggcctgtcccagtcagtggttggttagagcacaagttaagagtattagctcccgtaaatttcccatacaggctactcagattggacacgtagtggatgcccgtagccttggtacggcctctacatgttgggggagcttcttgggatgaagcttccttgaaaattctgtttgaacttcgcgagtttgcgttggagaagaattatcgctactatcaccaatgaatgtataaaccaggaggggtttgactacccattcactattgtaatttcccctatttccacactttatagacggcctcacttccacggtaaaaagggcaatagttcccatagggaacgacggccccattgttagcggtaatccaacgccgatataaatcctatgttaacaaacgcaaatgcctactaagcgtggcatgaatggcgcggtagggtgcgtttggaacaacttttttgccgttcgcccctcggagaaagagggaacgctccagggttggcgcccttattggcgggacaacagtgggccccaaccgaaaggcttttctcgacccgagaaaggttcaattggaggggttggcggcttaccttcctggacccgaggtgactaaggtctgttgttgcccacatgagaaaagcgtctgcccaatatagtcttccttccccaagcgacgtacacatctcggatgttaacgcaaggcttgggagttttattaacacgtttcaacaagttttgttgggagcaccaaggttttcgcattacggtttggaaatttaaccaatcggacactattttgtacggggtaccatgggaacgcgagcgaaacacggccatcacagctaaacacatgagcaggacaaacaccacaaacggtgcaatttgttctggcgcgactggcgtgtcagcggaccccactcccggagaagggacgcttttttccaacacaagacctgtgtaccagtgtgtgtgcggcccagcagacgccccctattaagataacaagtccctgaccacgcttgtggtcccacttggccgaagtatctcgtgagagagaggtgtcc

SEQ ID NO: 508741 - DNA, 103 bp, Homo sapiens
  misc_feature (73)..(73): n is a, c, g, or t
ccggaaacagtagatgctattgaggagtatcctgaggcatgggggtcagggttgaggtcttggtgagtgtgtnagtggggttagcgatggaggtaggatggtg

SEQ ID NO: 508742 - DNA, 410 bp, Homo sapiens
  misc_feature (114)..(114): n is a, c, g, or t
tgctgtgtgtattcaagtcgcagagttgaacattccctttggtagagccgtttggaaacacacttttggtagaatctgcaaggggagatttggactgctttgaagcctatgcangtagaggaaatcactgcccataagaactagacagtagcattctcaggaaacactttctgacgattgagttcaactcacagagctgaacattcctttggatggagcagtttcgaaacccacttttcgtaggatctgcaagtggatatttggacttctctaaggatttcgttggaaacgggataaacctcacctaactaaacagaagcattgccaggaaattcttcgtgatgttggcattcaacttagagagttgaaccgtcccttgtgagttcaggttgaaactttgtcgacgcggc

SEQ ID NO: 508743 - DNA, 127 bp, Homo sapiens
ccaccaccatcttggcaagcccacctgcaccagctgggagaacgctgccctggtattttaggtcagggtcaggtagaccccagagagaagggggagaaagaaaaatctttgttttgcccattctcct

SEQ ID NO: 508744 - DNA, 179 bp, Homo sapiens
  misc_feature (15)..(15): n is a, c, g, or t
agggttaagacccancctataaaatgtaaaaaaaaagttttagagttctgttttccacccttgctagtggtttagttaactttagctgctttaaatttgaaaagcttttatttagatcttgccccctttccaggccattcttaggatgtatgtagtaaaaaaagctttctttaaagcca

SEQ ID NO: 508745 - DNA, 172 bp, Homo sapiens
gcgcattagctgcgttcattcagaccgctgacgacctggctatgcagggctcaatcgcagtctcgaccgaccaattttatgtgcggaaggggcgattttttccagcaatcgcaaggtatctcgttagcgtcgacgatgtcagtgtgcgatcgtctagacgcttcaagccata

SEQ ID NO: 508746 - DNA, 935 bp, Homo sapiens
catcttcctgcggcgagcagagcctgggtggctctgagtctccaggcccagccccttgctcaccagtgactttctagcatcccccgcctccagccctgtgcctgactggacctacccctgcagatggatgcctggatgatgcttgtgaatgacaactataccaggtgatcattggcctgatggtgtggccaatgaatgtgttctgtcttgtgtgccaaatggaggtgatgcttgggtgaatcttgacgtagacgtgtgcattctcctgagtgtgcactggcatgcgacctcagatgcgtgcttttgcgtgcatgtgatgcgtcctggtgatgctgagatggttgcggcatttagacgcatgttggcgtgtgaacttggcttcacaatgtcacccccttaagaaaacctcacaaccttgcccccttatgtcgtgagtgacgtgacgtgcctaatcgaggacgcctttccagccattgttccaccacagtggagactagcccaccatggggcacactcattgtagccctcagaggcaaatgtcgccgtataatagcagtcgagtgatcgctccaatagaccaatcggctattgccacataagtgcgcctagcgagctccgccattatctacacgatatggggccacatccccgattttcgaacgttggaggcgcatttggcgtttgccttaccctttttattgagcgctcaaacacaccttccttggaaggaaaaacacacatttgcgagatttgagcactggagaagtcattccccgagaatcactagcttagcttacaccagcccattgctcgcagttggcgtattgaacgcatgggtggcgtcttagtgcttggtgggacctcgcacagcgattggtgactcactatggatccaacccaccccgccacaaggaccccaccgattaggaacacag

SEQ ID NO: 508747 - DNA, 394 bp, Homo sapiens
atgagctggaccttcaggctgattgcaggctgagctgtttgggttccctgcatacgactgcttgccagtggctcaagtcaacatgaacagagggatgagccaaatcaacgatacaaagctgtgcttggccttctttgtccttataactcattagggctttttgaataaactctgcacctgagcaccaggtttttatgccattacagtgattgttctggacctgtacaggtgccggccgccatctgctgcccataccgcccaagtttggtcatcgatttcgtcttgatagcccaattcatttaaaatacttaaagcatcatgatgtgactcaaataatttagcgagacttaaatcataccctgcaatttgagcaaacaatcgccatcgctgatag

SEQ ID NO: 508748 - DNA, 135 bp, Homo sapiens
  misc_feature (4)..(4): n is a, c, g, or t
actngatcaccgtgacgccctcgaagtcaccgcactgcattccttggccggacgagggagcgggcgtctcatgacgaggcccccactggctcaaccccatcattcggtgtcgatggcggccatggtcggtggggg

SEQ ID NO: 508749 - DNA, 485 bp, Homo sapiens
ctttgggcagaagaaataatggcctggggatgggaggacacacatttctgctgcacaaagaggggagtcctgatgtgaggaggctgggatctgggctcaggctgaccagcagagaagagttcacctgttggccagccacctccacataacaccccctgttctagttcctctagtggaaccagaacccactggccgtgtcggaggctgattatcaccgtgatgcaggcacaacagatctgaggcctccactcactgagacaatagacccaagaacaacagctctgaggcctccactcactgagacaatagacccaagcacaacagctctgaggcctccactcactgagacaatagacccaaaaacaacagctctgaggcctccactcactgagacaacagacccaagaacaacagctctgaggcctccactcactgagacaatagacccaagcacaacagctctgaggcctccactcactgagaca

SEQ ID NO: 508750 - DNA, 508 bp, Homo sapiens
aaactcaatatggagcatgtaaatggtctttttcatgaagcatcgaccgggggtgtacgtgttccgataaaacttcatcccattattgagtccgtaagacagggtgctctccagggagccccgcatcagttagcagcagagagccaccagtaagaggatgacgttaaagaagacgcagacagccaggcccacataaggacagtggatgaaggaagattcttcttcacctgcttgtacacgcttgccagcacatctgttggaagctacttcttcaggatcccagcttatacagaagggcagctgcaacaccagcctcgtgggacctcgtaggacggagcagcttcccattcacggctgcccaatgttgggttacctggactgcaaaatagactgggaagaaaccccagaggaagtgacatttgagttatacaaaactttgtttggccggtgcacacggacccacccaaactgcggaatctgatggaacagagcccaggaagcttggaag

SEQ ID NO: 508751 - DNA, 1060 bp, Homo sapiens
  misc_feature (145)..(145): n is a, c, g, or t
ccatttgatgcttgaatgcttaggtgggctgactctatgctgctgcgtatccacagctatagctcgtgatggtgttcagtgggagagcaagcgtcgcggcaccgagtctccacgaagtcatgcggatcagtaagtgggagctcanggagtgcctgaggagctgcggtgcgacgtgagccactgtcggaggaatgggcactggcgtgcctgttccactaccgccgcggcgcgttggtgtgacgcctgcgtcagccttcgaaggcaaactcgcacggcacgcagtcgtctccaagcagcagctaggtcctcactctagtctccacgcacggccctagtccaactagagaccgtgttgacctacgttacgagatgaccgtggtacgtttcttgcatggaaaggcttccgcaagacgcgttcacgtgcgcacgtttcaagtgcacgctgtccactcacacgagggatgggtgcgagagttgtagagcgccatggtagggctagaggctgcaaatactgggggtgcgtcgcttcctagcaccagaagaggtgcgcacaattccgtgggatggggaaaagaatcggatgaagagctcgacggaaaacgatagatagtgaacctcctcctggtcctgacttggatcaccattgaagagactaagccatgagtgctttggtgcgcatcacccacgtgcgcaaccagattaatacgagctaactatgccagatcagtgatgggctgtgacccagaatcaggtgcaacggaggtggtgagacgaggattcggctgtaaagttactgagcctcgtgcttcaaggaagaggaggagcgacgcacgtgcaccgtgtagtggatggggaatggatgcggcgaaggagtcgtacgtcagaatgagccattggggtgaggtgagggcgcgtcaaacgtgagttggatgggcctgaattgttgcccctaaatggtcttcgccgtaaggcccatgcgagggggtgcctgggccgtcattgaccccacttttgttcccctcatgggtagggtccgaggtccggggggccgggtatcggg

SEQ ID NO: 508752 - DNA, 131 bp, Homo sapiens
cgcgtacctcagccgccgctggccttgaccgaaaaccatgacaagaacagggagtgaggggctatgggactagttaggcccttgggtcgcgatgcccaagggtcccccttgacgtacgaacacccctgagg

SEQ ID NO: 508753 - DNA, 116 bp, Homo sapiens
aggctccatgttggcagtgaagtcaggttcggggtgcatgggctgtggtggtggtgatctggttgctcccagtgtttgaacatcaagaagactccaggttaacatggttgtcttgg

SEQ ID NO: 508754 - DNA, 417 bp, Homo sapiens
acttagccgatcccttttgtgctggggtgatggctcgcgtctgttatctcagcactttgggaggcaaggcgggcggatggcctgatgtcaggagttgagaccagcctgaccaatgtggtgaaaccctgtctgtactaaaaatacaaaattagccagatgtggtggtgtatgcctgcaattccagctacttgggaggctgaggcacgagaatcgcttgaacccgggaggcggagcgtgcagtgagccgagattgcgtcactgtactccagcctgtgcaacaagagcaaaactctgtctccaaaaacacactaaaacatggttcctgccctcaaggacgttacagcatacagagggatataataaaaacagacagatacggaatcacgaagggcattggtgccagcacaagaaccaacg

SEQ ID NO: 508755 - DNA, 355 bp, Homo sapiens
  misc_feature (1)..(1): n is a, c, g, or t
ngaatgctgggcttcatacttgggtaatgagatgatctgtacagcaaagcaccttggtacatgttcacctatgtaccaaataaaaagaatgattaagactgtggtatttgatagcaccacagggagcctatagtcaccacgcaatttaatggtatattttaatatgcctaaaagagtataatggattgtttgtaccacaaataaatgcttaagggaatgcacaccccatatcacattatgtgattatcacccatgcgcatgcatatatcaacctatctcagtgtaccccatatatatacacacctatatacccacaactcttaatatataatatgttttatataaatctctcgtg

SEQ ID NO: 508756 - DNA, 411 bp, Homo sapiens
  misc_feature (10)..(10): n is a, c, g, or t
  misc_feature (71)..(71): n is a, c, g, or t
  misc_feature (99)..(100): n is a, c, g, or t
  misc_feature (103)..(104): n is a, c, g, or t
  misc_feature (106)..(107): n is a, c, g, or t
  misc_feature (109)..(109): n is a, c, g, or t
  misc_feature (126)..(126): n is a, c, g, or t
  misc_feature (139)..(140): n is a, c, g, or t
  misc_feature (158)..(158): n is a, c, g, or t
  misc_feature (161)..(161): n is a, c, g, or t
  misc_feature (235)..(235): n is a, c, g, or t
  misc_feature (289)..(289): n is a, c, g, or t
  misc_feature (295)..(295): n is a, c, g, or t
  misc_feature (323)..(323): n is a, c, g, or t
  misc_feature (333)..(333): n is a, c, g, or t
  misc_feature (337)..(337): n is a, c, g, or t
  misc_feature (339)..(339): n is a, c, g, or t
  misc_feature (406)..(406): n is a, c, g, or t
attttgccanggccacatattattcaaaaagttagttgaataatttcacaaatttttctctagaaaaatanttttaattcatcagaattaaaaaatagnnagnngnntncttttaccatttggagncaaaggggggggnngggggcgcgggggggggnggngtgttgatggaagtagcatttctctcttcaaaataaaaacctaaagtgaatataataaagttatattgtgctgnggggattgtctttttatgaattaatactgactttttaaagacagtgttctgggncatggngaaacaatggggggggaatggggggggnatgggggggnatgngncttttcctttttccaataattctcctctctcccacaatggcagccaattcatatttctggggggggntgcct

SEQ ID NO: 508757 - DNA, 777 bp, Homo sapiens
acaatctagctcctcggggacccccaggctgggcatttccgcagaggtggggatggctcctctatcagaagcaagggctccctcagcacagagaccacatcccttcccttttcatccctcccacacaggattggccaagggtatcagagacaggaaggaggtgattgatgatacacatgtcttattattctctttataagaccatggagacctgtgaggatggcaacgagtctatgtctatcttctatcaagagttttgcagaacgagtgtatgcgaatggacaagaccaatgcactcacacaacaacaagcatgaccacaggagcatgagagacatatcacatgaacaaaaggcatatgatgtgaatctgatgagacaaaaggacaggtgcatggaagactccaacaatgtgcaaacgcaacacatacacaacagtatcagacggacttccccactataaccaaatgtccccgatagattcacagtaacaatgggagaacacattggagagaattagttaagaagcatccccaagcaatgcgaacatatatcagtaggaaaccccagtgtaagataatgacaccccaattattcatccattatctacgccaaatgaatccacacccatattaaccaatacactttcacacaacaacgatatacttatgggacatatgattatacacaattacgaggaatacaatcaaaggcaaacatatatggaaattcaacctgaaaagagatggagaaaaaaaatacacataaaaagattacgg

SEQ ID NO: 508758 - DNA, 519 bp, Homo sapiens
agagtgaaggcttacccacagtcactacatttataaggtgactctccagtgtgaatacactggtgtgtaaagagatatagatctgtcacgtcaaagcctataacacatacagaacacctactgggtttctctcctgtgtgaatctgctgatgtacgtggagctgtgatttcttagtgaaggattgcccacaactactgcattcatagggtttctctccagtatgaattctctcatgtgtaatacaatgggatttgtggaagaaggccttaccacattcagtgcaaacatatggattatcccctctattaattctctggtgcatacttaatgttgacttctgaatgaatgctttcccacattcactgcattcataatgtctctctccagtatgacacttctgatgtatcctgagccgagacttccaggtaaatgattttccacagtcgctgcatttataaggtttctctccagtatgaattttttggtgctatatgagatttgacctgtcagataaggcc

SEQ ID NO: 508759 - DNA, 1117 bp, Homo sapiens
gagcggagtgaggtgcgacgtgcagatgctggctgctggagcgctgagctggaccagctggcggcgcgagtgccagtgagctgggcgcgcaggcggcccggcgcggcgacgtggcgaggaggccgagacacagctgcaggcggcgctgtcaaaaacgcctggctggcggaggagaatgggcggctgcgggccaagaccgactgggtgcggaaggtggaggctgagaatagcgaagtgcgcggcacctgggccgcgcgtgtcaatgagcgcgatgcctccgtgcttgatctgccgaacatgctgctgcagcagtgctggacgcgcgggcaggacagtgcagcagcagctgcaaggcggacccgcagaaggcccctgtgtgaccctccatcctttcctggaaggggggatacaggcgctccagtgtctggcctggtcacccctccttgaacagccctgggagaccaggtcaaatgccggagtcccaaggttaaacgggtagcagaagggcccaaggttccacggcacgggcttgaagaactacgcaggtgtccacagctccaaacagaggacatacatggagaacactcgggacagccttcccctcgagggaagaagcgccttgtttggcctttggggagaagtcaagccaagtggtcccccccagagttttcaggacgcaccaaggtgccctgacaggccagagcttcgtgttccaacagaaagacgcaatgctcccatgtcgaaactcgtccagtctgacgcgggtcgacatgtgggtgcaactggtgcacagggtccatccccacttaaatccttgtgaccacgggggaccagcaagcgcacgatcgacgggttgggacttcgaccctggtggagtcccttgcaccagagtcagtgtgtccccttgtgagcccttgggaaaatcgggggatagcacagcgacgaggtcacgttaggcataggcccccaaacgacaccaagagaatacattatcatggggacacggactgtcacatcaggacccccacttttggagaggaggaccaatgtgatgctacgcgaggagaggagacagatcagactacatacaaagctcggtgagtcatacaataaatca

SEQ ID NO: 508760 - DNA, 964 bp, Homo sapiens
tgttgctggtcgtaggtctgtcctgtttatctgtgtcttctgctcgcgtcgtggccgcagttgtaggctcttctcccccgggttgttctgtgcgtccattgtccgtcgggacggccgctcctgggttccgtgccgggtgttttctggcactctttggcgttttcccgtcgacgccggtccgcccgatttttgtgcgaagatctcgcgcaatcttcctgtgtcgaccccttaaccaggttccctgctcggtcccgaacaattacccggggctcctgcccctcccgcccggcggggcagcctccttttgggtggccctcccccacagagtattcttccgattagcgcccccgggtgagatccgctttcccccttttcccgcggggggactttgtcgccacaaccagtggtccgccggaattattcggtgcccgccccccgcatttctttcccggccccgttcactcccccccgctgccgattattatgtgaacagcggtggcattctggggcccccgcgcccgattcttctcggtggcgtgtcgtgcccggtgtattcacaacaccgacaactgtgttttgtggcccaccaattgacttcccccgggccctctggaaccacacactggggggcccccagagggtgacagtaccaccggtctttcccacatggagagggtgggagaccaaccccccagactgcaaagaaggagactcccccagctttctagtaagaagaacaaggttcccatacaacaccggcgtgttgagaatcaaaggttctcacccaagacgcccacactcggcccgcaatgattctcgcccgtgaagccacacggaaacagtatcttgtcgctctccagagtgggaaaaagtcaagaggtgggggaacatttatgtcatgtggaactttttttggggatcaccagcaatgaaccaaaaaaaactcgaaccccccaacaaaaca

SEQ ID NO: 508761 - DNA, 194 bp, Homo sapiens
tgttgaagatgtcaagaatctgtattaatatacagcaagagagcttaattttgtgtccatgttccagagcagcgaaaaatggagggttaattaccagttcgaaatccactctgtaatttagttcttactgtctccacatccttacacattagcataaattaaaagcagagtttatttgtgtcaaagtgctctga

SEQ ID NO: 508762 - DNA, 182 bp, Homo sapiens
actgatcatatgcagcacacaatttttgcacacaattcaccttttaaacacacttaaccatttgtgaaggttaactttatcttacattttcaaccatacacaatcaacactaatcctccacactttcactgtttttattcgtctgaatatacactttgaaggtttggccaattagtacaagt

SEQ ID NO: 508763 - DNA, 922 bp, Homo sapiens
gatatgtggtcggatataaaactattgtcaatcataataacagagtggtgtaaaataacagctacgattagctcatcataatcattatactgaagttccactgtacactagacacaacgagggagattcacacggtactgtgcacaggatggctagagatgttctgtttatcagccaaagtggcaccaccgatgtggtatatagcataaaaacaggttagagttcaatgggccctccagcttggcatgtgttcctattccaggataattgcttttaaatatacgagacattcatagtgtttccatttttacatagaagtcacagacccttgggatgtgggtcggtttgggggtatttgtgtgggatctgcatcgaactatttcaactttatgtaaagctataccatgtgaaccagtcacaaggaatcatctatgaacggatctaagagtggctaacctcccaggaagtgctggatctgtgggtgtgtcaaagctcagtcgaagaacaagtagaacatatcgagggtgccaccaacgaggacactgcccatgcgagtgctgggggaccgttactcttgtagttccactgtgactacttagccgttagggcaacatgaattaccagtgtgccggccaggggtgcggagaagttaatattgttcaatgaattatactatattcagaactgccacgtccttactcatgcgggaccgtgagtataaccacaagtggaactctatccgtgcagactttggtactagagcaaacacattgtcaaggcggtccaggcactgcctgcttcacgcaatctatgcgcaggcagggtactcgtacacagcagaagtgtcggaactcaattgtgtgacaatcgaacatcgtcgcggaaaccgctactcaaccacaaaaaacgcacagaaatacag

SEQ ID NO: 508764 - DNA, 409 bp, Homo sapiens
  misc_feature (56)..(56): n is a, c, g, or t
  misc_feature (146)..(146): n is a, c, g, or t
  misc_feature (170)..(170): n is a, c, g, or t
ctgctgttttttcccccctttggtcccttcctatcacctaaaactcatcctcattncagcccttacagcataactaattatttgttttccctcacctacattgtacatgtgggaattacagataaacggaagccggcctggggtgngttgtcacgccctgtaatcccaanactttgggaggccaaggcaggcggatcacctgaggtcaggagttcgagattagtctggccaacatggtgaaaccccatctctactaaaaatacgaaattagccaggtgtggtggcacacatctgtagtcccagctactctggaggctgagacaggagaatcgcttgaacccaggaagtggaggttgcagtgagctgagatcacaccactgcactccagcctgggagagacagagtgaga

SEQ ID NO: 508765 - DNA, 195 bp, Homo sapiens
ataaatacatagaaataccaaaacataaagtaaaaataataataacacagaacaggcactgcagtcaggtactagattattgtgagcttatcttagaagtgctatgcaaaccagagtcatatctatcttatggacttccagcaatatgcaataatagtctaagatgactttatattaaatactatctagatctcc

SEQ ID NO: 508766 - DNA, 373 bp, Homo sapiens
taccactcttatttctcaatgagctctagctaatataataagattgcattttttgcttagcagatattgtgatttttactaatggaaggtttgtggcaaccctgtgtacgcagagcaattctattggtgccatttttccaatggtatgtgttcattttatgtttctgcatcacattttagtaattctcaaaatattcaaactttttcattattatatctgttatggtgatctgtgatcagtgatctttggcattattattgccatcgttttagagcaccacgaaccacgccaatataagactgaaaacttattcaataaatgtgtttgttctgactgctccactgactggtcattctgtctaactctctttct

SEQ ID NO: 508767 - DNA, 135 bp, Homo sapiens
accccgagcttaagggctacccaagatgtaagattcttcatttaaatacatatctgtgagccaataagattatatatatataaaagacagctcttagattttttttttgtttccccctcttaaacaatttggtca

SEQ ID NO: 508768 - DNA, 231 bp, Homo sapiens
gcctgctaagtgatctagagtatcccctcataggttccagcaggctaaggagatacccattcaagaactgacatgattacacaaattaacgatataaataggtgactcacaatttcattagcttacaaagatcgtggagttaactactacaagcacactagttataccgtattttgtgggaaaagggcatacagacttggctaacttcatattgatcctgcgaacctatga

SEQ ID NO: 508769 - DNA, 260 bp, Homo sapiens
  misc_feature (69)..(69): n is a, c, g, or t
  misc_feature (121)..(122): n is a, c, g, or t
catcatttaaaaaaaatgtacaatgacaaaaaaaaatggggatgatttaaaagattgcttctatctctngggaaaaatggagcagcattttggccagttgtcttttgttttctattcctgnntcccaaatcaaagagcatggttctcatggaaaaccatgttccccatgtttaaaaacaaaaacaaaaattccctttgtaagttccttaaggagtggaaaaaatgtgaaacaaccccaaacttttatagcacttggatta

SEQ ID NO: 508770 - DNA, 218 bp, Homo sapiens
tcgatacgactttttttttttggccaagcctctttggccaggccacttaaagttgtatatgtaatgtacaatacgaagtagataatcctggatattgtccagaggctgttggagagagtgaggtcgagtttactcatccagtggtaatcatcagtaggcatacgtaatttgtcatgtgtccgcaggcaaggatcagcataggtaaagtgcatcagcac

SEQ ID NO: 508771 - DNA, 624 bp, Homo sapiens
  misc_feature (6)..(6): n is a, c, g, or t
  misc_feature (85)..(85): n is a, c, g, or t
  misc_feature (129)..(129): n is a, c, g, or t
  misc_feature (134)..(134): n is a, c, g, or t
  misc_feature (140)..(140): n is a, c, g, or t
  misc_feature (162)..(162): n is a, c, g, or t
  misc_feature (171)..(171): n is a, c, g, or t
  misc_feature (176)..(176): n is a, c, g, or t
  misc_feature (201)..(201): n is a, c, g, or t
  misc_feature (209)..(209): n is a, c, g, or t
  misc_feature (211)..(212): n is a, c, g, or t
  misc_feature (216)..(218): n is a, c, g, or t
  misc_feature (222)..(223): n is a, c, g, or t
  misc_feature (225)..(225): n is a, c, g, or t
  misc_feature (264)..(264): n is a, c, g, or t
  misc_feature (268)..(268): n is a, c, g, or t
  misc_feature (271)..(272): n is a, c, g, or t
  misc_feature (274)..(275): n is a, c, g, or t
  misc_feature (278)..(278): n is a, c, g, or t
  misc_feature (280)..(280): n is a, c, g, or t
  misc_feature (301)..(301): n is a, c, g, or t
  misc_feature (320)..(321): n is a, c, g, or t
  misc_feature (328)..(328): n is a, c, g, or t
  misc_feature (333)..(333): n is a, c, g, or t
  misc_feature (359)..(360): n is a, c, g, or t
  misc_feature (365)..(365): n is a, c, g, or t
  misc_feature (370)..(370): n is a, c, g, or t
  misc_feature (372)..(372): n is a, c, g, or t
  misc_feature (376)..(376): n is a, c, g, or t
  misc_feature (402)..(402): n is a, c, g, or t
  misc_feature (406)..(406): n is a, c, g, or t
  misc_feature (443)..(443): n is a, c, g, or t
  misc_feature (477)..(477): n is a, c, g, or t
  misc_feature (492)..(492): n is a, c, g, or t
  misc_feature (503)..(503): n is a, c, g, or t
  misc_feature (505)..(505): n is a, c, g, or t
  misc_feature (563)..(563): n is a, c, g, or t
  misc_feature (594)..(594): n is a, c, g, or t
gccgcncgattcgcccctgcgctgtccgcccttacccctagcgttacttccggtccctcgctgaggggagttcgtgcggctcccnggaggcgtgaaccgcggaccatgagcgtgggcttcatcggggcnggccngctggnctatgctctggcgcggggcttnacggccgcnggatnctgtcggctcacaagataatagccngctccccngnnatgnnnctgnncncggtagtccgcgctcaggaagatgggtgtgaacctgacncgcngcnncnnggngnaggtgaagaacagcgacgtcntgtttctggctgtgaagcnncatatcntcacnttcatcctggatgagattggggccgnngtganagccngncacntcgtggtctcctgtgaggctggtgtnaacntcagctctgtggagaagaagctgatggcattccagcnagcccccaaagtgattagctgcatgaccaacacncctgatggtagtgcnggaaggcgctncngtgtacgccacgggcacccatgccctggtggaggatgggcagctcctggagcagctcntgagccgcgtgggcttctgcactgcggtggncgcggccctcctcgctgccgtcccggggct

SEQ ID NO: 508772 - DNA, 551 bp, Homo sapiens
gactgtggtgcaagcaatcagcgagattccgtgggcgtaggaccctccggagccagtcttcaggagatttctagtgaacgtatcttcaagctcagtggttgctttacccaaccgagtgtccagtcgtacgtgatgagtgaatcaaagggatgcttcatcccctgttgcagtatttcggatatccaggcattgcctttgaatgtttcctagggtttgcaggtctctgcttacattaccagtgtgtgagtccgttagtatgtgtgtgcactcggatccattagttgcccacagcatacttaatcatgtggtgttttaaattctgtgggttggacccattacaaatttgggcaaagggacagtgaacgagatacttctggaaagaagacatacatgtagacaagcaagcatacgaagaataaatgtcttatcatcactgatcagttaggagaattggataattcaagaagcacaagtgtagataccattgtttaagccagtgcagaatggcctataatgaagatagtaaaaagagaggaatcaaaaaactgatg

SEQ ID NO: 508773 - DNA, 396 bp, Homo sapiens
tgggtgatctaagatcctctctctctcgtggtttactggctcggccgagtcagtctctatcatgtcgatgtgcacagcagcgtgtctgatgaccagctggcgcgtatagcgactgttcactcatgtataaccgtcactctcggagatgagagtatttctcatagccttgtagttgtctcacgtcagttgtactccgagcatttgtatcataccatcatctgtgctagtccatctcctctcctgtcccgtttgtttcttcaacgtctcttctacaggcaggaaataggcaaaactgtcccttctcatcatcatgccctaatcatggctgagaatatctcaagcagatgacactcgtgtccttggggtggtctgagtcaaagatcacctgagcacatg

SEQ ID NO: 508774 - DNA, 1688 bp, Homo sapiens
gggatcgcgtggggcctgccaagcagataagtggcgcgcatttgcccgagtgcggcacagagcactgtccacctgcacacggggcggaccagcgtctacacatctgcgagtgtatagactagtacagacgcggcgtcgtctggttagcatcttacagaccaggactcgcagcggaactcgtgctaaagtgtccagcgtctttcggctggggacagagcagcaatgcaccgctccgggggccacagcgcttggcacacgcatcgcaattctgtagtgcgagtcgtctccccatggaccagcaccattggtgcaggttactagaggtcggggggctgtcgcgggtacgattgaacgcgcaatgtcgcgtgaatgggtgttcgtcagcagcttgacgtgcacacgatttacgaccaagaggcaaagaggggggcccttcacctgcaaggggcctttttgtacatttgtcatctcccgcatgtgccagagagaccaccccgcgaaatatgaccgacgacccccaaaagcgattgtgagagcgagagccaatttgggccgagagaaaaatctgtccgaagacaagaacaaggttaacttctttttgatattccacaaacactccgaaccgcctataaagggttagcctccggttgggggggttcccacccgttgaggtggggaggggccacacaccgccccggtgaagtagccgcttaagggcggcttgggaagcccccaagacatgggaagacccccctccctctttcctgtttgagacaagagcccccttacaccggaaggagctgggggggctccgcgaaagagccgccggtgttcggggacaaccgtataagggccgaaatgtaggaggcccccttaaggcgaattggcggagagtaaggataatctattgaggaaaagcccctattccaaaagacccaagcgcgcgctcccaattcgggcaatgtgcttacacatggtctggggcaatcccttaacgcaacgggggcgtctgttccgggtgtaaggtgccacccctttggggtgtgcggcgccgccttcggtgtgggggtgccccgtcaatcgcacaaccctttgggggaccctcttcggggtgcgcattttgtggcgcccccatgtgcccttgtggactgtgaggcgcgggggggcagagttcccaagcgctcgcggaggcccaccttttgctttaggcgcgcccaaagttcccatttaccctgcaccggttgccccgtttccacttaggccgctccttccccggcgcgaacgactcaggggctaacatggcgcctatgggccggggtggctgtcggagcagcaccctgtggtgccattttgccgcaacccggcgaggggaccttccctttgtacccccttgtgcacacctgtaatggccccttacaacttcgcaaaagggaattcccccctttttcacaattcggggatatcagccagagcgagagggatttaagagaacgggtcctaatgcacaaaacaccaattcacagagaccgcgcgcgacactgaacagcgccgtggtggaacacaccttcctgcgttgccgcccgtggggcacaatttttgcgagcgggaccaaggagaaagccattgggtaggagcacacaaagggtccccgggccactgagaagaaccctctcactccaccgagcaaa

SEQ ID NO: 508775 - DNA, 424 bp, Homo sapiens
  misc_feature (101)..(101): n is a, c, g, or t
tagtaacatctttgagaaatgaatttttaattacaggactaactggatagcaccagccggttaaataaatcagcctaaatttctgattaaaaaaaaaaaancttaactggataaagagaacattttagaattctgaggttgagttgacttttctggaagcaatctccagtcaatcagcaaatacacacacacacataagtgaaaatcaaaatataaatataaatttctttaaggtttatctaaatattaatctatatggaaggtaatatcttaatagatctttaaaaacaacagcttaatatatcttatcataaaataattcttaaaacaagacatagaatttctaaatgacatgttaaatacagtttacaaattatttttgccaaagaccattttttttccagcccaaagaacagctatattt

SEQ ID NO: 508776 - DNA, 134 bp, Homo sapiens
agtggctcagcgcttagtctggtattaaaagatgcaacagaggtagctgtgatcgcccagggccagccatctgaatacccccaaaaaggcgaaagaaaaacaaaatacaccaaccacataaaaccaaaaggagg

SEQ ID NO: 508777 - DNA, 814 bp, Homo sapiens
agcgggccgctctcgaccccgggagggagtcacagcgttcgtacacgcgaggacgggcgacgcgcagtcggcaggcgggtgaagtcttcccatgtgctgcatgcgcggtgctgcaggctacagggtctgtctgcacgaagcagcggaccgaacccgctccagcggaccgccgccggcagcggctcccgcagtcgcgtgtgtacccccgtgcactgaaggaggtccacagatccctgcaccgaggcccccgtcggaccgtgcaatggcccagtcgtaagaatgccaagagcagcggcaacaggagcgagcaagcggcatccggcagcggtgagcgaccgagtgtcggtgcagggaggcagtccccggggcccggatagagaccaagcatggaggacacacaacaatgggaggaaaggcggactctcaggaacttcattcttcaccgtggtttatggtgacttgcattgctgggcgttggacatctgtagtctgtaacgtgtggtttgatcttgttgactatgaggaagttctagaccaaagcaagaaggacttccgttataacttatcagaggtgcttcaaggaaaactaggaatctatgatgctgatggtgatggagatttagatgtggagtgatgccaaagttttattaggcctgaccaaagatggcagtacatgaaaatcttgattgtcctagaaagaagtccttaatatttgaggcagaggaagagttcagatggggtgttatgggtgtcctctcatttctctatgatataatgactcgttttgaaactgctaaaagaagaaaatggaaag

SEQ ID NO: 508778 - DNA, 232 bp, Homo sapiens
ttacgcgaaactgagcgagaaagaactggcgcgggcgcacgctatatcggcagtatgcataaaggttcagacggcgcggtgggaacgccagcgtttaccgaagttactgggtcgccgatgccaaactggggtatcgagttaatcgcaatctcgacttccagctaaacgtttacaacctgtttggtaccgattacgtcgcctcaatcaacacgagcggctaccgttatcaccc

SEQ ID NO: 508779 - DNA, 752 bp, Homo sapiens
tatttccgtcagcacaggcgctgaataccggacttcgtagttcatgccagcttctcttaatgtcgccatgtgtaaagaacgacatgctgtgcctggatcgaactactgtgacctctggttcattatgtagtatgctattcgacatataaataaagaggggatacatcggtgtcaatgccatagttgagtcgtcaagttaattagcagtaattgtcagcttggtgcgctcttcttcgctacctgacgagggtctcagggaagcaggaaggtgacgctagcgtccgggctaggtaactagtgtctggccgccagagtgggagtacgccttcataatgcgctggaatggtttggaccacgatcgctgacagaagaggctatagacattgtccaaggcggaaaatatcacgcatgccaatctgaggggtacttgtgttaactctgggaacacaatgctatttgagaggacatttcttttggcacttattgatttctgtgaccccatacctggggcagatcgatgaaatccggttggatacctagataaagatgggtggccaccagaattaaatcaacccgtttcatctcgtgcggttgcaatggagcaagggaaaggcgagaaagagacccgtgtaaaatgtctaattattcaacgagagaaacctctcatcatcacaaggaaaaggatcgaggaactattgaaggaaacaatagaaatcggaatcccatccccgggggagatcgcaagagtgtcc

SEQ ID NO: 508780 - DNA, 665 bp, Homo sapiens
gggggagagttttagccatggcccatcgctcccctatggacgcgggcctcaacaagggccacaaattgaccaacaacgtgcgcaagcccaggtccagccgacgccgtggtcgtctgaccaaacacaccacgctcgagcgatacatgattcccaaggtgcgtggctattgcccacgtacgagcggccccccatggagtcactgaaggactccaaggacaaacgggcccctaaattaatcaagaaaagggtggggaaggcacatacgtcccaagaggaaacgcgaggaacctgaccacgtacctggtcgccatgatgaaaagctgatgccacatatgactgagccactcccccgacctctgcctggaataaagaaacgctcgaaaccacacactcctagaccagttacatcacaggtcgccctacttgtccaatctacccttaacacggggcaggttaatcaatctcgccaaaactcgagcttacttgccctatctgtcctatactggcccgtctacaattactggacctggtcttacaccacctcaacgggaaaaccttgagtttcccaatacaaagcccttcattctcaaccgctttctcccgatggttttatctcaaagggcctccccaaaccgccatacagtcggccagcccattgcggcgtt

SEQ ID NO: 508781 - DNA, 164 bp, Homo sapiens
aggatggtaccactgcactgcaacctgggtgacaaagtgagacaccatttaaaaaaaaaaagggaataaaacaaagggcatatttaataactttcccctttaaagtgctttaggcttttcttccaaacctttttcctgtgttctccgtgttttaagggtatatc

SEQ ID NO: 508782 - DNA, 829 bp, Homo sapiens
  misc_feature (829)..(829): n is a, c, g, or t
gtatccaaataaactggacaccatcgacaatgtgactgtggcaaggaccgtggagcgctggaaatccgtgtggctcacgctgtgtcagtttcacagaccaagtggaaatcggagttcctttcctgtgtacagcccttctgagcgaggcagaagaggaaccccgccgctgtatgacagcaatgtgcggtgagtcatggcgcgagggccttgaggtgtctaccgtgacttgactacacgttcgaggactgctagctggccctgtcggaaggacagctccgtctacccgcgatgacactatgccttatcagaatttagcgcaggctcagtgacgcgcggcctctgggcataaacactcaggaaaaagcttgaataaatgatcgtggccagatactcagcaaagatgccacggatgaacgcgcgacgcgcagagaaggatacggtaatatgcgtgacgataaagcgcagtctctaccctgggaattgaggcagaccatcgtgaacctgtacatgtgagcagcacaattgattgtctaccctgataacgacccaaagaaacgtgcacccaagtcgtcagttctgcgacactggctaaaagggtgatgtgatcctatgcgctggacatggatacgacatgtgtgacgaaccaggaccccgagaacgacttgtgcaacgggcacatggccatgttccactatgacccaagaccagttacagtatatacgcccaatacaggatcatggcaatgcagtgtatacccaataggttcgctccatagatacctcgtcacttcctgtcaccagaatcgtgcctaagcaagcctcaacacacn

SEQ ID NO: 508783 - DNA, 512 bp, Homo sapiens
  misc_feature (102)..(102): n is a, c, g, or t
  misc_feature (223)..(223): n is a, c, g, or t
  misc_feature (377)..(377): n is a, c, g, or t
  misc_feature (414)..(414): n is a, c, g, or t
  misc_feature (435)..(435): n is a, c, g, or t
  misc_feature (466)..(466): n is a, c, g, or t
  misc_feature (474)..(474): n is a, c, g, or t
  misc_feature (483)..(483): n is a, c, g, or t
ggcgacctagaggacctctcttaacgccccaaactccaatcagcagtagataagatgcaaggcagcatttcgtaaaatctcaaacctaaacagattcctttngacaaggaagcctcccctttaggagcaggcgactaacctgaaaagtgggatataagaaacgtgaaagagctgcaccctttgtcttaaatcacagcgtctaattacacaatgactataagcngagataacagagggcgagggagctacttgatagtggagaccaaggacatttttaactgagtcatttaggcagctagtgaatttagaataattgttttcctccttaattgctgtaaaaatgtcatagtcacactttatcaagacatcattagatnggttggcatgggaacatcatggtgatatcagctgtancgtagccacagagctgaagcnagagcaggtctgaactggaaagtgtatatanatatgtgngtgtgagtntggggcgttaagataagatccggtgagct

SEQ ID NO: 508784 - DNA, 240 bp, Homo sapiens
agtatctaaacatactatcattatctccctgtgtagtacttggagaagtcagctagccctactctgggctaccttgagatgaggagaataggcagataggacctggctcactgtcactactataccctcagttactatatagttgtaattcttagaggggttagccacatgcactgttagctacgcacatgcctagatagatgtaagcatagtagtagcaaaagcattttgctagtagtg

SEQ ID NO: 508785 - DNA, 276 bp, Homo sapiens
aggactacaccagcgtaataaagggacacagaaagacaatgtcaccaaagtgcaggtgcaacgcccaagcagcccctacctctgccagcccagacccgccacttaattctagaggagggtgtctcctcaaggtcaccagtactttttatcttcctttcctttttggtttaagaaaacaaattcagcaggggagggaccaaggttcctcaaagggacaacaaaaaattccaagcttggaaacgaagaagccaaggcacaactcccattatgggtgaa

SEQ ID NO: 508786 - DNA, 937 bp, Homo sapiens
ccgggaacacgcccctgaggcggcgccgccaccagagggggtcgggcgacacagagtaccacgccgcacaattgtgttgcgcaacagtagccacaaggatgcgcgcacacgcggaacacacaggaagtcgttgttaaagaccaagaagccgagtaatacctttggtagaagacgcatgcacaaagttttccgcgccccggcgaaaaccggcggcttgtctgtcaacacagacggccagaaattaactgtccccgggggcaacgggccttagaaggcgtgtgtccacaagggcgcccgcggctatctcctagagaccaccctcccgtgtggagcaaaaacactcgacacacgtggccacctgcgggggcagagggggaaatattctccgcaacccgcgagcaggccccccgccgccggtggggtcccggccccccttcgggcccctgtgataatgggaaaaaccaaggtgcccggctgggcccccacaaaaaagccggtgggaacaccatgtggggggttctcccccagcgagcccaccaggagacaccgtctgcgttacagaagacggggcggcacgaaacatcatcctggaaagaaatacttgtctgcgagcacaaaccactggcccgagaatttcccccaaaaacagggaccccattggcccgcgtcccaggaggcgccgtgtgcacccgggtcccctgctcccccaaaccagccccagaataacagaggggtaccaacaaaaaggtggacacaacaccaaaagaagagagcggggtcaaaacaagaaggtctataagagaaaacagagggaagtgtttcaaaaaaagagtagacaacccccgtgcccttctaggaccccgggaaggtgtcacgctccaccgcacaccaagaacgacgggcatgtcaccccaaaaaaaaaatttcgcaaaaagca

SEQ ID NO: 508787 - DNA, 432 bp, Homo sapiens
  misc_feature (308)..(308): n is a, c, g, or t
tggtggctcgtgcctgtaatcccagcactttgggaggctaaagcaggtggatcacctgaggtcaggagttcaagaccagcctggccaacatgacgaaaccccatcactaactaaaaaatagaaaaattaggccgggcgtggtggtgggcacctgtaatcccagctactcaggacactgaggcagaagaatcgcttgaacctgggcggaagaatcacttgaacccgagatcatgccattgcactgcagcctgggcgacagagcgagactccgtctcaaaaaaaaaaaaaaaaaaaaaaaaggataaaangaatgctgagaacaagactgagatatgggcagatcaaagattctggcaaatacctgaagacatagaggacacatgagccagagtaatggaagccatggctcagagcctgaaaaagagaaatttg

SEQ ID NO: 508788 - DNA, 156 bp, Homo sapiens
gggcgcgggttttgcataaaagggggcccgtttcctttttcccggcccccccagttggggggttttttggggccccccccagggccagggaggggccggcccccggttttggcggccggggggcccgttgcccctttttcccttttttttttttta

SEQ ID NO: 508789 - DNA, 821 bp, Homo sapiens
  misc_feature (515)..(515): n is a, c, g, or t
ggaaacttaattggattacccaaaccaccgcagtgtattggtagtggatgtaatctggattctgctagattgcgtcgtagcttatgggctgacagacttggcattcatcccatcgagctgcgctagtggatgcgcatttctgggaggtaagctatcggtcgacttctatgtggtgcgtctgctgtagtgatgtgagtgctgaatgatggcgatgtgttatctcgtccaggtagattgaacttcagataatgggtagactgcatgaatgatagtgaatacattggagatgaagtgcgattagatggtggttggtgagtgtctagttaggtcaatcaaagcattaaaggattataccctagaattgtggcatattggtataaagatgtggttgatcttattgagtccgtagtcagataacatgtatcgcagtggagttgctacttcccggtgttctacactacactcggattgaagtgggcatagtaatcgtgtcagtatggaagagactcggtagngtactattcgcgtggagtgcttccgatgctcatcctcaaatggcgcctggtggattgaaccagcgtatatcaaacagaagctaagaggatgatgaggttgcctcaggtcaagaaccagtgcagatacccgtgtgggacatccagaaggagcctaaaagacctgtgactagtgagctctagggctgtagaaatttagaaaatctacagatgtgattaacgtcgagcctttaggttttcatccatgtacatggatcacagttttgcttgtgatcttcttcaatattgtgaatttgggctcacagaatc

SEQ ID NO: 508790 - DNA, 694 bp, Homo sapiens
gaggccctggacactctcgtgggaaattatgggagatggcaaccgtggaagcagcaaccaccatgggagtgcgccatttggggttggaaccaggagggtttttttgggtggcatagagcttttgtaattgagggcccactgatgatgcttttgatatttatttcctgctacttaaatgttgaatctgagtgaattgtacctatttctgatgaagtcggtcttgcaaagcgacagattcataaagtaatgagtgaaatcgtttctgttcgttcccgtgtgtatgttctaagaaatagagcccactgattttgtatgttaaatacccagagccatttacctggtactaaacccgcacccccgtgcggagcccttcccagccctcatcccagcttccgttcctagctgtcctggaacctgtctcccttgtgtgagtccacgccctggttctggctgtggtcacgcagatgccccgtgaagggttttgtgtgtttaggccctcatcttctttgtctttttcctactccgttcctggcatttgctgattttctagtgtatactccgtagtctccgcttcgggtttgattccattccatggagaataaaaagtatgttgtacatactgccgaagaattctcttgcaagttaaggcttcccccttttctataagactataaataaacttattttaacctta

SEQ ID NO: 508791 - DNA, 197 bp, Homo sapiens
gacctttacgctgagctcttcctattacgcttgacatcttgcacattggctacgatctgctgatatttccaaggacttctttccagtccgctgaccccgggcagctgccagctgcttcagcatctttccagtgctccatcaagctgctgccagccgctgctggtatctcctcttttcccgagttgtgttgtcatcgg

SEQ ID NO: 508792 - DNA, 464 bp, Homo sapiens
agcattagcccatttaaatatccctgatcagctggattccaaagacctgtcaactatttctttaaaatatctagcacaaataatcatatgccagaaaaatatgcattttaattaaaaacaagaaagaataattaatatggcagatgtgccttagtcactaaaaataatgctacaggccgggcacggtggttcatgcctgtaatcccagcaccctgggaggctgaggcaggaggatcatgaggtcaggagattgaagccatttcttggctaccaaggtgaaaacccatctcaactaaaaatacaaaaaacaaaattagccgggcatggtggtgggcacctgtagtcccagctactcgggaggctgaggtggaacaatcacctaagcccaggaggttgaagctgtattgagccaagatcgtgtcactgcactccagcctgggcaaccagaatgagaccctctctca

SEQ ID NO: 508793 - DNA, 885 bp, Homo sapiens
  misc_feature (189)..(189): n is a, c, g, or t
  misc_feature (192)..(192): n is a, c, g, or t
  misc_feature (194)..(194): n is a, c, g, or t
  misc_feature (214)..(214): n is a, c, g, or t
  misc_feature (219)..(219): n is a, c, g, or t
  misc_feature (237)..(237): n is a, c, g, or t
  misc_feature (247)..(247): n is a, c, g, or t
  misc_feature (312)..(312): n is a, c, g, or t
  misc_feature (320)..(320): n is a, c, g, or t
  misc_feature (342)..(342): n is a, c, g, or t
  misc_feature (348)..(349): n is a, c, g, or t
  misc_feature (358)..(358): n is a, c, g, or t
  misc_feature (415)..(415): n is a, c, g, or t
  misc_feature (417)..(417): n is a, c, g, or t
  misc_feature (476)..(476): n is a, c, g, or t
  misc_feature (510)..(510): n is a, c, g, or t
  misc_feature (517)..(517): n is a, c, g, or t
  misc_feature (571)..(571): n is a, c, g, or t
  misc_feature (589)..(589): n is a, c, g, or t
  misc_feature (624)..(624): n is a, c, g, or t
  misc_feature (627)..(627): n is a, c, g, or t
gaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggccagctggcttntananggcccaacacctgctaaagnacccncaggcccacgtggacatntacgagaaanagcctgtgccctttggcctggtgcgctttggtgtggcgcctgatcaccccgaggtgaagaatgtnatcaacanatttacccagagggcccattcnggccgnngtgccttcnggggcaacgtggaggtgggcagggacgtgacggtgccggagctgcgggaggcctaanangctgtggtgctgagctacggggcagaggaccatcgggccctggaaattcctggtgaggngctgccaggtgtgtgctccgcccgggccttcggnggctggnacaacgggcttcctgagaacaggagctggagccagacctgagctgtgacacagncgtgattctggggcaggngaacgtggtctggacgtggcccgatcctactgacncanctgagcacctggagagaacggacatcacgaaggcagccctgggtgtactgaggcagagtcgagtgaagacagtgtggctagatgggccggcgtggacccctgcaagtggccttcaccattaaggagcttcgggagatgattcagttacaggaagcccggccaattacggatccgtggattccttgagtactccaggaccagactcagaggtccccgtccaagaagcgcctgcggactgccggtcgaaggccacgacac

SEQ ID NO: 508794 - DNA, 348 bp, Homo sapiens
cctatactactgtatatatggataagctcagttgtatccttacttttatgaacttaattgtgctttgatttcattccatttttatttcaatttttatctcattcaatcaacagatatatactaaaaacctactatttgatagaatttcttatgtccataagatatagaggcaaattcagaaaagaatgttttgacatttaaatatattttccttaaagaaaacagtgatatggtaattaccctgatttggtcattatacgatgtatacatgcaacaaaacataacactttaccccaaaacatgtacaattatgtcattataaataaaatgaattaaaaatcaaaagta

SEQ ID NO: 508795 - DNA, 635 bp, Homo sapiens
atgtcacacggaggcgaagcattctttctattctatctccatatgcttagctgtctggtaaaagataccctgatcgaagcgtcgctgtttcaaacatacaccacagccagatccagaactgttttatcatcttcatcttccttaattcgtcgaagcatgtctctgatcagcgggtgtctgggattaatttcaaatgttttcttctgactcgcatagtaatttgtagagatgtccttgcccgtttggtacgcttgtgctttcatgattctctccatgttgccagaccatccgtacgtggctggccaccaaagcacacggagattctgtcaggcgctgagacaccacagccttttcaatcttgtccttaagggctttatctttcatccaattcagcagaggctcaaattctttctcaactgcttcacgactctccttagttttctcactttcatcgaacttcactccttccttggcaacattcgtggaacctcttcccatcaaattcgggaagggcctgaatacagtattcatccacaggttctgtgaggtaaataacttcatagccctttatcagaagtcgctcaacaagtggagaagatccagctcttttctgctggacccagccatgaagtaga

SEQ ID NO: 508796 - DNA, 149 bp, Homo sapiens
ccaggcacgcttgctcgctgaggtcattcttgaggatccccgccttcctgcttcctgcttctgccccccagaaaactacgattgcccttatgaaatcttaagggtcgaagcgttgatttagcagtaaactgagatgtagcagtgcttag

SEQ ID NO: 508797 - DNA, 163 bp, Homo sapiens
tagtgatgaagtgatgatcgggaggattgatgataatgatggcatgattgtttggtgatggtgatggtgacagtgatgatggtgatgatgttgaaggtggtgatgatgttgatggtgagtgatggtcatggtgatgagtggtgatgacccatgatgatggtga

SEQ ID NO: 508798 - DNA, 253 bp, Homo sapiens
gatggatgaactaccgaatagatggatgtatggagtgtagggaattgaatagaatcaatccgaatgaatggaatggaatggaatggaatgtaatgtaatggaatggaatgaatcaacccgagtgcagaggaatggaatggaaaggaatgcaatgaaatggaatcatccggaatggaatggaatggaatgcaatggaatggaatggaatggaaacaaacagagtgcaatggaatggagtgaaatggaatggaat

SEQ ID NO: 508799 - DNA, 258 bp, Homo sapiens
acaataagcgacggggacagaactgcagtggcttctattaaagcaaaaatggatatcagtgttggctagcagtctacaacatttattgggtgcccattgagctcaaaacaggtgttccctgtcacttcctcttctccccacatcctggtgcagggagggggcatgaggaaagaaaagaaaacaaaaggcaaagaggatgtggaggacgggcaggtgggcatcctctgccacacggcctccccttccagcctccgccgg

SEQ ID NO: 508800 - DNA, 339 bp, Homo sapiens
  misc_feature (24)..(24): n is a, c, g, or t
  misc_feature (29)..(29): n is a, c, g, or t
  misc_feature (80)..(80): n is a, c, g, or t
  misc_feature (88)..(89): n is a, c, g, or t
  misc_feature (144)..(144): n is a, c, g, or t
  misc_feature (199)..(199): n is a, c, g, or t
  misc_feature (271)..(271): n is a, c, g, or t
  misc_feature (291)..(291): n is a, c, g, or t
  misc_feature (309)..(309): n is a, c, g, or t
ggaggcggagaggagcgcgtgcanagtantgggtcgccatgcccgcatgcctgatgtcgtgagctagggcacctcggccntggctggnngcagcagaggcccaggcccagaggggtgaggcccaggcacatccggagcgcgcgntgttccgcgaagagctcagccgtctcgtacagcagcgtcagggtcaaagacagcnggcccccatgtcagtggtctaggatggccagtgaaggcaccaacatcccaagtcctgtggtgcgccagattnacaaagcagtttctgatttncagtatatgcctggaacngtacaagaatcccaaggttcttccctgttt

SEQ ID NO: 508801 - DNA, 386 bp, Homo sapiens
gctgacttgcctgtggtgcgcggacctgcgagcaagcacgcctgcggctgctgtgcatgctcgatgagtttgccgtggtgggctgaagaccaatctgggcttcttgcgacgcatcatcggccatccggcgtttgccgctgccgagttggataccgggttcatcccgcgttatcaggatgagctgctacctgtgccaggcgagttgagcgatgagttctggcaagcagccggccaggcgttcatgcagacccaaccgctcaatgacgcccgttcaccgtggacagatacccacggcttccgcgccggtttgccggccgaggtttccctgcatttgagctgcagcggccaggatcgcctggtgacgttgcaccctggcctctcaagct

SEQ ID NO: 508802 - DNA, 126 bp, Homo sapiens
tcttatgaggtagtgctttcttatactgaaggtggtatagcctagctatacatctagtgcttttcgtatactgtgaacttgtggagcttagctggtagtgagtataagggtggtatcagcgcgtac

SEQ ID NO: 508803 - DNA, 850 bp, Homo sapiens
tgcggtagctcatgcctgtaatcccaatactttgggaggctaaggcaggcagatcatctgaggtcaggagttcaagaccagcctggctaacatgttgaaaccccacgtctcatacataatataatacagatatatattagacccaatgactatatgttggcaaccatgccaagttaaagcctacctgggttatggtctgtaggggcgaggagacgaaattttgctgtgacactggggggagggcagatggttgctaggtgaatgctcgaggattatggctcattagtctaactcccaagcctgtgggtggccgagtagcgaaggtagtctcgtgctccagaaaacatatactaaagggaaaacaacttaggataatatacatatgatcgaagaaactggaaaaaaaactctttcagagctgttaatcgttcatagacaagcgcctattggcacagttttagcagtggctggactcaattaaagcaagtctcctatactttcgctttaatttgcccagaattctactgtctttgccccgtcatgagtttgtgtaaatcctgattgctctaggagggtactgctttcacactggttgggtgtttgggcgtagtccttccttgcaacaagtcccttgctggctcagacgttgtggtcccagcctggggcctagccgcttggaggaaaacgacccaagactaagcatacgacgcgtctagttaggaccgcgtgcctgtcttactggcataaggatcgatacgtggaggagctatcctccccccttgaacacatccctactgcatcccccctattgaacacagtagtcagggtgaggttctcaacctatcaattg

SEQ ID NO: 508804 - DNA, 278 bp, Homo sapiens
  misc_feature (38)..(38): n is a, c, g, or t
  misc_feature (46)..(46): n is a, c, g, or t
  misc_feature (138)..(138): n is a, c, g, or t
  misc_feature (211)..(212): n is a, c, g, or t
  misc_feature (219)..(220): n is a, c, g, or t
  misc_feature (222)..(222): n is a, c, g, or t
  misc_feature (234)..(234): n is a, c, g, or t
  misc_feature (240)..(240): n is a, c, g, or t
  misc_feature (242)..(242): n is a, c, g, or t
gcctgagcatcttatttcagaaagtaaggaaatgctcnaatacatnatgggcacaggtagccagcattagtcactgcaccctgctctaatatgattctattctgactgcatcatccccctccacatttcatgttctgntgttagcaacatagccttctctttctgcccatgtatttattatccatcttgactcactaattgctggttttcnntggtttnncntcagttactgtntttatntntgtgctcactttgtcctagatttgaccagtgagagt

SEQ ID NO: 508805 - DNA, 503 bp, Homo sapiens
ccccatattatcagagtccttgtcgccctccaatccatgcgcatcctttatataacaggagaggtcaggtctccctcctttaccataaaataatttgcccaccaatggttgtaccctaagagcacccggattgggggggaaatttttcaactcctacatacttcccccattattctaaaaacaaggcgacttgggaccccttgcggttcacaataagatagtactcccaattgaagcccccattggtataataattacttcccaagagttctggcattcatgagcggtccccccattaggtttaaaaccaaagccaattcccggaggtttaaaccaaacccctttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctaaaaagcc

SEQ ID NO: 508806 - DNA, 228 bp, Homo sapiens
atttctgggtcaggtgagggtcttctgaaacctcacagggtcagattaagctctactttgaagttgtacttctgcaaatgccacatggagaaaaagcctgtatcctataacagtgattcagaacagtggactctggatttcctgaggactgagcttcacttttgctggccagacgtgggcttatcttagaacctcgatactgcaaggggttaatcaaaccttcaaagt

SEQ ID NO: 508807 - DNA, 582 bp, Homo sapiens
gaccatgaagctgcgctgttaatcgaactgtgaaggcgctctcttatacatcgctgattggtaggtgggcttatcagtacgtctgtggataggagagaagtctttggatcgtgatcccatgcatgtctggcaacgtggctacatcatcatcgagtccgcgagaaggcgcagcgactacgtgctgtggaggagattttgtcctggggtacctcatctgctgtggtgcatcctgttcccggtagtcttgtccatcgggcatctccaggatgcgtctggcacagacgggaaggtggcagtgaacctggccaagctgaagctgttcgggcattactatgtcatggtcatctgctacgtctacttcacccgcatcatcgccatcctgctgcaggtggctgtgccctttcagtggcagtcgctgtaccagctcttggtggagcgctcacccgtggcttcttcgtgctcagggctacaagtccacgccacaggaacaacccgtactgcagttcgccaggagccgaggagatgtcagatggagcagtatgaggacctgggtcgggaggctctcaagtcacaatagcaggt

SEQ ID NO: 508808 - DNA, 163 bp, Homo sapiens
cttctatgcgactccacatgtgtaacccacacactctaccatgtaccctgcttccaaagtggaccctcagatgtactgttccctccacatgagcccaaagagcccccaaaagcaggccagagactgaggacacagaatgtaactccacaaaggtccaggtatg

SEQ ID NO: 508809 - DNA, 575 bp, Homo sapiens
atcggagagcttggttccttgcctccttctgcgtgctcttcaactccaagtctatttcattattcaccacagctgagcaatgaatgtgagagatgtggtcaccaaggatctacgttacttgtctgaccagaagagttacgtcttcgatcatagatccttaattatgaagagcagtagattctcacattgtgatctctgtagaataagtcactctatatccctagtaagagagtagccttttcaggtagagtttgcaatagaagtaagaggacaagcagtatggaaggagctacaccgatattttgtaacatactggctagctatggggcaccaggtttctcctggtctcactctacaaattttcagcacagatcttcacttgtctgttatttttactactgtatgagtttgtccagtcttagagagaaatattgagctaattctaacatggtaagtagagggtgtatggaaggatcatatgtacaccttaacagcgtaaggccagtaagatgagaatgactatagaccagcggagaattgagctactaatatgtttaaactcttaagcagccagt

SEQ ID NO: 508810 - DNA, 167 bp, Homo sapiens
attagataggacgacacagtgaaatgcaatggcacttaagcagagagaagaaggattttacatttactattttaaatagaaggtgttagaacctcaactcgtgctcgtttgcattttgtgagagtccagtcgtgggaacaacacaaataaggtcttgagaatgaaga

SEQ ID NO: 508811 - DNA, 710 bp, Homo sapiens
  misc_feature (2)..(2): n is a, c, g, or t
  misc_feature (105)..(106): n is a, c, g, or t
  misc_feature (137)..(137): n is a, c, g, or t
  misc_feature (156)..(156): n is a, c, g, or t
  misc_feature (159)..(159): n is a, c, g, or t
  misc_feature (185)..(186): n is a, c, g, or t
  misc_feature (205)..(205): n is a, c, g, or t
  misc_feature (222)..(223): n is a, c, g, or t
  misc_feature (237)..(237): n is a, c, g, or t
  misc_feature (240)..(240): n is a, c, g, or t
  misc_feature (244)..(244): n is a, c, g, or t
  misc_feature (249)..(249): n is a, c, g, or t
  misc_feature (252)..(252): n is a, c, g, or t
  misc_feature (265)..(265): n is a, c, g, or t
  misc_feature (268)..(268): n is a, c, g, or t
  misc_feature (270)..(270): n is a, c, g, or t
  misc_feature (274)..(274): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (295)..(295): n is a, c, g, or t
  misc_feature (310)..(310): n is a, c, g, or t
  misc_feature (405)..(405): n is a, c, g, or t
  misc_feature (409)..(409): n is a, c, g, or t
  misc_feature (493)..(493): n is a, c, g, or t
  misc_feature (519)..(519): n is a, c, g, or t
  misc_feature (525)..(526): n is a, c, g, or t
  misc_feature (532)..(535): n is a, c, g, or t
  misc_feature (537)..(540): n is a, c, g, or t
  misc_feature (625)..(625): n is a, c, g, or t
  misc_feature (697)..(697): n is a, c, g, or t
tntctccttgtccctggagtgtggcgcttcgcggggccgatgtagaacttagggcgccttgccgtggttggcgcgccccgggtgcagcgagaggccatccccganntttacctccccggagcggagcacgccggctnccagtactaggggtgcgcncgnggagtggcgggggcggaggggtggtnnttttccttctcctccgccngaggccacgggcgcccnngttcccgccggccnggncctntcaanggnggctgccgggacncgngnggcngnaanagnccggttaggcggngcagacggtctgggncgtggcagacggacggaccctcggcggacaggagtaccgggagccctgaaccgcccgctggtcggcggatcccggctgcggtggcgacggcgggnaggngctttccgctgttcctcagcggccgggcccttgaccagcgcggcccgcaggtcttccttctcgccgtcttgcagttgaagagcnacatacgtagtcagtttcgatttgtnacagannttaacnnnngnnnntacccaaggttatgctatgacctttccgcagtttactttgattttctatgtttaaggttttggttgttggtagtagccgaatttnactggcactttattttacttctaaccttgttctctgacggtgtacagaatcaacaaaataaaacatttaaantctgaaaaaaaaa

SEQ ID NO: 508812 - DNA, 153 bp, Homo sapiens
gtgcgctatcgagaatgatggacaatttagacaacttttgaccacttgcgctaataaaaaaaaataaaaactactcttatgtccactttacaaagacgaacactacgccattgtgattactcccaaagacccgcgcaacgggcctcacaacga

SEQ ID NO: 508813 - DNA, 1080 bp, Homo sapiens
tccaaaaaaataatatatattttttttctcacacaaaccccgcagaaaaaaaaaacaaagaggggggcgccgcggggggggacacagagggggcgcccccccccccaaaaaagagcggggggggggggggcgcgccccccacccctgggggggggaggggggcgcctctgtgtgtgtgcccgcgcgtgggggggtctctctctctgtgggggggggcgctcccctctctctctctgtgggggggggggggggcgggcgcgccccccccggggcgggcgcgccccccctctctctttttccacacaaaaagaatatatatgtgtggggggaggggcgccacgccggcgggcgcaaaccagaggtggcggcagagagagagagagacaaaaggcgcgcgcgcgcgcggggagcacaaccaaaaagaggagcagagaggtcggcgacaaaagagaggaggaaaagagacgacaaaaacaaaacaacaaaaagagagggcgcacagcagagaggggcgggcgggaacaacagagagagacaaaagcgggcgcccacaaacaccgtgtgggggggaggagagaggagagagagagagagggggggcggtgttctcgcgggagagggcgccgcggtggaggcgcgcccgggcgaggcgaagaaggcggcccgcgcggaggagaggggtctctccccaacccacacacggaggcgggcggcgaacgaaccgcgacccggagagtcaaccacacacaccccgcgggcggcgcccccccccacacacaaacgcggcggcgcccaccaggacacccccgggcggcccccccccccaactcacatagttcgctgggtggcggggatattcaggcggtggaggggactcaacctagctcgcttccgcaaagagaggggagggcccacccgcgtgtctctacatcctcagaaccatcaccaccggacaatgcacgggggtggagggctaaaccaacacacacaacacaagggaagacacacccctccttttaaaccacacactctgagtcggatgactaagcgacgatccgttggagtgcgtccgtaacggcg

SEQ ID NO: 508814 - DNA, 501 bp, Homo sapiens
actgtggtgagtgagatgagccccactgtgttgtggtaaatatgtagagaggagtatagggctagtgacatagtatgttagagtcctgtaagtagagagagtgatatttgaacaggagaacgtggttactagcacagagagttctcccagtaggttaatagtggggggtaaggcgaggttagcgcaggcttgctagaagtccatcaaaaagctcattcagtgggcagtcagcagtttgcaagtccttgcagcagcaggcattcatgcatgcgcactgtgcagtgcgttccgtcagtttgcagtttgctaggccgcacatcagtactgaggctgtaagtccgtgggcgcattatgagaatgcaccgcgccggtgcaagcttccagggggtttggatgagaatggctgttactacgagggctatgtggctgattgcagagtatgcaatgagcgattttaggtctgtttgtcgtaggcagatggagcttgtaatacttatgcct

SEQ ID NO: 508815 - DNA, 288 bp, Homo sapiens
catgcacttactgccacccctcctcctcctgccctttggtgcaggccatgcccaaggcatagaggcccccttagggcccaggaccctagggtcccagccgctagagcttaaagaggccttaaggtttttcagatccagttaaccggagttaccctagcccagaagagcattcttaccgccctggacatctttgcccacaacctggcccaggctcagaggctcaggaggaggacttggcacaactagtttggggtgactccattcagttacctcacaaaggaggagttt

SEQ ID NO: 508816 - DNA, 1943 bp, Homo sapiens
  misc_feature (653)..(653): n is a, c, g, or t
  misc_feature (917)..(917): n is a, c, g, or t
  misc_feature (949)..(949): n is a, c, g, or t
  misc_feature (1213)..(1213): n is a, c, g, or t
  misc_feature (1418)..(1418): n is a, c, g, or t
  misc_feature (1432)..(1432): n is a, c, g, or t
tcttaaagtattctttataaagatcattaaaagtggtaaaaacaatcttaatattatatataagggcacagggagacagtctcaaataaaattattcaaatttaaacagataactttacagatacaaaagacaagttttaagtgcacattacaaaccccaaagtgtcgtgatctcaaaaattaatttaacgtggcgtctattataagtgcggacaatgtgattataaaaatgtattaaaattgtgggtgcgcattattaaattaaatatactctgtgagatagtgtgacacattcttgtggatagcaaaaaagtgtgcagacaaaaaaaatatatatagtgggcgttatttagacttttacgagtatattttatctcccgcgtggataaattttcttaagagtctcccgataaaatgtcctgtgtataacaatatatcttttctctcgaaagctgtgtgtctcccccagaagagaatataaaatataaagattttctccaacaatataacattgtctcgagtggggaagcgggggcaaacacgtggggatacgggtgtggggtacagaaaaaccagctatcaacgctcttcaaagatgtgtgagcgacaaaatcatcacaaccgccggtgatggggccgagagtggtgatgtnttctctcctaaccagctatttttctgctgtggtgttctatgcgtgggccacaaagttggtgcgcgcaaatactacgcagcgcacctggttctcccccacaagaagatacaggaaaagcaagcacgaccacacacgctgtggtttgttggggggcttttaacagacacccccaatatgaagacataacgaggaaagcaaaaacacctttcctttgttggtgtgttgggaagcgtgggggatatatttataaaataacgagggggngtctactaaactcaacacgttggaaagaaganaccgcttttaatttccaacaagactctattcttcacacaacagggggagtagtgcatccccgccttcctgttgtggcacaacacacgttgggttagtcatacgtatactacaataataggaggaaaacgggctttgatggggaagaatcaaaaggaaggggtataggacaagatggggttcttggtggcgcacaaaagtttttcttgttccaacaacaaagcattctcccgctcgcttttcacaaaaaagaataattcttcccnccaaaaaagaggttgtgtccaaacaaaaaaggtgttcaagcgaattgatgagtcattaacaaaacaagttctcgccaagagagcaccaccataaaagagatgcggcatcacaaaataggaggggcagcacccagaagtgagtagatataatcaccgacaaggacgcgaacatatgttggtgtgttatcaacaatattcaacaggnagcagcgacggaancaaactatagcaacaaaaaggaggggagcaggagagagagcccaaaacacacaaatacaacacaccacaaagacgaagatataacacatagggcgggagaaaaacacaaatatatgaagaagaaaagcacaccccaaaagataataaaatagagacgaccacgcacacgtatagtgactcgtaatgcgaccaggaacagaagaagaaagaataatcaccaaccaagacgcaaaaacagaaaaaagaagaccaagagaagtcaaaagataaaaaggaagaggaataaacaggagagagaaaagacaataaaagaagacaaaaagaaacaataaagaaagagacaacagtcagattaagacgacaaaagcacatccgcaactaaagacaggacaaggaacagagaaaaaataaagacgacgaaacagaaacgagcagacagccataagcacaaaacaaaagaagcaagcacatcgcgaacgcacagagataaatagagacacagcagcaccag

SEQ ID NO: 508817 - DNA, 276 bp, Homo sapiens
  misc_feature (181)..(181): n is a, c, g, or t
ggaaaaattttgggcccgccccaaggggaacccccttttttggggtgggtttttaagggggggaaaaaaaaaaaaaggaaccccttttttttcccgggggcccctccaagccctcccccccccaaatttgggggttggggttccagggtggggggtttcccaggttatggggaccaaaaanggggcccccccccctaaaagggagggggattttttttcccccggggggggcccccggggggttttttttttttttttttggggggggttttttta

SEQ ID NO: 508818 - DNA, 390 bp, Homo sapiens
  misc_feature (303)..(303): n is a, c, g, or t
  misc_feature (328)..(328): n is a, c, g, or t
  misc_feature (356)..(356): n is a, c, g, or t
ggaaaagcaaccacttaaagaatttacaggccgggcgaggtggctcacacctgtagtcctagttctttgggaggcggaggctggtggattgcttgagctcgggagttcgaggccgacctggtcaacatggcggaaccccatctatacaaaaaatttgcagggcgtggtggtgcgggcctgtggtctcagcctcctgggctgctgggactacaggcacctgcccccacatctggctaatttttgtatttttagtagagacggcggagagcagagagggagcgcgccttggctcgctgggccttngcggcggcttcctcaggagagcttngggcgcccacgagaagagccatcaactnggatgcctaacgttgggaagggaacttcgaattt

SEQ ID NO: 508819 - DNA, 1002 bp, Homo sapiens
  misc_feature (222)..(222): n is a, c, g, or t
cgcgtaacccgtaaatgcgcgatatggtgttcatgcctgtgtatattgacgacgctgctggtcgatccgcgggaatctctctacggtctcagtacctctagccgagtacccactgtggtcgctgtgaccactagtgtaagtgttcgtgaattaccgagattgcgtcatgaatgcgacatgctgggatgccttcacctaatttggaaaatgtaataccacaanttgagtaagatggatgtacgcaatgagcatgtaggtcactatgtcacatgtcattgcgaaccactttatacacgcattcattctctgatagtatccatgcttagccttgaatgtctaacataaagataataaatgattgcttcgtaggtagggtaccctaatttgatgtagactttagaacccgattggattgatcttaccgctaacttgacccttgggctccccgaccaagctagttgctacgtatacagactagctagatagagtgagaccatagtagacctgagctacaagcttagagatcccacagaaatcatatctagctaggacaaagagagtgcgtgatcatatagctataacttacatacgacctgacaggcgtgatcatattgtcgaaaccgatgaattatcgactgcgcatgtgtatctgtagaaaatggaacatctggtagcgaacaggaacaagcgagcctggatatgcccgggaccatgacagtgtgtgtgttgagttaggaaatgccgtgtgagttttcggacactaaagcgtgccatatcaacacctcagcgttggcacttggcttggaaaacactacctcacttggggaataacgctcttcaggcaagggtgtccaaggcttaacacgttgtataccatatattcggtcgtgcctatcacacgtaccctctgtcacattaaagacccaagatctggccttggcccatggggtggaaaacgttaaaccacacggccggccccttcgcttcacaaaagggttcccc

SEQ ID NO: 508820 - DNA, 207 bp, Homo sapiens
  misc_feature (14)..(14): n is a, c, g, or t
  misc_feature (55)..(55): n is a, c, g, or t
  misc_feature (118)..(118): n is a, c, g, or t
  misc_feature (133)..(133): n is a, c, g, or t
acaggatcttcggntgtgtcatgcagacagctggatgtgcgagagcctccagctncatcctgtctaatttttttagacgaagtctggtctggtcacccaggctagagtgcagcagtgnaatctcagctcacgnaaccttggctttccaggttcaagtgattctcatgcctcagcctcctgagtagtgggaagtggggataacaggtg

SEQ ID NO: 508821 - DNA, 1338 bp, Homo sapiens
  misc_feature (326)..(326): n is a, c, g, or t
agcgggtggaagagaacggacggcgactggcgacggtctcagcaaatccagctgcctgctgcggaggctgtggctggcggcatgcggaggtgactgaggatagagagccagcatggcactgagggacgctgccaggtccatggacacgtgcatgtgtgctggccagagttgaaaatcggcgtaggagttgggcgatgaaccgtcctagctgtcgcggtcctggtcagataatgcatggtgtccctatgtggaagaaggcacttggtgtaaggcacgggggatggcatatcggtgcaagggaggggggatcgcaggagctgccatgntagccgtgttccactgagcctgcggtctaacaatctcgacctgcactctgttcaacgactgaggagtagaactggtcgcctcaacaggagagggacttgggtgagaaacggcgaggatttagtcgttgcgttgctccgcattgcaaggacatcgcgttggaagcaactttgacccttgggtcaagcctgggctaatgggtcataggactgcatttggctctaggccaacctcgacttgggaaacaggcaaggggtccattaggtatcgcatgaaccaaaacgattcctacgaatagggatcgttacccgggtgatatacccccaaggatatgccaatcttgccttgagtatgctcgcggtgccccacagagcatgaagatctctgggggccaaacaattcgtgacacaggcatgtcttcgatgatctctacgtgcaagtatcgctggaagtatccataattttgggaaccttagttctaattatggatcgcccacacaggtggctccgggaggtaagtaccggcgaccacattcacgtagagtccttcgagaggggcctcccacaagtcggaaaaggaaccagacctcctgtgtcacttatattgggttccccaagaaggaataccttcaaagcaacaagggcccctcatttggggcggatagtaagggggttttgggttaatttaaactaagcgctatacctgtcaaattcaagcatggggttctcccttcgtgaattggctgcggcccccttttggacgaacccttggggcgcaaagctatagactccatgtcggaacttggtgattgatccgcccatgtcgacatggaaaacgagagaattgggcacgacgatttgggggccaccataaaggtgcaacagagagacgattgccatagtggttcaacgtgaaaacctggagcgacaaccagtttgttcgcgtgaacagaacgagcacatggaagtagcacgcttcacaacgggagtcacagagcgacagagggacgttcg

SEQ ID NO: 508822 - DNA, 725 bp, Homo sapiens
  misc_feature (418)..(418): n is a, c, g, or t
gctattgtgaataacgcatcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgcttcacagactcatgagatgtgaaagcggngaatctgtttagctcacatgcgtgtgagaaagctgagaccctgagacaaatattggcctgtgctgcaggctttcagttagacagggacagcatcagttctcattcccttggtagctctatgcctgatgtcttctcactgttttgctgcattatgaattgattttttttttttttgagacagagtctcgctcttgcgcccaagctggagtgcaatggtgcgatctcgcctcactgcaagcttcgcttcctgggttcaagtcattctcctggcttgcctcccgataggtgggactacaggccccggcct

SEQ ID NO: 508823 - DNA, 351 bp, Homo sapiens
ctgttcataatcgaccacagggttacatcctcattactattcttgccgtagtcaggctcggatctacgaacgcagtcacagatctgcttcataatcctctctcgaggatttcaatactctactcccactaatagctttttgatgacttgtaactggcttcgctatcctcgtcttaccccccactatttaccttactggtgagaactctctgtgcatatttaccactttctcctgagtcaatttcactctcctactcaccggattcatcatactagtcatagctctttcctttctctaaatatttaccacaacacaatggggctcactcacccaccacattaacaacataaa

SEQ ID NO: 508824 - DNA, 139 bp, Homo sapiens
ctagtgttgaacgactgttgtgcagcttggtgctgggtgagaatgtgatggagaggaagaagcctggccttgtatcgattcctggaggatgttgtgcagtgctgagtgctggtgtggtgcatgcacacctgtgtgtcta

SEQ ID NO: 508825 - DNA, 442 bp, Homo sapiens
attcgcggccgcgtcgacctcttcttgtttttatgtattgggtatattttattttcctctgattcccatttatccttcaaatttttctgcagctctctccttcctgcttcctccttgctgaggctggctgggatgcttcttccatgattttctgaatctagactgggctgctctctgtgttaaaccaatcaggtgcgaccttctcttaacaggtgtgtatggaaatatgcttattaagaaggataaatcttacttttaaagaaatatgtttttttattcctttcatgtcatagcagaatggaatctttttaaataccttggttccttatgggttggtgagagggtgggaattggggagaatgtttatttaaaaacctgtctttcagcattgtgtattttggactggcatataggcgttcatagctataagagagataatcac

SEQ ID NO: 508826 - DNA, 1251 bp, Homo sapiens
gggggtgggtgtccttttgtggtgccaacagtctataatatcttttgtgcggatcacgcttggtcctcctgttattctcccttgtttgtttctcgctgattggcgccgctccctgtaatgttggtccccacggttagtgttttgcgacgctgtgttttttggttagtgttgtggagtagttcttttatcccttgtggaatcatcgttgttcactcttgtgactaatcaaccaagacacctgtggatgtgtttttgccccgacacgttggggagggcccctattgatctcattttgtaggggtggctttttgttgttaactccctaatgtgcttctctcaaatgtgggttatctactacgtggataatatggtggtagtctccaccctcttctctgtttcctctctctcatatgccccctgttgtcgccctactatctcccccgtgttgctcacgtgtgacgtctcaactctggtggtggggttttttataagggaacactccctagagctgttcctctttatgacagtgtcccgttgctgttgtctaccctcgcggtccttgttatcactgtgtttctctaaaatgtatcacactctgtgtgttatgacgcgccgcgggtatcttgacgtgtggtgtgggggcctgtgggggctccctcctttatactgctcccacgagataatagattgtgtatacttgttttagaataacctctctgctcactctctaacatggagagaacacaacacaagctcctgtgagagtgtaagaggccttgtgaaaagaggtgtatagaggcactcagaccgtctcaccttcccatagggggtctcttgtgggttaccattataggtaacccaggcttgatttgattaaggcactttggccactggtttcctctgtttcgtgttgaacctcttgtggggagcctttttcacaggcccactggacaacataggcttgttgtgtaactaattgtggggaataactggaaccaagtgctgcaacacactaaggggcacaccacccacgtccacatgagagcaagctctctgccccgtggcgacacgccacagcggggcaacccacagaccctggtgccacatggcgaaagcacaggcggttcaaagaaaccactggaggaagacaactccttatttaggaaatgaggaccactcactgcccaacaaacacaccttttatgacccaaccaggatcctctgttcaatttaaactggctaacccatacc

SEQ ID NO: 508827 - DNA, 913 bp, Homo sapiens
  misc_feature (162)..(162): n is a, c, g, or t
acacacttcactaaccacgctttttcctgcactttttactcacattccccgtgcaccacacaatgtcctgctacccccacgtctggtggtcaccaccccgccccgttgaacaggaatttaccaaacactggggacttccccagacagggtatacctatattnggtgtctaaacccacggtcccagaaatattacgccctcacgaaaacacttgtgtaaaaattgtgcccccccccagttgtcacgagattttccaaagcagatttttcttcccccgaaaaattttgctactggacagaagaccctttaacgtgcgtgcagtccacaagaaaatttgtgtgtagtgggtgtccacaccaaagagtttataatacaaggggggcccccccactaagactgcgtcacacgaagccggggcaccaccaaagtgttaagaacccacctcagagggcccggtaggcctatataatgggggtacttcttccccccacacacttcacagaacctgttaccactaatgagaatctgagttgttctcctatcctatatagatgagggtatcgctctcccccacctgttttcatcttcccaccaattatccaccacggcgactcatcccttgtatacaccaaacgttcaatatctcctggtgcccacatccacaaacacagtggtttactaatccccccctcatcacccacaacctcttgtgcactaacccgtcatctcccctcaagtaccgccgtaccacaattcctatcgaaccaagtatgattctgttacccccgaactcagctattagtcgactgctacgtttcacccctcattcccttctcgaacacgacgaacaagtcgagtcaatgaccgcgaaacaacccacaaacatcatattttcatacatgataacaaactat

SEQ ID NO: 508828 - DNA, 249 bp, Homo sapiens
atttaggaagtcacactgacactgtcctacagacctccacttgtcagcaggagcgtgaggggggatggtggtggtgggggagggtgcggtggggttgagggtgaggatgtgttgcagggtggtggtgtgtgggggtggtagcggtagggggtgtggtgtggtggtggagggtaggtggtggcgagggtgtgtggaggtgtgggaggtgttggctgtagggggggtgtgtgtgtggtggtggtagtgggt

SEQ ID NO: 508829 - DNA, 123 bp, Homo sapiens
ggtgactgctgcggtagctcatcacgagctccccggaccacctgtgctggccggacccccttctgtctcttctcgggtaccacgctcgcacattcgtcacatccatggtccatcagctgtttc

SEQ ID NO: 508830 - DNA, 295 bp, Homo sapiens
  misc_feature (30)..(30): n is a, c, g, or t
  misc_feature (61)..(62): n is a, c, g, or t
  misc_feature (66)..(66): n is a, c, g, or t
  misc_feature (72)..(72): n is a, c, g, or t
  misc_feature (76)..(76): n is a, c, g, or t
  misc_feature (106)..(107): n is a, c, g, or t
  misc_feature (128)..(128): n is a, c, g, or t
  misc_feature (135)..(135): n is a, c, g, or t
  misc_feature (144)..(144): n is a, c, g, or t
  misc_feature (146)..(146): n is a, c, g, or t
  misc_feature (152)..(152): n is a, c, g, or t
  misc_feature (155)..(155): n is a, c, g, or t
  misc_feature (159)..(159): n is a, c, g, or t
  misc_feature (162)..(162): n is a, c, g, or t
  misc_feature (185)..(185): n is a, c, g, or t
  misc_feature (208)..(208): n is a, c, g, or t
  misc_feature (220)..(220): n is a, c, g, or t
  misc_feature (241)..(241): n is a, c, g, or t
  misc_feature (254)..(254): n is a, c, g, or t
  misc_feature (258)..(258): n is a, c, g, or t
tcaagttttatgatttatttaacttgtggncaaaaataaaccagattaaccacaaccatgnnttantttatnaaangtataagaggtaaatatgaatcttatatgnnaaaatgtttcattcattatancaaattnccaattaangnatctgnganctangancacaattattattctaacaatgnttattagctcattcacttatttngataactaatgnccacagctattatactacttnctcgttattttgngtgnatgcctcatttccctgacttaaacctcactgagagcg

SEQ ID NO: 508831 - DNA, 429 bp, Homo sapiens
tctaaccaagagtgaactccatctcaaacaaacaaacacacaaacaaacaaaacaatgttgtttctaactgtccatttgccaacatgtagattatctgagcttactggtccattctccttctcagattcattctcatttcagattcattcttgttcttaccaccatacctatttttacctttgttcttgggcagagctgggtggagggctgggtctctatctccctctgtggtgtgtgggcacagcagttacaggaggcctgatactgcgtatgggagaacgctggcgcatttgggagagtgtccatttgagatttccttatgatattctcccctctgtgtttttcatagttacacgctctatctctattctctcaaaaacaccttttaaacataatcaggtatatttgatgaagtctaaatgcaatca

SEQ ID NO: 508832 - DNA, 196 bp, Homo sapiens
tagctatactcctgcttcagcctcccatatagctggggctacaggcacgtgccatgacacctggttgatttctaaagatattgtcgaggcagggtctctgttgcccaggctggtctcgaactcctggcctcaggccatcctcctaactagttctccccaagtgctgggatcacaggtgtgagccattgcactccgg

SEQ ID NO: 508833 - DNA, 223 bp, Homo sapiens
cggcacgaggggtcagcaccagccaccagccccttaggtgaggactctgcctggggctctgctgatggttccgaatcatggagctgcgcgcggcactggtcctggtggtcctcctcatcgccgggggtctcttcatgttcacctacaagtccacatctgagaaaatcttccgtttccaggacacagggctgctcctgcgggtacttgggagcctcttccttga

SEQ ID NO: 508834 - DNA, 714 bp, Homo sapiens
ggtgtgcatggtggtttggattgatgcctgggcccggccgtggcgccgagttggagggggtggcatgtgatgcggcggcagatggctactgtgggctcgtgttttggcttgactggtggagtcgtgcatgtgcgtgcaggaaccatgcgaggccatgctggagcctgctgctgggccctgtgcccgcctctgcctccgcctccttctgctgctgggttacagtgcgccgctgtccacctctactccggggtctagtacaagcgctggcgctacgtgcaaggtctgcctgcgctccctgctctacaactcctttgggggcaggtgacaccgctgttgattgctgccttttgagccttgtctactggcttggtagacaacgttgatccggctggtttggatgtgggcaggacttgattatcgccaaccgtctccatcttgtaagaagttgcatttaccccaagccgagcccgaacacaccacttgcagcatctgcaacaggtgtgtgctgacgattgatcaccactgccccttggctaaacaatttgtgtgggccactataacccatcggtacttcttctctttctgcttttcatgactctgggcctgtgtctactgcagctattgcacgttgggacctttttccgggaggctaattgtgccattgagacttatcacaaacccacaccaactttccttcggaaaggttctccagag

SEQ ID NO: 508835 - DNA, 85 bp, Homo sapiens
  misc_feature (43)..(43): n is a, c, g, or t
ctggacaggtctctttcctggaatgcagcccaggcaccatgtnatccatggcacccttgaggtctctcctttgagccgtggtcac

SEQ ID NO: 508836 - DNA, 283 bp, Homo sapiens
ctctttggatagcggatgagggggtgcagcttcttgtgtggtggtgttctcatcggtgggacgctggttctagaggcagctgtcacgggagttcctgttaaaaggtcaagacactgtcaaagggcgtgttccattcaatggacaagatcccgttaaaggacaagtttcagttaaaggtcaagataaagtcaaagcgcaagagccagtcaaaggtccagtctccactaagcctggctcctggcccattatcttgatccggtgcgccatgttgaatccccctagc

SEQ ID NO: 508837 - DNA, 476 bp, Homo sapiens
ctccctgcttgtgctgttcccctgctctgtgctgttcccctgctctgtgctgttcccctgctctgtgctgttcctctgctctgtgctgttctcagctatgtgctgttccagctgcagtcactgcacctgggggagactgagttgcttcaggcctcagcttctctgacctgccccatctgccttatgggttccatatgataaccacatggagatcattctggaggccttgctctcagccctttgccgcaggcttaccatgaccactgcccatccctctctgctccagcttaaccccatgcaccctgcggtcctcagatcactgtttcctctctgtaaccttttccttgtgccaggagaggtttggtcactggagctgaggggtgatacgtgcctattgtcaaccagagtcctggcaggccacgagggtgttttccagtaatggactcaggttgactagaagggaatcttcaaagttt

SEQ ID NO: 508838 - DNA, 172 bp, Homo sapiens
tgggatttctgctggggtgatgcctgttgggggccagtgcttgaattatttggtttctggttgttttctattagactatgtgtgagctcagtgtgattgatcactcctgatagcgagtaatacgggatttgtaacaggagtagggactatctagtgtggatttagctggtgg

SEQ ID NO: 508839 - DNA, 107 bp, Homo sapiens
gatctagaggatcccgctgtattggcaatttctgtgagcttggttcatgaaacacagacataagtgttcttgagtgtatgtggatgaagaaaatgtctccctactat

SEQ ID NO: 508840 - DNA, 531 bp, Homo sapiens
cggaaaaaaccaccaattattgtctaaaaaaatatgctatgaaaaaaaccttttaacctccccaagttcttttaaaaaaaacacattttcttaaaaaaaaatagtcataaaactctatctgtggacaactctcctttccaatccccaaaatactttaaaaaattaacacctctccctccaacctttttaaaaaagcttaaaatcttcctccttatcttaaaaaaaaaaacatcccctccccaaaaaattcttgcttttccaccctcacaaaaacgtccttccaaaaaacaaaccaccctcgaaaaccctaaaaaaacactctcccaacaattttttttttctctttcttccacaaataacttttttaaattctcacaattgtagaaaacacacaaatttttcctacctcttcttttctttaaacaccgtaggaggctcttaaacaacacatcttttcctatcgttctgacccccccccctccaataatgacctaataactccaacacaaaacaagaactcccttccacact

SEQ ID NO: 508841 - DNA, 531 bp, Homo sapiens
cttccagcggtttccacactcgttgcagacaacacaggtggtcatgggctcatcagagctgcgggtctgcacctgtgaacagggctgggtgaacccagggtcacctccatgctccgctgcagacggcatcccctcaacatgggcagtgcgggcctcgcagccactgagctcccacaggtgacctgatccgaggccgcctcgtgactccaaccttccaaagctgagcctccgggggagggagacagagtttatcggggcagaggcccttgtgtgagcctgaagcagctcacattggctggggaccaggagggcccagacttggctgagggcaagagggtcccaatggtggggggaactagcaggggtccccagtgcccgcggctgccttccggaaggcccaagggtgagcctccggccacaggcagagcctgttctgaccagtggctgggagcaggagagaggcaggctctgcaccgacccaggccccatgcagccttcgaggggaaggaaaggctgtccttgcagcccctc

SEQ ID NO: 508842 - DNA, 153 bp, Homo sapiens
catttattcagaaactccccctttttaaagcccttttgttttttgatttaaaaactctgttttacagatttagctaaaaaaaaaatgtcagtgttttggggcccctttttgaaatgcaaaactaggaaaaggttaaactggatttttttttta

SEQ ID NO: 508843 - DNA, 397 bp, Homo sapiens
ctaagcctgggtgaccgcccccccgtgttccacaagaaggactatgacagcttggggcaacccggttttttggaccgctttatccgttggatttgctagcccccccgcccgggccccccagtgaagggttgtgagccccccccgtccatggtgttaaagggggccgggtcccacccggccagcaccgttgttcattgggaagacgccttgggcctgcccctttccagctcctcccagggggtccccgtagccccggcccccgcccagccccaggtttccccgggccctccgcggggtgcccggcctccctccccctgcagccatcccaagggtcctgccctaccgggcccctgagttttggggcaagccctgccccaataaaggctttgacccccta

SEQ ID NO: 508844 - DNA, 141 bp, Homo sapiens
cagaacacgcatgctatttatgattgacaatacttaacaagggcaacacattccaggtcttgctttctagcggctagactcggaacttggcaaacatctgtgcgccctgtacagcataggatgttcatatttaagaatctt

SEQ ID NO: 508845 - DNA, 413 bp, Homo sapiens
  misc_feature (406)..(406): n is a, c, g, or t
acaggcacactgcaccagcgttcaatagctgaacttgtgcccaagtgccatccgctagcagctttgagcagatggaggctgtgaacatcgcacagacacctgcagagctctacaatgccattctggtggacacacccctggcggcttttttccaggactgcatctcagagcaggaccttgatgagatgaacatcgagataatccgaaatacgctttacaaggcctacttggaagtccttctacaagttctgtactctgttgggtgggaccacagctgatgccatgtgtcctatcctagagtttgaagcagaccgccgcgctttcatcatcaccatcaactctttccggcacagagctgtccaaggaggaccgtgccaagctcttcccgcactgtggccggctctancctgagg

SEQ ID NO: 508846 - DNA, 378 bp, Homo sapiens
ggtgtaagtagttgtgcacactttacaacagtgtaggtctatgagatccatagcccacatactggagagtgtgccaatattaaatgtgaattttactatatttgatgatttaattgctaataagaaagccgaatgataaacatctaagagggaaatgtggtaaaaactggatttgctggaatatattttgagtcttaaaagaaaaattactggagatacttggtaaagatgataaggaagacttaattcaaaatgggctactacaatgggaggatagtagcaggtgagagacactgggcttaattccagatacaataagaaaaaaggatttatagcaaaggagcagagtcaggggctgctgggtggcatcgataaaca

SEQ ID NO: 508847 - DNA, 124 bp, Homo sapiens
tctgatcgacatcgaggtcgttcaccctattgttgatattggactcgtagaataggattgcgctgttatccctagggctacacttgttcccgttgttcaacgttattggagtcatttgacgttg

SEQ ID NO: 508848 - DNA, 150 bp, Homo sapiens
ccgggactgagctggagaacctgggaacgcacaagccaaccttattcaggccaggctggccgccggaacccaccaggtaaccacccaccttatcaccactactgctccgccccgtcatttaataatacctaccacctgttgattaccccc

SEQ ID NO: 508849 - DNA, 466 bp, Homo sapiens
cagatcatagctgtcagctcggccctctcctgcttatggcagatgcacgggcctgccggctcttcgcaggcagtatggtggcagttctaggaataagaaacaccaaaataaaggctgggggaggactgacaaaaaaaacttcagaatgcggcatatcagattctcccttggtaccaggtacatcccaaaattttctataaaagaaggaaagtagcaaagtatttttaaaaggagcatttacactactgtggcaattaagcagcaatctctgagtcagcaaatcccatccagcaaactgagtaacatttgagataacatgagaggattaaaaaaagtagggacactagccgggtgcagcggctgaggctggtaatctcaccactttgagaggctgaggaaggaggattgcttgagcccaggagtttgagaccagcctgggcacacattatggcgggggatcctctag

SEQ ID NO: 508850 - DNA, 347 bp, Homo sapiens
tgacaaggaatattagagcagaaagagtgctacttgatgggtggacacactcgatgtcccacatggcaaggtatcttgaataaggtctgttcatcaccttagtggaggagagtcagctcaatctgagcattgcgtttgtccccaatattatatccttcctggtaattacttcgtcatttcattccttcagtcatcttctgatgtgggtgaccggagcgctgagaggcagctctgatgcactattgtgtgtcagcagctcaaaggccctaaaacactgaaggttctgcatctgaagtattagattgttagcagcaaaatatgaaagatgaggtgggtcagaacagaag

SEQ ID NO: 508851 - DNA, 235 bp, Homo sapiens
  misc_feature (201)..(201): n is a, c, g, or t
ctctgggacgagggggttagggatgaggtcagcctctcatctgccagctggtccccgccactcttccactctcagctggactcccctgccagggtccagatcctgccagagtagttggtccccctagccatgtcctggccgtggacactaggactccatgtgtggggccagtacttcagctcctgggcagagcaggtgtcntatagtagcctgcggtctccccaactcttcctca

SEQ ID NO: 508852 - DNA, 404 bp, Homo sapiens
cacgaggccggcgatcaaggcgccgttgatggcgccgatggacgtgcccgcgacccaatcgggtgcgaagccgtgctcctccagcgcctgatagacgcccgcctggtacgcacccagcgccccgcccccctggagagtgagcgcgagccgcctgatctgcggccgggccgcgaacaagccccgagcttcggcgttggcacgctcctcattcccgtcaggcgtcggccccatctccgcgatccgtcccttcaagcggcatcccccagattatccccgcttaaggtctccagggcgatggccgcggggcaccccgccaggagcagcaccggcagcgcgggaggcggcgcgcctgcctgctccaggaacaccgcgatgaacacggcgacgagaccgtgctgctcgat

SEQ ID NO: 508853 - DNA, 398 bp, Homo sapiens
gcacgagaggacctggatgcaaaacccataaaatcccatgccctttgactcagtaattgaagttcttgaaatgtattttggggaaataatttaaaggattattatggaaataaaggggccaggtgtggtggctcatgcctgtaatcccagtgctttgggaggccaaggtgggtgaatcccctgaggtcaggagttcaagaccagcctgcccaacaaggtgaaaccctgttttttctaaaaatacaaaaattagccaggcatggtgtcaggtgcctgtagtcctagctactcgggaggttgagacaggagacttgcttgaacctgggaggtggaggttccagtgacccgagatcatccccctgtactccagcctgggtaacagaatgagactcccttta

SEQ ID NO: 508854 - DNA, 139 bp, Homo sapiens
taaaacgccacaccggttattttctctgtatactgagtacggagcgaaaactattgattttcggcggctgggagtttgccagttcaattctcaagcattaaagaagaacacgaagcggttcgcacgcggtgcccggttt

SEQ ID NO: 508855 - DNA, 600 bp, Homo sapiens
tgagtgccaggtgccatttagaaattccggatgtcaacatcatgacacaaaggtatctgctgagtaaaaatgtcatatatggaaagtgagaaattcttagatccagacatgtatactttattagacgattttacaagtgacttaagaagcaaaaaattcaggaaactgactaaagctatatgcggactgactgatgactacagcatggatcgattattaccttacgatcagtcagatgaagaaagcatgaccattgtattgcagcatattgattttgccattcattatgctgaagtcctagaatttaaagagccaaaggaacgtgaagatgagtcttgctctatgttagacgaatattttcaagaatgccaggatgaatgcagagcttactaaaagtaaccatctaaagagcttgtggccaaaccagcagagcattcttcccttaaaaggatgcattagtagaaagctacttattttaatgacaataagcctgcgctctttatcagcctcatgcctgaatcaaatgtttaagaattctgaaactgctgttcgttgtgggatcttttagttttataacaggatcactttggatttgggggc

SEQ ID NO: 508856 - DNA, 430 bp, Homo sapiens
  misc_feature (244)..(245): n is a, c, g, or t
  misc_feature (247)..(247): n is a, c, g, or t
tacatcgtctcactttgcttcctattaactgctggtaaaaggagatttggggtagcggctagacctccttttatttgaagggggcaagggctgagatgtggtcccaaggggccagaaattcccaagttggtcacaggtggcttagaagtgtgtgttatggttttacggatttccttgaagcctctctccttctctgcctaaaaagaccctatattctcagtctccccgacccaccccaaagganntntgggaggcttttttttatctgccatactcgcaatcctttgctaagtggtgaagggagagttcaagccaaacgcaaggattggatttagctccctaggtgccacagtcagatgccggacacgcatttatatataaatatatatatataaatatattatacccactcatcacggccaaaaaaaaa

SEQ ID NO: 508857 - DNA, 774 bp, Homo sapiens
  misc_feature (621)..(621): n is a, c, g, or t
  misc_feature (774)..(774): n is a, c, g, or t
gtctttttgaggaagacgcgctcgtaaggtgctgaggattattggctccgcacgctcctgttcctgactcaccgtctgttgcgcatctcgcctggggaacaggtcgggtcaggtatccgctgcgcggcaagcgagccatggcattttaagtgatcaccggcaataaatatccgtgggagccaggacggtgattaacttcatcggatattcgaatcacctctaacatgcctgttagcggtagaaatccttggacatagggtgctgtgctgactttgataagatggcgtcaaaaagcaaacatgaatctccagcacgtcgacagtggtaccagtgttcgaattgccgtgccgaagatttatgagatatcacgtgaccacagaacacattctccgttgttggttgagatggtcctgaaagaccgtgggggatcgtattcctagattgcagacttctacatgcggactcaattgaacttgctcaagtccttccttggagatttggttactgcgtgattacttccatgcagtatggagccgggagttaggggtggaagtcagcatgtgcggatgcttaatgtcaaacctacttattagtagagtttgatggaccaagttgggctantttaaagaaaaagcgttcaagctcaaaaaccactttgttgggagggcttccggacccttataaaatgttttcctcacacccagtggggcccaggcgtatcacccctattagaatgaaactctgtggtctacgcgtttggtcccctgggagacn

SEQ ID NO: 508858 - DNA, 174 bp, Homo sapiens
agggtgacagatgtcaaaacgatatgtatcacaaagctagtagttggcggggggggaacaccaaagttccaatcctctaaaatacgctattcatactatgaatataggacataacatctgcagttaaagtaatagtacacaactgaaaaataaactgcaaatcatattcctcaa

SEQ ID NO: 508859 - DNA, 202 bp, Homo sapiens
gacaatcattgcccttgcagagtggtttacaagcatggtgagctgtcagggacgcacatgtcgaaacaggtcaagagatgttcgtgcatcacggttcccagcacatgtgcccggcgaggtgcttcagatatctggaccaatgcacgagatacactcgaggacctgatagtcttcgcagcgttgtcaccctatctcccaccgg

SEQ ID NO: 508860 - DNA, 221 bp, Homo sapiens
  misc_feature (29)..(29): n is a, c, g, or t
  misc_feature (61)..(61): n is a, c, g, or t
  misc_feature (74)..(74): n is a, c, g, or t
  misc_feature (110)..(110): n is a, c, g, or t
  misc_feature (114)..(114): n is a, c, g, or t
actacaggcctcactctcagtggctgtgnaactaccatcatgtagtattctgactggaagncactaggagcagncttccgaaaagcatgtgtctccagtacccttcaagncagnctgtacacacaagcatttcaggaccaaactgtcacaaagtatttggtgagatcacccaacaccaattttttcaccactgtctcatgtgaggtgaagcagctaaccct

SEQ ID NO: 508861 - DNA, 263 bp, Homo sapiens
taggactttgttcttattgttcactgttgtatctccagcttctgagacaaagtgcctgggacatacaaatactttagttgaatgcaataaactggatggatggatggatggttggatggatggatggatagatgaatggattggatggatggacggacggatgggtggatggatggatggatggatggctggatggatggctggttggatggatggatggatagatgaatggattggatggatggagtaggcatcgataaaca

SEQ ID NO: 508862 - DNA, 209 bp, Homo sapiens
tgagaccgggactcactgtggccctggggctggagtgcagtggtgtgatcatagcccaccgaagcctttaaaacttctgggttcaagtgatcctcccaccttaacctgttgctgggactacaggtgaacaccaccatgtctggctaattacttcagttctttaggatcccagaacctagaggtctaaagtccatacaatctgttctttg

SEQ ID NO: 508863 - DNA, 807 bp, Homo sapiens
taagaatggccataatcaaggagaatggtagatgttggcatggatgtggtgaacagagaacgcttctaccctgctagtgggaatgtaaactagtacagccactatagaaaacagtgtgaagattccttaaagaactaaaagtagagccatcatttgatccagcaatcccactactggatatctgcccagaggaaaagaagtcattattcgaaaaagatacttgcacatgtatgtttatagcagcacaattcacaattacaaaatcgtggaaccaacccaaatgcccatcaatcaatgagtggataaagaaaccgtggtgtatatatatatatatgcactatggaatactacatagacataaaaaggaatgaattaacacatttgcagtgacctggatgagattggagactattattctaagtgacgtaactcaggaatgaaaaaccaaacatcatatgttctcactgatatgtgggaagctaagctatgaggacgcaaagacataagaatgacacaatggactttggggacttggagggaagaatgagagggggcgaggggtaaaagactacaaatatgatgcactgtatactgcttgggtgatggctgcaccataatcttacaaatcaccactaaagaacttactcatataatcaaacactacctgtaccccaataacctatggaaaaataaaataaaaaaaccttttgttcttccttatttaaactttggacgtttatatccacctattccatggaaacgtagaaatttgacttggggaaccttttttgtccggttgcccgtttg

SEQ ID NO: 508864 - DNA, 3678 bp, Homo sapiens
taaaatatatgcagaatcttttaataaaacaatttaatttcctattactaaatgatctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 508865 - DNA, 1072 bp, Homo sapiens
gatgacccaccagtcacatgcctatcatatagtaaaacccagcccatgacgcccataacaggggctctctcgagccctcctaatgacctccggactagccatgtgatttcacttccactccagtaaacgctcctcatactaggcctactaagccaagcacactagaccatatacgcaagtgatggcgcgatgtaacaggagaaatgcactataccgaaggccaacatacaccacctgtccagaaaaggccttcgatacgggatgactcctatattattgacctcgagaagtacgctggcttcgcaggattatactagagccattattaccactcgagcctagacccctatcccccaattaggagggctctggtccccagtagggcatcaccgcacgttaatatcccctaggaagtcccgaatcctaaacacatccggatcagtcgcatcaggagtatccattcgacctgagctcaccatagtctattgcgacgaacaatccagataatcccacagtgaatgcaaggcactgcttcacttagcactgcatacctggggtcccatagtagttaacccatgctacaaggcctcaagagtacactccgaaggtcttcccttcgaccatatgcccgacggcactctaacgcgctgcaacattatgcggtagccacaagggcttatcctacgtgaacgttcacgtccactcattgggctccagtatcctcacataatcttgcctacaatccgtgaactaaattatctacagactttagattccaagaaaacgactatggcctacagaatccgcggcctgactactggaccagttccggccagcaaagactcggccggcagcacacctagccgcgaaagagtcgctccccaaccaaatcggcctgccggcggctctcacagaaaacacagccaacagcaacaggaacatgacatgtggccgcccccgactcgcgcgccccacagagacccaccgcctaaaacccagcaacgtagcgcggcgcaccgcaccaacgaacaaaacgagccacccagcggtcgcaccacggacacacgcgacc

SEQ ID NO: 508866 - DNA, 2968 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 508867 - DNA, 355 bp, Homo sapiens
  misc_feature (24)..(24): n is a, c, g, or t
  misc_feature (197)..(198): n is a, c, g, or t
agaccatgcagcggatcggatganactgacaacatacgatggctctgcatattatgcccaggattttaaaagtcaagcattaataaatacattaactacacagatcacaacagctgccctgaacttggccttcaacaggtgtagtttaccctttaactaaactggtaacattttgagacatcgggcttagagcttgnnaacaggctttgggaggacgctttgatctcacattgagaaacccgtctccgtgtttcactattgcgttccaatcccaaatcgcatccacttgggcgtgtcttgaagctcctgccaagcacagttgtctgtgccgtggtgcccgagtccgcgtgcattt

SEQ ID NO: 508868 - DNA, 469 bp, Homo sapiens
  misc_feature (129)..(129): n is a, c, g, or t
ctgtaatcccagctactcttaaaaaaaaattcttctaaaaaaaaaatggatacatgtgcaggacatgcaggtttgtttcataggtatatgtgtgccattgtggtttgctgtacctattgatctgtcctntatgttccctcccctcaccaccccgcaacaggccccggtgtgtgatgttcttctctgtgtgtccatgtgttcttattgttcacctcccacttactagtgagaatatgcagtgtttggttttctgttcctatgttagttttttgaaggtgatggcttccagcttcatccacgtccctggaaaggacatgatctcattcctttttgtggctgcatagtattccatggtgcatatgtactacattttctttatccagtctatcattgatgggcatttgggttggttccatgtctttgctattgtaaacagtgctgcaataaacgtgtacatgtgtcattataa

SEQ ID NO: 508869 - DNA, 3331 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagagggaaggttttcctttcccccctcacccccagaaaaccaccttcgtccctgccccttctggccgatggcttccaatttatgt

SEQ ID NO: 508870 - DNA, 503 bp, Homo sapiens
acaaaacacagcctgtgtgggcagctacgccccaacacccggccctgtgcacgttgagcacgaagagaagcgagctctctgttcagcgcacttcccagaagccaggggcatcggctgagcacacaccatccggaatatctcgaaaggcacacagtggcatctgtaactatggtaagaaaagcctggtgaaagctcaaggagatccagagcatgtatgaagccgctgcacccctctgttcttacgccctttagtgtcgacactgtctacattggctgcttgctctgaaataacttggaccaagaaggctttgtgccacgccaggctcggaggaagtgtgttggaaaagagggcacacactcgcccgcagcagtcaggcaagactctgcataagtatttcagtgacagcttaccttaccggaaaggtaagctgaaactgtcattactcttcctaactttgcatacttgaaatacttttaactgccttttacagcggacagacctc

SEQ ID NO: 508871 - DNA, 2880 bp, Homo sapiens
tatccagatgctcacacaaacaggctgaaccacactccctctgagcaatatgatccctttgctatttgtggaaaagaaaaaggagcagaggggctctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 508872 - DNA, 410 bp, Homo sapiens
ttatccccggctctgggtatgctgttactgcggcaaatgtaagggagctgactgtcacagtccacttagaaaaatgcaggaatggcaggcagagacctaggaaggacgcacacttgatcatgcctcagtcaacagagatggcaccacacagctgccattcgcccagaggacgcccctgggctgggcatcaggacacacaagtgagcccagccgaccgcaccccagcccttgggagcagacaccgttttgcccagaagcactggaatcatgacagtcaggcggcaaaggtgaggggggaagatggcaagggcaacacccaggctaacacgagcctgaaatcaactaagcgggagtaaagtcctgcgcccactgcccaggccccggtgacggtgaccgagggcgcctccccc

SEQ ID NO: 508873 - DNA, 1769 bp, Homo sapiens
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgcca

SEQ ID NO: 508874 - DNA, 1789 bp, Homo sapiens
tactaaccaataggattgcctgaagggttctgcacattcttatttgaagcatgaaaaaagagggttggaggtggagaacccttcaggcaatcctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 508875 - DNA, 999 bp, Homo sapiens
  misc_feature (32)..(33): n is a, c, g, or t
tagcggcctgcccccttatggcatcccgcccnnattcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagcttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttcaaaaaaacctcgtgccg

SEQ ID NO: 508876 - DNA, 741 bp, Homo sapiens
  misc_feature (471)..(471): n is a, c, g, or t
  misc_feature (481)..(481): n is a, c, g, or t
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctggtaagtttattaaagaaaacttggaaccaggaagttccctctattcatagatacctttttatataggagatcaaccagttttatagttagattaagtggtggttggatatgttgtatttntttaatgagntttgctcaaaagtatttaccacactttctgccacttcaatattaggatttattcctttaggttttaaagcatttttatttcaggattttcctataaaaatgaaaatatgccatcagaaaagtcaatcctagtgtcctcaccctttgctattctttctagtgtcaaaaatgttaattcactcatgaaaacttatttattctaaaaaaagttcttggttgcacgtgtgaatttgtggactttttgcagcagcaccaccagga

SEQ ID NO: 508877 - DNA, 177 bp, Homo sapiens
catatgccgcgttacatggatttggggctggcagggtcgagggtcatcaaatgcattgtggctaaccgtatgtggtccctcaattccccggcccgttggcggggaaggtggccccggttgggtcgtgcatatagtgggagggctgtggccccggcgttactaaatacaaatgggtgg

SEQ ID NO: 508878 - DNA, 508 bp, Homo sapiens
ccaccctggggatgcggcctattgtgaataatgctgctatgaacgtttatgtacaaatatctcttcaaggctctgctttcagttcttttgggtataaacccacaagtggaattgctggatcatatggcgattctatttttaattttttgaggagctgccatactgtttttcacagcatcgtaccattttatattccctccaatcatgcacaaggattccaatttctccacaacctggctagcaatctttatttcatgtttttcttttttttaatttttgagatggagtctcgctctgtctcccaggctggagtgtagtggtgtgatctcagctcactgcaacctccgcctcccaggttcaagtgattctcctgcctcagcctcccaagcagctgggattacagctacgcgtcaccacgcctggctaatttttgagttttcagtagagatagattttcaccgtgttggtcaggctggtcttgaactcctgacctcagatgatccacccg

SEQ ID NO: 508879 - DNA, 525 bp, Homo sapiens
  misc_feature (245)..(245): n is a, c, g, or t
attcgataagtcgaaactgaagaagacagagacgcaagagaaaaatcccctgccttccaaagaaacgattgaacaggagaagcaagcaggcgaatcgtaatgaggcgtgcgccgccaatatgccctggacattccccaagcattgccttcttattttacttcttttagcggtttaactttgtaagatgcaaaaaggttggatcaagtttaaatgactgtgctgcccctttcacatcaaagaactnctgccaacgaagggcgcgcctgcccttcccctttggttttttttttgggcgggcagggaaggaaaaaacttgcatgttggtgaaggaaaaagtggggtggaaaaagtggggggggacgccagtgaaatttaaagtaaaaccaagctggcccaaggggtcctgcaggctgtaaagcagtttaatcaaagggcccttttttttttttgttcaaaagattttaattattggaaggcccaatttttttaatatgcaaataaaaagtttaaacccttaaaaaaaa

SEQ ID NO: 508880 - DNA, 495 bp, Homo sapiens
  misc_feature (345)..(345): n is a, c, g, or t
  misc_feature (351)..(351): n is a, c, g, or t
ccctgccatgtggctggggcactggtggggcctggggctactgaggtgggccttcttggcccgtttcgggggcccctcccccgctttcctgggcctgtcggttgaccgaagcggcgagccaaaggcagttttatttgcaagattagaggcctggaataatcgggctttttagatggtgtagttccccctgtactagcctggggttcgggagcagctgctggtggctgggccatcagtgggcccaagggttctctgtccctggttcgactgtggtttggctttcccgtgtctttcctggtagagcccttcctcgggcccgtcggtttgggtggggggggggttttnggcctnaatgtccccgccagctcctcctcccccgggcgtgcttgggcttcgttggggtgtggtcatttttggccccgccgggggggcccgtgttgcttttctgtccctgtttgttttggcgcagcttaagcctgcccccatactttgcca

SEQ ID NO: 508881 - DNA, 89 bp, Homo sapiens
ggatttgctggtgcagaacaactaggcttaatagggacatgaggtcaactctcgagaccatcctggctaacagtgaaaccccaaaaaaa

SEQ ID NO: 508882 - DNA, 203 bp, Homo sapiens
tctcctcacagcactaggatccgagttaacagagatacaaattcctgctctgcacgattgttgtgaaacaataggtggaaggagttagtctaggccgctgtccttgaattacattgttcccagagaacctaggagagttctttagctgggcccccaccccagatgccattttgagccccttagccactcctgatcaggtccct

SEQ ID NO: 508883 - DNA, 701 bp, Homo sapiens
tcccacgcctcctccactggcggatgatttgtgtgcgcgcgccccttcttcgggagaagagaacccccccccgcctcgtgtggctagatgtttgttgtgtgtagagcatgcccccctcagctttctgcttgtccttggccatttggtcatgccgatgtctcctcattaggaaagataggttgcgtttggtctcattatcagagcacagtcttttttcttttcttttttcgcggggcgccgcccttctactcaaacagagtgcacacaaccctcgctgagtataagagtgacgcgccacagcctcctcaataactctctgcgcaccccgccacgttgttgagagaagtacaaattcgtaaataccatataatcatgtttttttggtcttttcctcctccgatttcacacacactacgtattccgccttatgtttttgttagtcatctacacttcacataagtgaatattatctctctcttcacacatttttttctttctctttttatgtttcgtttctattccactcaagtatcgttctcaaagatattcccaacgcgcaacaagattcttcctccccatcagatccctcctctgttcaagacatacaagacaatcgatcttccacccctccccatgcgtctcatccgaacaattactactacaattctgatacaagagcgctcccatcaattgtcgcagaa

SEQ ID NO: 508884 - DNA, 336 bp, Homo sapiens
  misc_feature (48)..(48): n is a, c, g, or t
  misc_feature (147)..(147): n is a, c, g, or t
  misc_feature (152)..(152): n is a, c, g, or t
gtaagtcctccgtgaagtttcgaggtaggtatttcattgaagtttcgnctcaagtgtgtgatagaggaagcttttgtggctgcgtgtgtagtcatccctcctcgttctgtgaaagcaaatgcgtgtcggctttgaaggttcagatgncgtanctaggcggtaatgccctccgtgcccacaagagggcaacatcccgagggctttgtgagcgctgtatctcttgttaaacgcgcaggcttgggtttagagaaagttacactgaaacttttaaaaaactgataccacctcttatttcgcgatactaaaaaaagaaagatataaaggaaaaaaaaaaaa

SEQ ID NO: 508885 - DNA, 664 bp, Homo sapiens
gactctcctctcaagctgggggttggtagggtggggttacacgcggtttcgatatgcgtatcgaaataagtgtgatatctgttcgtgcggcccatctcatcctggatcacgggctacctgatgtatgcgctccagctaacggagttcgtcgaaaggctggtgtccagcatcttatgcaagatcttagatatgtcgatagaagacacttgtaatcaagagaaggcgcacatcgctcgcaaaagttcagtgtggcatccaaagcattccggagagagcagctggtagcaggagcttacagtgggataattcatttgaagatttgatagaccgtagaaatgagtgctatcagagttaccagcgatgagctatggaactagaaagttgatcgatggcgatggaaggagagttgaagaagatcaatatcatgaagcgcgcaaggtagatttataatgaacagattgaatgaactataaagagctacagaaagttcatggatatcaaatagaatgtcaagctagatacgatccatcttgatcgcgagcccctcttgcgaggcgaaagggaacccagttggccgatgaatcattggtgacagcagttaacaagaggatgtggaccctggaagatgcttccttaaaaaatctctgtgaccattggcttcatg

SEQ ID NO: 508886 - DNA, 1030 bp, Homo sapiens
cgccgccgcgccgcgcccgccgccttggattcccgcggactccgcccggacccggcctccccaggcatggccgccgctgccgcttctccgacacatcggtcctggctattccccgagacctctccggcctccccgcgcgggtgagggccgcgggcagctcgggcttcgaggccgtcgaggtggcctggcgtacgcggagacgcctgaggcggctggcgcgcgccggcgaaagcggggctggggattgtactgatacaacacgcccccgggcgaccaagagaagggggcacatggggactagggggccgtccccgggcgacaggcggacttccgagagggactggagcaggccgtgcggaatgccaaagccctgggttgtcccaggatccagctgataggactggacgagtaccccaggaagctagatcgaataagcagtcaaggctggcagatggagagcacgaataatccatgggagaacacctggacgggccacatgccagacatgaggcgattagcgaatccagaggaagagacccatcgatggcaacccttgcatgggaggccccgatacaaactaccccgcgagtcccactgaagcccccgcagtacgatataacgtggcacaacgcccccaaagtcaaggacgagcaaagcacagaccattacacagaaagggataaggacaagaacaccaaacctcccaggtaactacaatagggaacaagtcgttccgcagcgcgagcaggccacatgggatgggaaccgtggacaggcaaaaataccgggaagatcatgcccatgaagggcctatggcaggtgccacaggtccccagggcggcaggggagacccaacagaccgagagacgcagagtatccccgtacagtatcatgcggagacaaagacaacagagcaacaggggtgcacccacagacgagcgacagtggcaaacgaccacagggaatcagggcaccccaagccgacgagaggcgccacaccaagacgacgcaaaagaccacaccacgacag

SEQ ID NO: 508887 - DNA, 861 bp, Homo sapiens
gagggagcggcggcgctgcgggccgggccgggcctggtgggcttgaggcctgtgctggagccgtggggtccgcgcagccccgtgccggagcccaccagtgcggcggctgcggtgcctggcgcacctggtgcgtcttcgtgccccgttctccaagcgccgtgcagggccggcgtcccaggcctcagggtccgttgcaatcttcctggcctggctgggctgtctttgcatggcagctggctggtgtacgtgcacttactcgtcctactcggagcgctgtcgctggcctatgtctgccatggtggtctctttgtgaccagtaccggcaaggggatcatctcgggctcctgtctgccagtgacctgtgtgagctgcatatggtggagtggaggacctgcctcgtcgtgatgggacctgggccagcagggtgtacagagggcgtctggcgggacaagggatgtaacacatgaagtgatgggacattgaggagagccatcgagtccaaggacccggtcggatgcggctctccggcgggagcgtggtacatgattggaacaagggcggcaaccgagaatagctcacatccaaggaattccgggtaggatgagcgatcgggttcctcaaggtgaatcttgggagaacttcactttcaccttgaccggacgactagggatatagggccaatgggtccattgcgtcaatcggggtttcgaccttatccaacagaatgggaaccaaatccgggaagtagtcaccaatagggcaaggaggaaggtccaaaagtacacgtagatggaccgcacactgtggacatgcaacgaggtaaaccgatatttccattgcattgattgagatgtccccatg

SEQ ID NO: 508888 - DNA, 460 bp, Homo sapiens
catgtgttgtgccggtgggtaactgagtgaagcgcccaggtttgcaagataggcagcatctatacatggtcagcccgatgtccttctctagaaagatgcaaaacccagaagacctaatggtcattgaaatcattgaataaaattttgactatcttagaaaagaaatgacacaaaatatatatcagatggcgacatttgtaacaacagctggtttctctggaatattctcaaacttcctgttcagacgctgcttcaaggttcaacataatgctttgaagacctatgcatcattggctacacttccttttgtgtctactgttgttactgacaatctttttgtaattcatgctttgtattcagataatatcagctaggaaaactgtgttttcagaagctcactgattggcatagtttgtggtgttttctatcccagttctttggcttttactaaaaatggacg

SEQ ID NO: 508889 - DNA, 857 bp, Homo sapiens
gcagaggcatcatggagggtcccggggatggctggtgctctgtgtgctgaccatatctgctggacttctatgagtgaccgaggacttgtggcgagcaccagaggggaaagaaaggggaggcacgtgcaagacctggcacgacgtgcgtgcgcgtcaggcctcagagggtgagcatatggggatgctcgagggtcccgtgtgccatccgtacagtgcgatccaaggccttaaagggagaccagaggggaaacgtggagccgcttctgggaatacctccgtgcaaggttggtcatatccaggatcacatcggctccccatcggagcccgtggcatcccgggaattaacaggcaccaagggcagcccagtgaaaacatcaaggaccagccgaggccagaccttctccggcattcggcggaaccccccaatggggggcaacgtggtcatcttcgacacggtcatcaccaaccaggaagaaccgtaccagaaccactccggccgattcgtctgcactgtacccggctacgtactacttcaccttccaggtgctgtcccagtggggaaatctgcctgtccatcgtctcctcctcaaggtggccaggtccgacgctccctgggcttctgtgacacaccaacaaggggctcttccaggtggtgtcagggggcatggtgcttcagcctgcagcagggtgaccaggtctgggttgacaaagagccaaacaagggtcaccatttagcagggctctgaggccgagagcgtcttcagcgggtatcctcatcgttcgcatctgcctgagccagggaaggacccccgtccccaacgacgtcgtctggcttccatgctccgacttgtaacatg

SEQ ID NO: 508890 - DNA, 251 bp, Homo sapiens
  misc_feature (120)..(120): n is a, c, g, or t
  misc_feature (154)..(154): n is a, c, g, or t
  misc_feature (200)..(200): n is a, c, g, or t
tagagatggggtctggctatgttgcccaggctggtcacaaactcctgacctcaagcaatcctctatccttggtctcccaaagtgctgggattacaggcgtgacaggcatgccctgccaancacaagtgtatcttaatccatcataccccactgnctgactttctctgttggagatcactccttatttaaaaataaggganaacaccaaaaaattggtttttaaacaagttataatttttggttccaatctg

SEQ ID NO: 508891 - DNA, 1702 bp, Homo sapiens
  misc_feature (415)..(415): n is a, c, g, or t
gtggtgatggttcttctcctgctcggcttgtggtgaaagataggcaatactcatttgttaagggagtttgcttgcgtggggtatgtgtgttttcttagcagcaagttttgtggggggagtttatttttcttccaccgcccctggtccgagtggctatcctgtgcggttttatgctgttgccgttcgccttacacaagaaggatgtgtcctctggaggccctctgttggaggtgcctcttaatagttagagggggggcgggatccctccccgtccgtccgcgctgtggttgtttcgcccgcccccccgacacattgcttgagaggttgtttattttataaggggaaagaggtgtggtggctcctactaatcgaccccccacagagaacctttccttcttctagcgggacaaaaggngagtgtttacttaatggatggggaagaatatgttgatgatactgaggatgcgcccttccaatagacgcacatgagggggggacaccacagggctttccctccgtagggtaaaaaagggggaggttaagaccgccttcgacaagcaggccgttgttgttctcgtttgtgtgcgcccccacgaaatgtggggggaagagctgggtgagtgatgacaccgggttgttttttcataaaaagggggacatcacaatgggggcttttcccacacccctgtgcaccacaggcgtgtttttaatggggagattctttttttccctgttggggtttggttgcaaaatggtggggccccacactttaaaagggggggtaatagtgcaacagcgttttggacaacaccacccacgagtgtgttgtgcgctgctttatattcgtgcacagactttatagtttttttccctctggggggagacaagaagggttgccgctataagagagggggactttttgagagagtatacacttcttcacacacttcgggggggaatttctccccacacaggagaaaggtgtgggggccacacaattataggccctctgtgggcgtctctctctttccgcacacacacagtgtgcgcacactcacaggagtttggagagagagtgtgtgtgtgttctaagagcttctctctcacgagacgcacacttctgtgtgtgtcttggtgagacgctcacatctctgaggaaatagtttgtgtgggagaaacttctgagagggggtgcgtcctcttcagtagtgtcccgctctgttgtgtgtcacactctggttctctccacagggtctcacacactcttgggggagactcttggtggtgtgggtgtgtggagactctggagagagacctctcacaccccctctgtgtctcccaggtctctcgcgccccgctgtgtcttatatctccacacaccgctggtttctcacatgttagagcaagaaccccttctctaaagggaggccaagaggagaggggagaagccaccacgagatgtgcacaaacaccacagggggctctcctgttttcacattcttttttaaaaaccttgagataatctctcagcccacaaaggcggagatgcccccctgccacctctcaaagcctggagaattggtgcaataaacccggagttcttgttaatcttttgtaataaaccggagatgttaatttgttatacgaaagggccagtttgtaaacagacacttgtttttttaataaaaagaaagttttgcca

SEQ ID NO: 508892 - DNA, 249 bp, Homo sapiens
cccccccccccattttctttttccttcccaggggggggggggggccccggtttttttttttaaggcctttttttggaagaaccccccccccccccggggggttttaccccttttccccggggcgggggtgtttggggtttccccctttttccaaaacctttttaattttagttccccccccttttccctttttttttttgccccgggccccgccgggggggggggtttttttttttttttttttttgga

SEQ ID NO: 508893 - DNA, 99 bp, Homo sapiens
gatttgaataatatactttttaaatgtgaatttctcaagttgagtttggaaacatctggagtcctattgacatcgccagtaaaattatcaatgttctag

SEQ ID NO: 508894 - DNA, 168 bp, Homo sapiens
  misc_feature (97)..(98): n is a, c, g, or t
  misc_feature (104)..(104): n is a, c, g, or t
  misc_feature (106)..(106): n is a, c, g, or t
  misc_feature (108)..(108): n is a, c, g, or t
  misc_feature (114)..(118): n is a, c, g, or t
  misc_feature (122)..(122): n is a, c, g, or t
  misc_feature (124)..(124): n is a, c, g, or t
gctgcgaagggggacgcggcatccatctctcctcgggaactttgaaaatgctcagttcttctggcctagtctccgctgggccgccgccgcgcctccnngggccncngncctccnnnnngccncngaggcccgagccttgcggtcgcgctctccgctctttatcttctc

SEQ ID NO: 508895 - DNA, 289 bp, Homo sapiens
cagtgctgtagcttgtaggatgaaccgaggcatttccatgactagtggtggccggactgtagagtggcagttgagggtccctggactggtgacagagctattgcttgttggatgaactgtgacgtttccatggctggtggtggtagggttgtgactggccgtcgtaggatccgtggctagtggtgcctgtggtgcttgtcctgtgagtggtggtttagtggctcttggtagtcctgtggctggttgttccagtgctctctgtaaccgtgggtgtcaccgtgaaggatgg

SEQ ID NO: 508896 - DNA, 1064 bp, Homo sapiens
ccgttcttgccgcgtgtgtgttactcgtggctctgtttgtcctctctgcctgggtgtggcagtgtggttgcgtgtagtgtgccatgttccgttcactaccgtttcgcctgctgcgtctgttgtcggggcccctcgtgtcgattttgccggggcgcgtgcatcgcggtgggcgtgggtgggcctatgggctgtcaggggtcgcgctgctgggcgacgtcttcaacgttcgtgtcctatcgttgatcctggcgtgccgggcttgctcagtctggctgctgatagggtgtcgccctacgtgtcatcgtggcttgagcgctgttgatgtccatctgagccgaagttgttatgcgtctagggtgaaggtctgtggcctgtcacatgggttggtagaccgccgttctgtgcgcgaatccctcctgtgtagtccataccctaatagcgtatcgtataagggtataatcaagcgcggtctgtgggactgtgttagcgtccgcgttgtctccgaggtcgaattgaagcgtcccttgtgcgcctcaaagggaaacgaatgtattgtgtatgtctgtctctatctatgtgtagtctatgtaagtacctcaatacctgtaatctccaccattgcggtacacagttgtgtcctgtatatgcggcgtagtcccggatatcttagtgctgcaaaggctgtgtcgaaccagtccgtagattacgtcgcagcaaggccccctgtctgccctatgtcttgcaagagcctgatatgacgacttactattgtactgatgaatggtacaccactcgacggcagctggacaatgcattgcacgtgaggatacaatacatatggacgcactgctgcacccttggaacatgctacaacaacatgatgtgtgtcggtgcacgcaagaccctacttctaacctccctgttcttatgaattcgatacagcatacccaccgattccagctacgaccaactcatacaccttcctatgattaaacttcctaccatctcaccctagcattacttatatgatatgtcttaatacccatacaatctgcacatccact

SEQ ID NO: 508897 - DNA, 299 bp, Homo sapiens
gattgttcctcagcaacattgtagtgagtgagggtgtttattataagtaatgttagtgtattcggctataaagaatagaggcgaacggcgcctgcgtcgtattcgatagtagaagcctgagactagtctcggactccccttcggcaaagtcaaagggggttcggtaggtctctgctaatgtggagatcaatcctattatggccatatggtcatgatggcagggagtagtctagaggtgtacttgtgtatgagataagggtggacaggttgaaaggagccacttattcataatgttgata

SEQ ID NO: 508898 - DNA, 943 bp, Homo sapiens
  misc_feature (764)..(764): n is a, c, g, or t
cgcggagtgcggagggaggctgggctctgggaagtccgcgcgcgtctccgcttcagaggcaggctcccggtataatgagcacccatgttgcaggcctgggcctgtactaagatgaagctgggcaatccccagtccttcctggatcaggaggaggcatatgacctagcagcgtgcatggtaaccagaaggtcgtggaagaccttacaccgagcgccgcaaatgccactgcagtgagcttccatgatcctcggggaccgtgtagcccggcactcatgtcttcaagcgtcctacccacagccacgacgattgcagcttgtctgctgtaagggtgctcactacgtacattcgcacggtcgcttgacccaagacaacactggaccactggtgcggtaacaatgaagccagctctggtgtagctgctctttagcagccattcgttccgatgactcatcagacgccctttggtagagattctcagcaggcatgtaaggaacgggtagggctgacgagcatcatgagccacacgtagtccaggcgtcgctgactgcctccgggcgactctgttctggcatcgagcttcgtatgctagtgtgccgtgcatgagcgtggactgcacctgcttcacggtcgccgagtatcgccagcggtgcctttcgctggctccgactgtggcgcgcgtggttggaagcgagccgtggttggcagggactcgttgctacggcacggtactctcggaacggggctttcgcttgaggcctattganttggttgctctgggagcagcggtatcacctgtacaatgctacccgtctttaggttgttctcgagtagtccagatgtccacactaattgattctccgtatcgatctaagcgtcaatgcttgagtcaccaaagtatgacctgtacgtgttttgaccgcaaagggcgtacagggggtcaacg

SEQ ID NO: 508899 - DNA, 102 bp, Homo sapiens
  misc_feature (11)..(11): n is a, c, g, or t
ggcatcccccnttacttaaagagaaagttgctaaaaagtcaggaggagctactatagaagaactaactgagaaatgtaaacagatcgcaccgagtaaagaag

SEQ ID NO: 508900 - DNA, 139 bp, Homo sapiens
cgtacccgatcgtctggcgctgtggagcgaggcgctcctatcacgcatcggcacctgcaccttctacggcaccgccaacaccaaccagatggtgatggaagtgatgggcctgcacctgccgggcgcctctttcgtgcat

SEQ ID NO: 508901 - DNA, 151 bp, Homo sapiens
gaacccaatccttcatcaaccttatcaaccttcatcaaacgtgagactgcggaaagcaaccaaataacagcgataattggctgtagtggtcaacttgtatacgggtttagaggttacgatgacaggatttcgatgacaggatttcagatga

SEQ ID NO: 508902 - DNA, 255 bp, Homo sapiens
  misc_feature (37)..(37): n is a, c, g, or t
  misc_feature (89)..(89): n is a, c, g, or t
  misc_feature (100)..(100): n is a, c, g, or t
  misc_feature (106)..(106): n is a, c, g, or t
gcgccgggagcttccttgcaggaaaactgctccgaancacttttaaattttttccctttttttttcttgccctttcccattagttgtantttttatttanttttanttttatttttttttagagatggagtctcactatgttgctcaggctggccttgaactcctgggctcaagcaatcctcctgcctcagcctccctagtagctgggactttaagtgtacaccactgtgcctgctttgaatcctttaaaaagag

SEQ ID NO: 508903 - DNA, 245 bp, Homo sapiens
gttgcccttaagcagttccagcttgacttttccctttatcttagtgatgtggggtcccataagatctattttcctttcacatatgcaatcctttcatatgtacctccaataccttaaatattttgaaaaaaaatttagaggtctcttccgcaattctgggaccacaaatgccagaaaacttccaaatacttcaccctcatcaaaagtatgagctttaagatctggactttgccctttctggttgg

SEQ ID NO: 508904 - DNA, 411 bp, Homo sapiens
agtgtacacattattttccaatttgaagattcatttgaaggtagctcctgccatctgctaatagcagttcaaactagattttttgtcatcaagtccctgaatgaaagtatgacgttaggtccctctgaagtttaattctgatttctcattacgagaaatttgctttcatggtattatttcttaattgctatgcttcagaatcaattagtgtatatatgccctttcccgcattattgtagagtcaagtcttggtgttaaagcccaatgtgacagtgtctgatgtaggtactgtcttactggttttttaatagatccttttgtattagagagagagagggggttttgaaaaacctcctttagaagaggggaaaaagagagacaaataaaaaaaggaaacaaaacataaggggg

SEQ ID NO: 508905 - DNA, 380 bp, Homo sapiens
  misc_feature (35)..(35): n is a, c, g, or t
  misc_feature (66)..(66): n is a, c, g, or t
  misc_feature (101)..(101): n is a, c, g, or t
  misc_feature (110)..(110): n is a, c, g, or t
  misc_feature (119)..(119): n is a, c, g, or t
  misc_feature (204)..(204): n is a, c, g, or t
  misc_feature (224)..(224): n is a, c, g, or t
acccgctggaaatcttggttccggagccctgagangaaagagtcatggtagacctttttggatttnctccataatgatggtccagaattgggtcaagtggngttgcgcgncatggctcntactgtaaccccgcactttgggaggccgaggtaggcggatcacttgaggtcggagttcgaaactagcctggccaacatggtgaantcgcatctctactaaaaatngaaaaattagccagatatggtggcacacgcctataatcccagctactcgggtggctgaggcacaagaattgcttaaatctgggaggcggaggttgcagtgagctgagattgagccactgcacttcagcctgggtgagacaatgagattctgtctcc

SEQ ID NO: 508906 - DNA, 334 bp, Homo sapiens
  misc_feature (110)..(110): n is a, c, g, or t
gggtttggggtttttgttaaaattgggaagaaaccatcctttctttccctttggattttctaatggaaaagcctcagttcctaaaccggaattttttcaaatgaaacttncctggccccgtctttttaaaaaatagtgattttttaaacaagcttatttgggttcccagcccccaacccaatgaggcatctgtcttggggcctttttttgttttttgcttattgaaacccttaaaatgaaagctattttttggatttaagttgaaaaaaggaaaatcttgctttttttggggcccagggacaaatgtttgttttgtgattttgctaaggttata

SEQ ID NO: 508907 - DNA, 341 bp, Homo sapiens
tacctagaggacccaagctccaacagagacaaaggtaggaggaagacaagaaaggaagatccaaaggagcggaagaaacttacttagggacagattagcatcttacatacctaagagtggggggtgaaggggaagaacacgattagagagcatttaaaagcctttatccacacagccctggtgattattggattggaatccaaaccaacacagcctgagattattaagaggttttaaaaggccaccgtggtgtggactggttattgccagtgttaagagagaaattaacttgggtttttaggcccccgaaattggagcaccacccaatcttgttgggagcc

SEQ ID NO: 508908 - DNA, 238 bp, Homo sapiens
tagccatcccgaggttaatctggcttatagtcgacgctgacagtccgcttcccacttttagataagcaccgggatgaagctgtgtccgtgattggaaacccgccgggggtggcgtgtgctggggtaaacatgaaagtattaaacaaagtcaagcatgagatggattttgatgctgagtggctatttgaaaatcatgacgagaaggattccagagtcaatgctagtaagactgctgaca

SEQ ID NO: 508909 - DNA, 182 bp, Homo sapiens
ggagggcggtgtccaagtttgtgctcataagcatggctcttttggtgctgtattaagcttggctctggtcgggtgcttgttgactggtaccgttcccggctggacgttgtggcaaccatttggagcattcagggcgtgggctgaggtggtaacattctgctggtggatgcctgaatctcata

SEQ ID NO: 508910 - DNA, 986 bp, Homo sapiens
gagatggcagaagtagagcagaagaatgacgcggaccttcctgcaatgttcacctaccgcggctgtggacctcgaccagctgctggacatgtcctacggagcagcatgactgcatgcatgtacatgtgctgcgccagctgtgtgtgttggcatgaacctggtggacctgctgcgcaggaatcgcaggcaactcacctgctcgaacgtcgcctgctgcacacggccacacgaagcgaggaaagcacgcccatgcgacgaagcccggaacgtcgcgtgcagacagcacacatagcgaggacacatgatcactccgtacaccgcagcatgggtcggcgcaaagaactgtgacgaggcgccgctctacccaaccgctgcaagacctatcaaaccacggtggcacgatccgagccgcgcagatgactcgagccacataccctggcgcgacgatatcaccaatcacgctacacaacgcccgatcaagcaatggccggcccgggccctccggggcccaccaccacatgccctccgcgactaacagacccctacctccaggtcacacggcccacagcctaccacacacagcgcggcacactgcacgtcccagacaacaacaacaccaacaacaaacaccacgcggagagacaccaccaccgaccacgacgcgccaccgcgcacaccaccaccgagaaaacaatagccaactagtcgagccccaaaccgagcaccaaacaccaacacaacccacctcgaccccccccgcacacacactggcacacacaacggggacaccacacaggaccggcaccccccccccataacagagcacaggccgacaacacacacgcgccacagaaaaaaacgacccgagtgtaaaaccccgggaccaaacactgcaacccgcggcgacacaaacaccaaacaccgcacgaacgcagcacgcacgcagtgctcgcagcccatggcagacacagccaatacagccacca

SEQ ID NO: 508911 - DNA, 843 bp, Homo sapiens
gcttctcaaccttggtggcggggtttccggcgaatctgccgccctcgagaacattggcctccgcccagcaggttgttttcccgccggggtttattcatgccggtgttgtgtggccgtcacaccccggctcgagagtagcgggcccccaacctcttgggggtgttcctgcacattcggtgctggcgagggagcttttttaacacggggccccacgtagcgtccagtgactgagcttcaacccttatccggcgctgggccaccacctgtggccaccgtgggacccaacagttgcgcccggacatgaccccccgatattctcccggccgcattcccacacaggggccccgaaagtccgggtggttgccctcgggcccccttttttccacgaccccggattcccgcttgggccgaggcaacgctttcccacgggggtgtcccccgagcggagactccctttcacccgactgtgaaccccccggcgcaggttatacaccggccttctttgtgcccctttcactttgttagagggctgttacacgtgaacctctcgcacggttcattccgcgggttacttagacccccgcttaagagtggtttcaggactggttaagacggctgttccttcacagttaaggccccccctggcttgggcaaccccccgctggctggccgccgttccccgccttttgcgcccctctggcgtgggacccccccctgtcccccctaccagaaagacccgaactgggttccccggaaccccacagagggccagacccccaccttgaggtgcgctcccaacacttcggggcttttttgccaaaaaagattccggaagcgttttga

SEQ ID NO: 508912 - DNA, 204 bp, Homo sapiens
tacatgatacgaatcgagccggtaccccccgactagcccgacagctttctgtattcccgatttttcctggattctggaaaagagctcggaatacagaaagcgtcccggtcgttgcctgtgaaaaagcagaagtccatgggctgggtttactatatgataggcatgtgattggtgggtcattatgtgctgtcgggctagtcgggg

SEQ ID NO: 508913 - DNA, 221 bp, Homo sapiens
  misc_feature (145)..(145): n is a, c, g, or t
  misc_feature (199)..(199): n is a, c, g, or t
actagtcacgggttggctccgttgcagggtccaagtgggtgcaggctgagccccccacctgcagctccttgaggccacggtcaggggctgtctatgggcagaaacctgccacaatgatgccactccatgtgtgcaggtggtcacnagtcccgttgagcttcaaagctcgttgtccgcctaaggcataaagtgtcatcanggcctcagtcatcatcgtgggc

SEQ ID NO: 508914 - DNA, 375 bp, Homo sapiens
  misc_feature (275)..(275): n is a, c, g, or t
ctcaagtgatcctctcttcccactggtcgggctcctctctcttttctaagcagtaaaattctagagtcaaatcagcaatattcacggtggttaacaatggacacatagtttagcgtacgcggagatattggaagtgatatctacaatcaccccactatagtggggaaatttaaaaaagcaaggcggggtcaggcacaggggctcacacctgtaatcccagcatttggggaggcggagggggatcactggagctcaggagttcgagaccaggcggnccaacagggcaaaaccccatctctacaaaaaaaatacaaaaattaggggggcaggggggtgcatgccggtggtgccaagcggctggggaagcggaggcgg

SEQ ID NO: 508915 - DNA, 181 bp, Homo sapiens
catttacttctcatcttcaatgcaagcaaaatgattgaggtttattcacattgaagatgcagaagctaaagtgttccctgtgtcatttctgaatctaggttcatcagccttctctgctggatacctagggtaccgcagctcgcacattcgtcacatccatggtccatcagctgtttcccag

SEQ ID NO: 508916 - DNA, 720 bp, Homo sapiens
  misc_feature (630)..(630): n is a, c, g, or t
cgtgcgtgacgtgttgtgtcggttgtggtagtgggtgatgcgtagtagttgaggtgcttgggtatgctttcgtgtgttgcggtgtgttggagttggcgttgctgcgtgtgacggatgattatgcgcatgtgatgtgtgcgtgcgcttgaagatcgtcgtgtggtgcgggttgtatgctggtgtgtcgcggtgatttgtgtgagtagatgtggttgtgcgtgtgtggggtgtgtcggcggtgtcgtgagtgtttggtgttgtagcggtggctgattaggtggtgtgctttccgtgtcgtcagtggtgtgaggtttgtaggtgctgctggggataggtgtggcgtgttgtgttgttgggactgtgatgcgatgcgcgtggtgtgttggcgaggttgtgtcctgtatgcggtcggtatgcatggcggtgcgagtggtagtgttgtgcatgtgttgcgtgtgtgagtttctgctatcgtcgatgggttcgttctcttgtcgtgttgagcgcgtggttcgcgctagagagcgtaggtcgtagtgcgtcgtcggtgtgtgcggtgcttcgtgtgggtgtggagcgctcgtgagtaagtgtcgtcgcgcgtattattctcctgcgcatcgtgtggtngtgtgtcgttggtgagtatatcggggtggtgcgtgatcgggtggggttgtgtgagctcggtagcgcaggttgtccgttcaggttgctgtg

SEQ ID NO: 508917 - DNA, 197 bp, Homo sapiens
  misc_feature (36)..(36): n is a, c, g, or t
ttcattctcagaaatttaggaagtgtgatggatttnttgttgttttggttttcctctctcctgccagaatattgatcttagtggtagggttacagacactccagttctatgccctctttagataattgttggacaccttctcttccccatgaatacaccatagccttggacaccttgcttccttcacaggttcaaat

SEQ ID NO: 508918 - DNA, 350 bp, Homo sapiens
  misc_feature (197)..(197): n is a, c, g, or t
ctagctggcagtggtcacgctattccagagtgaggcagcgatcactaggtcaggagtcagatcagctgacacatgagaacctactaaaatacaagtagcaggctagtgtgcatgctgtatcccagctgctcaggagctggcacaagagcaaatccagctcaaaaaaaaaaagaagaaaagaagctgggctggtggcnaggccatcacccttcccttggctggaactactggacagacccttttgagatgtgcctgtgctgctgtggaaatgtgtgtagtggtcttacctctttgttgagcttgtgtgtgtgtggtgtagtcttagctgtatgctgagattgcggtgtttg

SEQ ID NO: 508919 - DNA, 1002 bp, Homo sapiens
gagcatgtgcctgtgtaacatgcactgggggctgtggggttggggagactgaatgtgatttaccagctggatgaggaagagactcgctacctggtgaagatccctgtccccgccgagcgcatcaccctcggcgatttcaagagcgtcctgcacgcgtgcccgcggtgcgccaagtactttttcgaagtctatgtgatcaggatttcggggtggtgaacggacagaaatttcacgatgaacaacggccctgccatcccctgcttcaactggaagggtggtatcctgtgctgcgtgtcctcatgagtaattcccgcaaacccgaagactggccaccatccaggtccaatggagccctcggggcatgaacttggcagccatccatgctcaccgagccagtttagcccgttcccgtttatgaccaaccgcgtgacggacgagtacccaaagcggtccactatagtgggcgaacttccaagtggggccgcgatctcaattcacgtttccccagacaccgttaaagttgcttgttcgccaggccaaagacaccatattgcaagcgcaagaggtttcgcttgagaaaagtcaccttgggaagggaactaggggtaaaaagcccggtgagtgattccaagcggtaagaggattgggttccgaggcgtggcacagcggcccggtgtgtgcaggccgaggggacccattcgggcctagcgtggaaacgaagggcaactaaagggcgacggcatggaacagggccagatttgtgcgcccaggtggccatgcagaacactagcgccgcaccaattgttggcccccctacatatgtgaccatggacgcccccggctcgttgtgaaacaccgtgcgggtgtccatttggcggaagcagccacatagagaaatagcaccgaccccccaagatgggaccctccagtttattgggcgattaggtagctcacggagattggaaaggtgccacacacggggttggcgagtgaggaacaatg

SEQ ID NO: 508920 - DNA, 112 bp, Homo sapiens
tagtttgagcctaatagaagttaagcatgaaatgggaatttagctgggaacttgaggaaatacccagtagttaacagggaacgtcttactctttctacctctgactctgtgt

SEQ ID NO: 508921 - DNA, 373 bp, Homo sapiens
  misc_feature (279)..(279): n is a, c, g, or t
  misc_feature (330)..(330): n is a, c, g, or t
taaaagcccgtccctgggggctgggtgaatgatatggggcgcatccctctgagggaacactaagctgccattaaagagtacagggcagctgtatttgctgagacgtggaaattttccggtgtattctaagtaataaagtgcagaagagtgtgagtagggctgtgtgtatgtggtatgtgtgtttgcatctctggaagtggttgcttcttaggatggtcactgtgggactaggagtggaggagagaaagaaaacttgcttttcaccgtactagaatcttntgcaccttttgaattttgccgtttatactatgtctttacctgtaaagaaanaagaactttgaaataaagttgcatttgcttgaaaaataaaaaa

SEQ ID NO: 508922 - DNA, 137 bp, Homo sapiens
ctctacaaaaaaaaaaattacagatctcacaatgtcttcaaagaacattgtgagatctgtaatttttttttttgtgtcacaaacgtgttgaattttggggtcccccaaattggtggtggcccggttgttaccccctg

SEQ ID NO: 508923 - DNA, 687 bp, Homo sapiens
  misc_feature (6)..(6): n is a, c, g, or t
  misc_feature (46)..(46): n is a, c, g, or t
  misc_feature (376)..(376): n is a, c, g, or t
  misc_feature (385)..(386): n is a, c, g, or t
  misc_feature (409)..(409): n is a, c, g, or t
  misc_feature (411)..(411): n is a, c, g, or t
  misc_feature (432)..(432): n is a, c, g, or t
ccaagnaagcagccaattactcgagcacacaaagctgcgacagaanacaccagccaccatgaatccaccctctagaaggtagattcaagagatgaatccaaaatgtcttcatggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtgggagtaatagaaagctccattactcaactgggaaaggaccctantgacagggnnaactgaacagattgcacatgggnangccaaactggactttctttgnttcctctttaaaagtttacaaagcagaccattttttgacccttccttttgtttcctctgaggggctggacgccccaagcaaggggccatctttctgatctgaacaaacctcctttgggccaaacggtgctggtcacaaggacttcagaaagtgttgagttgaggcgcacacccccatttccgaaagaaatccaaaagggcagtcctccataagcacaaaggaattggggcaacacaccaaaaaaacactattgtg

SEQ ID NO: 508924 - DNA, 897 bp, Homo sapiens
ggatcattattgctaattacttcactgacgcaggctcttaaggagctttcttgacttgcctccgtattccatctgtccctgggccccaggaaagaactgcagaatggagctgccaggagcgatctttctcacagaaagtggcgccgtagttcacggagggtgggtggcgttgagtgtcaatagaaagaaactgaaatagagactgtgatctttccagtaaaacacggcacgttgattgggtgctgtactggatgggagcatgttgtaaactgaactgctgtgtgatgtggaatccaacgtaagtgatagtacttgttgtcagacgtgcagggctctgtgagtcacctgtagagccatgagtgttgcccttgctgtgccgtggtgcacggtcccatatggtacatgatcagagcttgatctctcctctcatgaaggtctcctggaagtacggctgacgcacgacatccattatcatgtatatcttttcgtaccgattgtggttctcttttatacaatgctgatgttctgagtcgaagaagcgttactgaaatggtataaggaaggacatgttgctaaaggcaaagagtgtttttcttgaccagatgtagatagttgtgagtggttacaaactgccgaagaatggatccgaatcggaaacgcggggcaactgagtggtcatccatgtgcagtacctaggttaacacttcacacttgttgatgcgagtgtcgaccattgaaacacacacttgggcgtctgtttccgccaggtaacaaatgggggtgggtccctgggggagcgcaggggttgcccggggcccgtcaagggggccggcgcccaccaatatattggggccgcgcccaatggaaataaacccaagaggtaggtgacccaaatgc

SEQ ID NO: 508925 - DNA, 412 bp, Homo sapiens
aaattttctttacctgttttgttgaaaaaaaaaatctgttttaattccaagccattattagttttttttcccttataaatcatcatcacttcaggaatcctttcttaagaattgcattggccagatttggtggctcatgcctgtaatcctaacactctgggaggccgaggcgggcggatcacttgaggtgaggagtttgagaccagcctggccaacatggtgaaaccctgtctccactaaaaatacaaaaacaattggctggacatggtggcatgcgcctgtagtcccagctacttgggaggctgaggcagaagaattgattgaacccaggaggcggaggttgcagtgagccgagattgtgccactgcactccagcctaggtgacaaagagagactctgtctcaaaaaaaaa

SEQ ID NO: 508926 - DNA, 292 bp, Homo sapiens
  misc_feature (55)..(55): n is a, c, g, or t
cagcctgctgaggtaggacaatcacctgaacccaggaagtcaaggctgctgcagngagctgtgactgcatcactgcactcgagcctgtgcaacagagcgagaccctgtctccaaaaaaaaaaaaggggtgaagaaatggaaaaaaggttcccttttaaattaaaaaaactgcccggcctggggggtaaaggttggaaacccaagcttttgggaatgttgggaagggggaccccctggagactgggggttaaaaccaaccgggcctaaagggggaaaccccctctccccctaa

SEQ ID NO: 508927 - DNA, 324 bp, Homo sapiens
acccttcctacctatggcccccgcttcccccctgttgaatggaaacccggattgcggaggtggatgccacgtgtggtacgttaagattgcctccaagtacattttatgccagtgcccacagtggctggatatggccccatttagcagcttccagactacaaccgggatccgtagggcatgttttggctgcgcttttaggcgggaagcctatgtaaacaaaagggcagggccggggtttgtggtcccccccccaacccccaacacagcactttgggtcctttaacctgtgccccaggtggcccccaataaaatcctttggtgaga

SEQ ID NO: 508928 - DNA, 146 bp, Homo sapiens
tccgctggccgatgcattaggttgatggacgcctcctctactctggcctcagacaggaaggtgatccagtgacagcgggggccactgtgcggcgctagtggaacgtgtcgccatggcagctctcctcatgagaacacttctgagtg

SEQ ID NO: 508929 - DNA, 176 bp, Homo sapiens
tgtgcacgcacgtcatgctcagctagttttgtatttctgtagagacaggtttgccatatgcccaggtgggtctcgaactcctgagcccaagcagtctgccctcctcagtgtcccaaagtgttgcgattacaggtatgagccacggtgcgttggcccaacacggtgcgttggcccaa

SEQ ID NO: 508930 - DNA, 911 bp, Homo sapiens
gcggctgtacgccatggagttatgggatctagcacgatggtggtggaaagacgcttctgtgcgttagtgtcctaacggttaggaaggattcacagagctgggacatgaggaaggagccagacccctcgggcagaatgcccgcgaggagcactgggtagtggtgggggcaggggtgcctcctctgtcaagtaggagagtcggcgccatcgcatcgttactcgtgcgagctgcgcagcagcgatcgtacagtacagagcgatagcagaacgcactacagggaaagtgaagccggtgagagagtacctgggtaggacggtcgtctggggactgggggcctgtaggagcgccactttgttcgtcgtggaggcagttgctgaagacacatgatgacttacagtgtgaggtctggcgccttactcatgatgacggttcaccctatgagcatcctatcaattacatagggaccacattggaaaccagggaatagaacgcacaagtgatacagtaaatgcataaatgcataaaacagagggaaacctccaagaatatacgcaaaatgactagagacctgagggaaatatagcgtatccacccagctcgattacacttattgtcccgttatagccgcacgttcaccacaaccaatttatactagagcaagacgattgcggatacaggcaatcgcggtctcccatagacagcatttgggtagagagcacgaaggtgatcgcaagtccacgagaaggaatcagtataataaagacccaagcggagtaaacactcaatctagccaccattaaacaggcacaacacaacggactagaacgcgatccaaaacaataatacgaatcagcaaagcacaccaagatgcacggaagttatcgggatattgcgcagaagagcccaacagt

SEQ ID NO: 508931 - DNA, 127 bp, Homo sapiens
atctacaggttcccctcatgtcacctggtggtcccccgtctcccgggaggtcaccataattgtatgcgcgcacttagtgctggacgacccgagtcggctatatgcgcactacagtcctcagaactcc

SEQ ID NO: 508932 - DNA, 1235 bp, Homo sapiens
ggttgagatccgtgccaagtgcagacataccagtaattcctcatcggctaggtggggcggcaaaattcgctaggtgcgcgtactagtgactggtagcacagtgtcatcttacctctgtggcgctgaggactaaggaacctagggacacgtgtatcacgcgatcaattggaaaggaggacagcgcagatccgagaggctgatataggatctggaggaccgttggatccgagaaaccgtgggatatgtgggtggaatgactgccgattgtcgtgggatgggatcctccaatgcgaccgagtcgtcagtatcgtacatcctgcatgaggccaaggtcttgcgtgtgagattgctgaaagagtatggtggaggctgattggctctagcgtatcccaccgctcgtggcaatcgagcgaggagcgaacaaacgtcaccctcaaggggccgccaaaggacgtgtgtgcgaggccgtgcaaagaatacgcatacgaggagtatcatttgcacggaccgtggcaagcgtcatggtgaccatttaggaaatgttgctgataccccaggaagattccattcgattctgtctatgggctcactcaacgggttcgcaggaagtccaggctagattgacctcgggggattcccagcttgttctaaagttaacattccccaagacgaggagcagcgacgaaccgtcagttcgacagtaacgagagcccgctagttcgagtgaagaatcgggggaccgaacgcctggggcagggggtagcacaggctaaaaggcatttggtcgatggcccgaggtccattcacaccgtggagtgatggttgacccattaattgaatggattgtccttggctgagaacgagaagagacgtgttgaggggttggcgagagcaaaggctctgcggagcaaatggatcgatggacagcactccgaatgtagaggctgctttgggacttgaccgtcccagctgtggagcaacgaggcgactggggatgcacgaaaaagaaggacaaggagaaaggggacaagcacccgtgcaggaccaaaagggggttgaggacacccacaggcgccaggacaaagaacagagccaaaggcacagaagactaaaggaaaacaaaaaagagaccggcaaaggaaagaggacgacacaagacagagaggaggggaccaacacaggagagacaaaaaaagacgcgacaacaccgacagagaaaaagaaaaaacaaccaa

SEQ ID NO: 508933 - DNA, 892 bp, Homo sapiens
  misc_feature (22)..(22): n is a, c, g, or t
  misc_feature (31)..(31): n is a, c, g, or t
tgcctatggctgtaccggccgncagggttanatctttgtgagaaatgccattagccccatattgacccctctcatcttgtcatcatccccaggctctggcctgaacaaatcctaattgtcctggtcttacgtttctgaaaccgaacctcactcccccagacaaaccataatgtcctagtatgctttactcacaggcaacggaatcggatggggttcgaaccccgttggctgaatatccgtaacttcccaactggtgcgggtcattacattaggtgtgtgtcccattgaatcaaccctgtagtttccttctgtcatgctttcgcacttcttcctggactcatctctccccagtctacttgccttggtagtcatctgccctggatctctttacccagcagtgatggcctggctttgcttttgggcaatccagccctatccctatcctgtcaggctgtgtggatggtctacctgggtggcacgtagtgaccctgagtgtggatttgggcctggctgtgggtgtggtcttctccatgatgactgtggtctgccgcacccggaggtgggcatcgagatgagtggccgttgcggtcgggggcaggggacggagactgaggtgcttgggggtgactctccagccaggccaggctaagctggaaatctggcccacttcttccctagggtgtagtgcctggcatcttgggacaggctgaggggacaggagctctacaagaaccagtcagaggaagcccccagggtgggtgcggctgaagcaaaagaacgaaggcaagattagcccagaacctttctctgatcctttgaactcttaactccctcccaggtccccgggggctctgaatacctgagctaaaccaacacaatgtacttttgggac

SEQ ID NO: 508934 - DNA, 157 bp, Homo sapiens
atatggtatcagatcaccaaactagagtgcatcagttaaattcaatccatctactggccccaatctctggcttgcctctacctactgctgtccagttggagaccgactaccatgcactgaaagactattaggattgctgcctcctaatttatcacag

SEQ ID NO: 508935 - DNA, 542 bp, Homo sapiens
ctctgctcagggcagacagtgacgaactgtctatgcctgggagtgatgaggtttgtcttaagttttggtctttcactgtctccggaactcagggccattcatgggtctagagcctccatgatactatgtagccacagagaagcatgtgcaaacattgaaataaaatcacatagacgatttctagaattgaaattatgtatgttgcttttcagtaccttgaagagagcccttgatgtcttcaagcagcgtaagttaattatttaaaaaatattctattttatgtgtctgagtgtttttgcctgcatatgtgttttatgtactgtgtgtgcctggtgcctatagaggccaggagttggaattatggtggtggtcgtcaatcacctcataggtgctgggaacagaatatggggcctctggactgttgaaccatcacaccaacctctagtgtaaaattctattctgccctttgtaaactccacatctttcctctaaggcgaattctaatttgaacagcaatttagcattaggttaaaaaaacaaaa

SEQ ID NO: 508936 - DNA, 143 bp, Homo sapiens
aagtggttctggagtcagatctctcctaagtctcttctgttcagattatttcgtcaccttttacatgtaatttcatcagggctcccctgtggccccagttgtcatgtccaagaacgcacaggctttacttataagcgacggtg

SEQ ID NO: 508937 - DNA, 481 bp, Homo sapiens
  misc_feature (16)..(16): n is a, c, g, or t
  misc_feature (67)..(67): n is a, c, g, or t
  misc_feature (92)..(92): n is a, c, g, or t
  misc_feature (131)..(131): n is a, c, g, or t
  misc_feature (134)..(134): n is a, c, g, or t
  misc_feature (159)..(159): n is a, c, g, or t
  misc_feature (211)..(211): n is a, c, g, or t
  misc_feature (218)..(218): n is a, c, g, or t
  misc_feature (222)..(222): n is a, c, g, or t
  misc_feature (226)..(227): n is a, c, g, or t
  misc_feature (230)..(232): n is a, c, g, or t
  misc_feature (234)..(235): n is a, c, g, or t
  misc_feature (238)..(239): n is a, c, g, or t
  misc_feature (245)..(245): n is a, c, g, or t
  misc_feature (265)..(266): n is a, c, g, or t
  misc_feature (278)..(278): n is a, c, g, or t
  misc_feature (287)..(287): n is a, c, g, or t
  misc_feature (303)..(303): n is a, c, g, or t
  misc_feature (309)..(309): n is a, c, g, or t
  misc_feature (332)..(332): n is a, c, g, or t
  misc_feature (334)..(334): n is a, c, g, or t
  misc_feature (345)..(345): n is a, c, g, or t
  misc_feature (478)..(478): n is a, c, g, or t
tgtactttggctccangggaaggactactgcaatttattagcggtatctgtaaacatggggaataantctgaaaacaaaacaaataggaacnctttttagcaccaaatacactgtcttctcataattcctnaanccccctcccctttcccccctgctgncctgccttagtgtttcttacaacatctcccagctcttgtccccatccctgtnggtcccngctntggnnttnnngnngtnncctgtnacctcactagccatacgggnngccacgggcacnaagcctggnggctccactgccaagnccagcnctggtgctcggtccaccaccaangncagcgccagtntttggtccaccgccgaagccagctcctgtgctcggtccaccgctgaagccactggtgcttggtccactgcggaggccaacaccagtgcttggtccaccgctgaagccaacaatagaactgggtccactactgnagc

SEQ ID NO: 508938 - DNA, 351 bp, Homo sapiens
ttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgtgcccagagaggtcaaggttgtgatgagctgtgatcacaccactgcacttcagcatgggagacagagtgagaccctgtttcagaaaaaataaataaataaaacca

SEQ ID NO: 508939 - DNA, 214 bp, Homo sapiens
accagttgggcttttggtcttcctctccccatgcaaactggtaaaaggcctcaggatttttgagttgtcctcagccccctcctcttgtttcattttaatacatgttttctaataacccagtttgtctcttcttactttcagaccatcaaactccaaatggtcatgcaaccaaagtcttgaagtctcggacaatgaccccttctgtcgtcttctc

SEQ ID NO: 508940 - DNA, 447 bp, Homo sapiens
aaagaactcttacccataacccacgtgatgcaagtcatatgggggaacctatgtaaatggtcaggataaaaaccaactctgaatgccaagatcccagcactactttatattactaggaaaaatgggggagatagaaaaatctacttagaataatatagtaaaaataaaagagtgggtagtgtatgtacttctcccaccttacagcatttataaaacatgctgccccacatacaaagtcacgaccacttacttttatgtgacactagtagttaggggttaatgtatagagataaaacagctgcatatgagataaagttaccccaaccacagtgaggaggaagatgtacacatactggaactgtcctgccaaataaatataagcccctattagtgctctgttttaatttggagtgggcacagtaacctctatgcttggaatgggtaccg

SEQ ID NO: 508941 - DNA, 156 bp, Homo sapiens
ctttatacaaaatacagaatactttatattggaagtgaaaaaaatgaacgtggacttttacacatgggcatatttttttggaggctatatggattatttgaaatgaaaagcatactaattgggctttaataaatcattttcaatcagcgtttggta

SEQ ID NO: 508942 - DNA, 250 bp, Homo sapiens
gtctcaacattggaaaacctctgtctcactgtccagcagggactcccctgaggggcccagggctcctcctccatggtgggaggtgagcttttaccaggttccaccacccccaaagtgtgtggggttgcgggccctgggctttcagggcaggtggctccagggggccacccagggtcagcactccctgtcccacctggtggacactcatgagcaacagctgctgacttggcaggttctttgctctggttgg

SEQ ID NO: 508943 - DNA, 284 bp, Homo sapiens
agactctcatcatcaaaaaaacaaaaaaatgaaaaagacaaataatttatttggtattactttaacagattatctctaagagtgctgcacagaattcatacgtgtttaccctgatgctacatatcaaaaagatatcaaaacaataaatcacaaaatagaaggtaagaaccattttttatttaaaacatcttttgaccaaatgtttgtctaaattcatgaggactgatatactctgacagccagagaaaattattttttaaatgcataacacggaagaacaaagg

SEQ ID NO: 508944 - DNA, 224 bp, Homo sapiens
atattaatgaggtgggaggatctacttgagctcagaagttcaaggctgcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactctt

SEQ ID NO: 508945 - DNA, 201 bp, Homo sapiens
acctcaggcagagagaagccttcatggaaggatggaaagaaactttccttggaaagaacaggctcccctaatcacactccttccagatgttaccagattcaataactggaactcctgtcctatcagaatgaagggttaggagctcttcctttgagtgtgataaggaccacatcacatccccacaggagagctcagtctgag

SEQ ID NO: 508946 - DNA, 554 bp, Homo sapiens
cttatttgacccaccgcatcgtttacacctcctcctcccagggcatgtcaacactgctctcgccctggcgggtagcaacaaatgggatatcatcttctgtggtctcggagtcatcatgctggtagaccagccggacacgcaagaggtcttcattggtgaaggatgtcaccatagtggtcttgtcctgtgtcccacgccaagccaacctcccatggcggggccgctccatgacctcatagaggtagctggcactgttgagactcttgacaaagaggtggtcagcagagaggacacccccaccatcctcaggcaccacgaggaggacattggtgaggacaggcgcatctgggtcaccaacaatgtggatggggaaggtatacagtggggagaaatatggtggagctgtgacacggagaacggacggtgtcctcgtactgcctctgaggcacgtgcttgtggccgcataggtcacccggccagcctgtatgtcatcctgggtgaagcctggccatctgacagcttgtgcctgtagtgaaggttgctttcctggagct

SEQ ID NO: 508947 - DNA, 429 bp, Homo sapiens
  misc_feature (272)..(272): n is a, c, g, or t
  misc_feature (429)..(429): n is a, c, g, or t
ggatccctcgggctgcaggattctgttcgaggagagagtgagtgagagtgtagagagagagagagatttagagagagagagagagacctccagagtgactgcgctatacagtgtgtgagctagttttctttttccgtctcttcctcttttcttctatagctcctgttatcgctctttgtcaattgcttttttttttctttcattctattgccttttttttggcttgtattgctcttttcataagaatccctttttgtctggtgccagttctngttccacatatagtttctacttttctacgagtctgccattacctgtgacttcctttattaagcattcccagagaagtaagtttttaatctttctaccatgcatcgaacccttctttgttctcctctttgatgttgtttttttttttggcttcctttn

SEQ ID NO: 508948 - DNA, 703 bp, Homo sapiens
ctggctgcagcggggaggcataattttttctctctgaaccctggacctaccaggttcaagcgacactcccatgggaggggccaaaaacttggttttacaaggggctcccagctcgccaggctatttttgtatttttaggagagaccgcgttttaccacgttggccagactagtcttgaacttctgaactcaagtgatccatttccctaggtcttccaaaatgctgggaggggcgttgtttgccaccatgccccgccaattttctcttattgtttgataaaaacctatttggccgcttaagacttatatgacatgagatcctaagtcttacctgggtcaaaaactgaatgcttgcatgaatgaagaaaggctgcctgttcactcatcgagtttggcaggtctttctggaatgccacacaaattagttttctctggtgagccaaacttggaactcaccttagcttttccaattggaattagggggtgaccagccccatatttttctagacttttctctccgactccaagtgccgggactggtgaagtccatttagattgagggccgggtgggatgaccttctcagccaggaaatggtttggcttaaagaaggggccctttctccaatagataaggcccttttctcccctagagctggggctccctggttctcatatgagggctttgtcctttcagaacgagaggg

SEQ ID NO: 508949 - DNA, 445 bp, Homo sapiens
ctggtggtaccatcagagattgtagaccctatatacctcctgcccgcgtcactggctgccccagatcctggcttgccgccattacctagctctagtatgctgtgatcctagaagtcaagatgagttctatacatatttgactccctcacctttgcaggcaactagaaacaccaaaccctatgcaattgccatggttctgttgatctgaatccatgcccacacagacaaccatgctgaccggtctctttgcagtgcacagccgcggactccagtgaggccctagggctgcgtcattcctactcaatctcccccgtccacgcattcttccacccccgagtgagcagtcacatcgtcacttctttcagatctcgcacaactccttccctctctccgtcattctcaagtgaagaccttccttcctacaacacgggacaactggcgtaac

SEQ ID NO: 508950 - DNA, 161 bp, Homo sapiens
attacccttactgaaccaaagacctactctgggctggatgactacccccgggcttcacacccttcagtaacctgagcggcacctggacctgcgatgttgggtggcactggtgtgccctgtgtgcttgactgctggctggcatgagcatcttgggtagaggc

SEQ ID NO: 508951 - DNA, 595 bp, Homo sapiens
aagatataccagcgagaactaggggtctatcacttgagcaagatgtccgagcctcttctggccggttaccctcaaatccctgtcgtgagcttcaccatccttgggggacaggctatgctgaaggtcgtgactggggactgcctcctgcccagcctcccggggtcagtatgcagggctgtggcagaacaatgctccacgacgcttaggtgtgcatgggggctccccagaccactggggccagacaaggagggaaagaggcaactcactggccccaacgccagccacactgaagggctgccctgcggggcagggacggcgggcgtgcagggagtgggtaaacctcctctctaccaggggaggctggcagagtcaggcttgcagatagagcaactcaggtggctgaggaggggccgaggaaaaaaacaaaaaaggatttgaaaattcaggggcccaagttttctgggtcataaggggtgggctggggtcactgggcccagcccaggagatgtcctctccatctggaggggccagctcaaagaggctggaattgggcaaatggctccggtatgggggctagggaaggttgccaccaggt

SEQ ID NO: 508952 - DNA, 440 bp, Homo sapiens
taatcacagatccatttaagcttgcagaagagtctgacagtatgaagtccagatgtgtccctgatgctgctggaggagggagagtggcagagagttgtgggagagtgagaaggggtgagtgaggacgaatgaagtagggggagtgtggaggaagagggtgaatgggggttggtggggagaagacgataagaaacaacaaatggagccactgcgcccggccataaatgaattatttttaagaggcattgattaaagattcacagcaaatcactagttaagcagattttttttctatttcctactgcaaagttctggtgccacatagtggtcagaaatggaagagagaagctgtcttaagccttgttcaagaagcaggaaaggcatcagaagaagtaacagttggcagaggggtctcaggaaaacatcgtccttcggatttt

SEQ ID NO: 508953 - DNA, 362 bp, Homo sapiens
ggaggagcgggcagccaaggttcctagcaccccgccccccgagggcagctcacacaccccctgccctcactccggactcgcagaccgtggaagcacgagaagacagctgaggtctcattgctgcgcgaggagtgctgaggaacgtgctcgtggtgtccggacgggagtgggctggagcgaagagcgtaggatgcgcacggatagaacgtagggaggcacgcgtacagaggcaatcacgggcatggagagagcgaccgagctctgcttaccatccacggcccacctatgcactgcctagcagccagaacccaaaagcgcgtgaccccgagccgccggggtccaccgagccgggtgactccggg

SEQ ID NO: 508954 - DNA, 1094 bp, Homo sapiens
  misc_feature (4)..(4): n is a, c, g, or t
  misc_feature (31)..(31): n is a, c, g, or t
  misc_feature (631)..(631): n is a, c, g, or t
  misc_feature (671)..(671): n is a, c, g, or t
  misc_feature (674)..(674): n is a, c, g, or t
  misc_feature (744)..(744): n is a, c, g, or t
  misc_feature (756)..(757): n is a, c, g, or t
  misc_feature (778)..(778): n is a, c, g, or t
  misc_feature (783)..(783): n is a, c, g, or t
  misc_feature (786)..(786): n is a, c, g, or t
  misc_feature (791)..(791): n is a, c, g, or t
  misc_feature (825)..(825): n is a, c, g, or t
  misc_feature (834)..(834): n is a, c, g, or t
  misc_feature (840)..(840): n is a, c, g, or t
  misc_feature (844)..(844): n is a, c, g, or t
  misc_feature (849)..(849): n is a, c, g, or t
  misc_feature (859)..(859): n is a, c, g, or t
  misc_feature (862)..(862): n is a, c, g, or t
  misc_feature (879)..(879): n is a, c, g, or t
  misc_feature (883)..(883): n is a, c, g, or t
  misc_feature (885)..(885): n is a, c, g, or t
  misc_feature (915)..(915): n is a, c, g, or t
  misc_feature (921)..(921): n is a, c, g, or t
  misc_feature (925)..(925): n is a, c, g, or t
gganaaagacctgagacttgcatgaacggtnaaccctgtgtctgtcttcctcaaaggaagctgcaagtggattcgaactcctgcaatcatctactctgttcacaccatgacaaccttaattccgatactctccacatttctgttgaggatttctccaaagccagtggtttcaagggacaaagacctgagacttgcatgaacggttaaccttgtgtctgtctatgccccctacttactcatcccattcatacttttaattttcatgttgcggagcccctactacaagtatgaagagaaaagaaaaaaaaaatgaaggaaacaaccatctctaccctgggccagtggttgttggtgggatacaatacaaggaacactggtcagaacccacgtcttcagcagcattggaaacactggcagcaatgcacaagagcaagatggtgtcaggaaccatgtcaaaccctcaccttcttccatttttttttttttttaagacagtctcactctggtgggcccaggcgggagtaaaggggcaggggcattgatctcgggctcactggcaacctgcggcctcctggggctcaagccatcttccttagcctcccaagttagcttagaaactacagggtggtgntaccaacacgttagtgggctaattgtggtttgggtttttnttngtggtggtggtggtggagacgagggtttggccagtgtgtgtgcccaggtgtggtctcgaagcgcctaggnctcaagtgatcnngcccacctcagtctccctaangtgcnggngattncagacgtgaaccacggggcccagcccaaaccttnaccttctangggccngggnatgancagaccgatnggnttgaggggtgggcaaangggntngtgggctaggtataaggaaggggtaccaanataagngtgntgccttaagttcccagcggagagattcataaaaagtgggaccaggacacgaaactgtctaagaacatgggcggtttgacatgtctatgagtcaccgacacaaaatttttgctttgaataaacttcattctggttctcagaatgttcctgtgacaagaaattggtattgg

SEQ ID NO: 508955 - DNA, 193 bp, Homo sapiens
gcggccgcctctactactactactgctcgaattcaagcttctaacgatgtacggggacatgcctgtaatcccagctacttgggaggctgaggcaggagaattgcttgaacctgggggtggaggttgcggtgagccgagattgtgccattgcactccagcctgggcaacaagagcgaaactccatctcaaaaaa

SEQ ID NO: 508956 - DNA, 342 bp, Homo sapiens
cccgtagcacttccttacccgttgatgtcccttcttactgactttccatccatcagatcctttcgcctctattgctcgatcataaatctccatctgtcttagatgcctttggggacgtagagtccagaactttctcctgattgccataatcctgagtataatgtgtgcttacaacgtttaattaacggggctacttctcttggagcagctagtcctggtgggttgtcatggagtacaacttatccacatggtgctgatgtctgactaaggaggtatctcgttatgttttattaatgcgatctgcagaggatgttgatgggacgatagtgttctcctaactgc

SEQ ID NO: 508957 - DNA, 513 bp, Homo sapiens
ccacagactacctcccttactatctcctgttctacaatatgcgctgcaggtaggacagagcaagagacacacaaaggtcagtttgtactacttacaggccgtccagcacaacaactccagaacaaggacttgggaatctgcctaccgggctgtgcatcagatacagtcctcagacagctgtaccgcccctctgtgtcctggctgttatgatagcattgcaatgaggaaagtatctgcctatgtgtgcattgatgggggaaactagagaagtctgtatgtaaagcacatggagcaggccaggcatccattgaagactactgcaggtttgtgcacttactctcatcattgtaatgacacttgatgctataagactataaattagagagatttatagttacaagaggcactgaaaaacaatcactttaggtatgtctaaaatatcttgtaaaacgtgtaaaaataaacaaacccagtcaattaaaaatttagactgttattgaggtaatccgtgag

SEQ ID NO: 508958 - DNA, 103 bp, Homo sapiens
gccgttaaactcagaatctgctgctgccatctgaattctcatctgcctggcagaagttgtctaaaacctgctgatcaccttcggcagcaatggatgagtggaa

SEQ ID NO: 508959 - DNA, 128 bp, Homo sapiens
  misc_feature (99)..(99): n is a, c, g, or t
  misc_feature (101)..(101): n is a, c, g, or t
ggagacgaaacttcccgtcccggcggctctggcacccagggtccggcctgcgccttcccgccaggcctggacactgcgggtggacctgggtgttcatgngngcgcgccggccacacctgcagtcacac

SEQ ID NO: 508960 - DNA, 87 bp, Homo sapiens
  misc_feature (60)..(60): n is a, c, g, or t
acactgtgcaacacagttagaacactgttcaccctgttgtgcatcttgtccccggctttngtttttaagttggtctcaaactcctgg

SEQ ID NO: 508961 - DNA, 192 bp, Homo sapiens
tggtccagtttcatctccagctgctgttctcatgattgtaccatgctttccggggtacttggatcatgtaatggagagggatcccctcatcataagcctgaaggtatgcaccggaaagcatggtacaatttgagaacaggagctggagattaaactgtacaatccaaacgcaggcgagggtcccacactcag

SEQ ID NO: 508962 - DNA, 307 bp, Homo sapiens
caggagaattgcatgaccccgggagacgaaggttgcagtgagccgagatcacgccactgcactccaacctaggggacagagcgagattccatctcaaaaaaaaaaaaaattttaaagagttggagcaaacagggatccatgagtgaaaaaggcccagtcatgattgggggtttgggtaccagaaagttttaaaaagaatggcatttggttaacggtggagggggtccaggttctgggcgtctgaacaaagaatgggcaaaacgcaaaagcaggaaggaatgagggatttacactccaagtgtcaacg

SEQ ID NO: 508963 - DNA, 105 bp, Homo sapiens
gaacaaaattggttttatttcataagatgtttagagacaggcaatggctagtgttgggtcagcagctcagcaatgtggcaactggcatcttcgtggttctcttgg

SEQ ID NO: 508964 - DNA, 994 bp, Homo sapiens
ggggtcccgtgctgctcccttattgggtctctcccctgggcccgactgatctgacttgtaattccttcgtgctggagctaggtgttctgtgccacctttgacgctgccccctactgcccctgtgagcgtgtctttgggttttgtgtgtgtgggagtggggtgtatgtgtgttctctatatcctgagacacctctgggtcgttttgctctggaaacctggctgagggccctgcataccctgtgagcattcttggttgcaacgttgacggcatggtagcgcccaatggctccttgtaccagggccaggttaggcaccaactgctgtcccttatgtctctgcagcctgcacgtgtgtgtgtgaaccgttttcatacgactgacagtgtgaaccgtcaggcaggggcatggatatccagcagcatctgtttatccgaccattttcagagcagttggttatttgctcttgacttgtgacgcgtaggcggggcttacctctctgtgttctcgttgttctttaaccctggctacctcttgacgcgtcttgttggtaccctactacttaacgcttggtggcgttgtgacggactttacacatgccactttttgatcattgcaacactggttgagcaccagggcccaggaacaccaaggtaccgcgggactcacgctcacgtttggttctgccttttactcaacttacgtagggccattcccattcttgcccagttttgcagcgttcagaaagtgacaacaccctcatgacctggcaacgtttggcttgcatggctacgcggttcatccccatgctcaaacctacgacgacacttacgttgtcaacatttgcaacttcccatgaacgttcccagtgcacggtgtacatcttttccaactcgatccgttccacctcttctggcaatcccatccagtgccatctggatattcctttactgtgtggccctgtccaactgtggtgcctatgtttcaccccgatgttt

SEQ ID NO: 508965 - DNA, 403 bp, Homo sapiens
tcgcgaacgtgttatccctaaaagaccatttcctggcccttcagctgcttctgtttctcttcatctacgaataataaattacagtatacaataatcttttaaaatacagcatcattaagtgggaaactgaaagcctgccattgttgttgccgtttaacagctgatacaggtttctggtgatgctactgttgcctatctaccctgaccacattattttttcactgtatcagtggtgtgtcgtatttttttttcgccttcctttttcctttgcgagttatgtcatattttttactgtttagtacttttgcgtgaataagtatcagaaaatcactgcgtcttggaagcatatactttcaggcaggaatgattgtcacgtcgaccccaccagggtaccgagcgcgaa

SEQ ID NO: 508966 - DNA, 307 bp, Homo sapiens
aaaaaaaaattttttagccaggtgtggtggagcacatctccatcccaattactagggaggctgaggcaggaggattgctcaccgtaacctggaacttctggctcaagcagtcctcccacctcatgcttctgactagctgggattaccggtgctcaccaccatgcccaactgatttttgtgttttttattttttgtaaagatggagtctcactcttgcccatgctggtcttgagctcctggtctcaagtgatcctcctgtaatcctagcactttgggaggccgagttgggcggatcacgaggtcagga

SEQ ID NO: 508967 - DNA, 441 bp, Homo sapiens
cccctgtacatgtctttgtgtgtatgtatggggtgagactttacatataaaaattctcatgtcgcattgactaaataacaccttatggttgatgactgttagtacatagcagcaattaaagctcagctacaagttgctgactacattaaagtttttgacagccatagcagtatcacagcctacccaacaattaagaatgtcacatacatgaaaccacagttgtatggaattatgagaaaatactcattagtccatcaggatattttagttaaggaaattactagagatatcaggtgagctggacctgaagaaagaaccagatgccaaataatttcaggctagaactcccaagcgcccatgattaatggatacaagataagaagagattgctgatatcttgaagattgcttattaataaatgatatggaggtgacatgcaaa

SEQ ID NO: 508968 - DNA, 234 bp, Homo sapiens
agtactggcctggcactggtgagtaggctaacttttgtattaggactacaggcgccgccagcacacccagctaatttctcgtgtttttatggtggagacagggtttcgccgtgttggccaggatggtctcaatctcctgatctcgtgacccgcccgccctcggcctcccaaactgctgggattacaggcatgagccaccgcacccggcctccacaaagtactcttaccaaaaaa

SEQ ID NO: 508969 - DNA, 317 bp, Homo sapiens
tggcattggttgtccagtggtagaatatctcgcctgccaagcttggaggcctgtgttcgattcccggccaatgcaagaacgtatagaacatgtaatatcgaccagtatccaaacccctgacgaggaaactctgtgtacgattgccaggccaccagaaatctctggtcttggtcgaattctcaattgactctagaacaatatgactttgcttacatttacagttaggacatatactcattctcaggagactatggtgaatccatggaagactaccagtgagagaggtgatatacttggtgcaaggctttagttgtaaa

SEQ ID NO: 508970 - DNA, 276 bp, Homo sapiens
tctctcacgctctattgtcttttatctcactacacacaagttaaataggccttattctccttctatagtagtctagctatcatatgagtgaactacaaagaaatgaacagaagagcacagtaaaataataagttggcttggcacgccattttctaacactatgtgataatgatttcactctccttggtatcagagatatctgtcaccactgaggaattttacagttgtcagagaactagttaagagaaaacaacttgacttcggtgtataaaatta

SEQ ID NO: 508971 - DNA, 370 bp, Homo sapiens
tcattaaatgtacctcttaattataatattctgataccctaaggcaaattgtgtgttgtgagcacagtactgatataaaaacaggctgctttatagggatgaggtagcaaatagtttcaagtacaaagaaaattggtccgactgagcaatttggcttgttttcaaacttcagcagatgtgtgatcatatcatttgttaattgcctggagtagaggattacagcatattgagtggtagctaacgtatgttttacaatttatttttgccaagaatcaaataaccatatggctaacattaatcaagaaattatgtttttagcatatcccgcccccagcttttttttgtgattaaaaaaaacttcataaagacc

SEQ ID NO: 508972 - DNA, 264 bp, Homo sapiens
aagtcaatcgtctgccccaagacttggaatcaactattcttcaaggattgtatttcatctaatgaagggtaacacaaaatttgggtgatagggctacatgtaagagttggtggtaagcaagagtgccacagctgctaggcgcatcagctcatgcctgtaatcccagctacttaggaggctgaagtaggagcatcatttgagaagtttccaggagcttgaaaccagcgctaggcaacataatgagactctatctcttaaaaatag

SEQ ID NO: 508973 - DNA, 155 bp, Homo sapiens
atgtgagatggaaacaggaagggggcatggcctggggatctggctggagggggaaggagaagcgagagatgagacctcagaatcgacttttgccctggagaggaacgggggaaggaggaaggggcaaggagaccgacgcggtcgggaggtccagt

SEQ ID NO: 508974 - DNA, 641 bp, Homo sapiens
ggccggggggttaactctttgtactgaattttttatccgcgggtgcatgctaccgggaacaagtttttgtacaaaagcttcactcccaaccactgagcattattgtgactctgtctaccactagcctcccgtccctcccgcagaagactgttggattgaacaaaataactatgtatcttgatttacttaaaacgcctgcaaattccttaaggacccgccacttttgactggggatcacctgaggaacactgtcttattaaagcactcaataaatcactggggctgatcacctcccatctaaaaaaaatcaacaccccctcaatctgtgcggcccgcctcgcccaagccactctaaaaccgaccaagctcatgcatgcgggcggaattccagcctcacttggcaactccgcctaataggaggcgaattacaactcctggccgggtgttacaacggcgggactggaaaactctgggttacccacatatacgcttgccgcgaatcccccttttgcagctgccgaaaagaaaaaaggccgcccggacggtcttccaaaaggttcgcacaccgaagggaacggaaaattaaagcggcaaaatctgtaaacaccgcgtaaatccctgtaaaccccggcatttttaac

SEQ ID NO: 508975 - DNA, 1100 bp, Homo sapiens
  misc_feature (262)..(262): n is a, c, g, or t
ccctttgctccagtgaatgttagaagggcatgtacaatctgtcgttctatgcaccaggaagtctatgagatggagactctgcctgagtacaagcgctgaggcttcaactgatcaccgatgtgctgtcctgtccagggaatgtgtgcagctgcgtggtgaagcagattggcgtgggcttgagcgaggccggagactcagtgacaccgacccacactggagagcagagctgcgagttcgaatgtgtcaagcgatgctatagtancatgcatacgcgagtgcccagagccaaacagtgagaagacggccagagacataatgcgcgctcgtgtgcactttgggactctcgggcacaacagcggatcaacaatttgccaatggcaaagggtattgcctagaggcgtgcaagagccacaaagattagcagtcggcacggatgcgatgggataaggacggaagggcgtgggaaatcgacctgcgacgcccataacacctttccgttatggagaaagggtcatggcgtgtgagatgccttagctcgacgttgctctggacctatggtggtctctttcaatggtggggaaaaggggcccgcgacatggttgtgttgctttgtactgaagggcaatcttctgttccacgaaagccttaaattcgccaattccccttgtatatggcgccgcatacccggcgcggtatcttgtggcccagtggatatatacgggtgtaggaatattatattgcaagggtgcatcccagagaaccacggaattttggccagggggttgggagggtaggctcccaagttctcaacaaaagtgccagggtttaggggaacgccaaaaactggaatactagatggcctgttaggccattatggtggtaagaggccttttggcgggccacaaagggggggattaccaagcccagaaaaaatggattccatagggccacccccaagtggacacaatactggccgttctaaactggacaaacagagggccattagagaagacgtctgaaagactcttacactttatgaaatttccgccaccatttaaaaattaacccccgtaggggccccaatgcgcacaccgccgaat

SEQ ID NO: 508976 - DNA, 280 bp, Homo sapiens
atcccggtcgctcggacaccgaggatactacaagcccggatttacacctcgcccacctggagtgcctttgtgaacagacagttcctgccagtgcacggaagtcacaaactggtctatcagttcagacgggggctttggtcaatattcttctgattacttcccaagccccctctgactacagatactaccccctaacagtcctttccagactgcaacaacacccccaggcttcctcttcccaggacaacgaggggtgtcctgggtcccctgggtcttacct

SEQ ID NO: 508977 - DNA, 961 bp, Homo sapiens
ccagaggatcacttgaggccaggagttcagttacagcttgggcagcaaagtgagaccttgtctctacaaaaaaattttttttaaattagccaggtgtggtggtatgcccctgtagtcccagctactcaggaaaccgaagcaggagaatcgcttgaacacaggagtttgagggtgctatgagctatgattgtgccactgcactccagcctgggcaacagggcaaggccctgtcttaataaaataaaataaaattcttaatatgtttatatacttgaaaaactatttgtgtagagacacatgtctgtaaatacacatagatatattgactttttaagctttaattgaagcctttctcttcacaggttttatatatttgactgcagatgactaacagattgaattttaagagtgcgaaacactctggtgctatagggaaggaacttcataaatagcccctcctgtaagggaccagtctttaatttaaaacagtccagcccaggaatcttgcaagaattttgtaattatttgaggagagatgtagatataccctggagttctttgactttaagttattctagagtcatcccagagatggcctagaagacttgaatgtaccccaaaggattctgaatccctttgggaaatttagactatgattttcagtaagaattaaaagccccaggataagcgtggtggttcacacctgtaatcccagcaatttgtgaggccaaggcgggaggatcgcttgagctcaggagttcgagaccagcctaggcaacatagtgagaccccacccatctcaatttaaaaaaagagagaaaaaggccaggtgtagtggctcacgcctgtaatcccagcactttgggaggccaaggcgggtggatcacctgaggtcaggagttcaagaccagcctgatcaatatggtgaaaccccatctctactaaaaatacaaaaattagc

SEQ ID NO: 508978 - DNA, 880 bp, Homo sapiens
tatattttcaaagaaaaaaaaagaattaacatttgggaagttctcccctggaggaagaggggctagtcagaaggaacacgaactgggtcctatgcaggcggccaagtcaggtcacaaacagcttgatgcaaatctcggcgcatggggatttctatcactagcacgcatttttattttggataacaatttcctttcgtcctcgttccttttggtccatggtcttataggttgaggtggtagtttgtttattatttatgtggtattagggttatttatacagaaaaacaaagggtgtgcgggggagagagaaaaaggaaaatttaaaaattcaagaaagaaaaaaaatgtgcccccataagaagaaaacaatgttttgtctcgcgaacagaatgatatctctcatagacataacacgaggagaaatatcccatattagggttccttataactccaagggaaccaatttatttggaaaagtctccgtgggaagtgaaggatatactcatgttggtccccaccagtttatttctacgaacaccacacgcgagaatgttaaacggaatttttttgtggggcaaaaaagagggcgctagcgcgagcgatttcgaggagacccagcctcgattcgttgccacaggactacagagaagtagacgctttcccccctttttgaggccttatcactttttggtcaattttttccaattacaagggggatgtacaaaggggagtgctatccgtggtcctgttgcagaaaccaaagtacagtggcttgacttcggtggaattgcccacccaagcggaccaatgtttacccaagggatgtgcgtggcaagaacggcttaataagggggcaggccactaattgttggggcgttca

SEQ ID NO: 508979 - DNA, 117 bp, Homo sapiens
gataaataatatcctcgtagtccgcagctgctggctcaggtaaaacctctgtattagtagagcgtgtaattcaacgcattgtatattaaacatgcgacatcaatcaaatactagtcg

SEQ ID NO: 508980 - DNA, 264 bp, Homo sapiens
atagcgtcgatcctcagatgtcgccttgatcccagcctacattttcacacttctatgtagcctctacctgcgcgacaactcattcctgtcgcgcaccaatcacatgcctatcatatagtcaaaaccagcccatgacccctaacaggggccctctcagccctcctaatgacctccggcctagccatgtgatttcacttccactccataacgctcctcatacataagcctactaaccaacacactaaccatatactcataaagacg

SEQ ID NO: 508981 - DNA, 461 bp, Homo sapiens
ggtgaacaccctgcaagcagctgctctccgtgcgagcttgaagaagaacactggctacaaggggacgttgccgaatgttctccagcgctctgtataagacccaggcttgctagactgtactatacacgtcgggactggcaccataaacggagatgatgccgaaaacgcaaggcgaaggccaagccaggtatgtgtgtgtcggctgtgatgaaggtggagtggtacataacgtgtctaggaacttgctgctagttggatttattaaaagaatgtagtcttccatggaaagaatcgggctttcaaatagacttcatcagtattctagtctctcttcctaatcatgtattgaagcatttttcttttgccacttcattcatctttacgctttctttgtaaaaaaatgttaaatgacatatttccctgttttctatatgaagtgtattcccacttagtaatatgag

SEQ ID NO: 508982 - DNA, 222 bp, Homo sapiens
tcttacatattccacttacagtaagggtgaatgcattaaacaaggctgactgcaaattggatgtagtcagattgaatgctcttgtcatatttctattggttagaaaacagaacaagccacatcatttgaggcatgcctcatgttccatccctcaatgctctaagactagaaaaaattgttgttctgaatatactattaggagatcaatagtctatttatcac

SEQ ID NO: 508983 - DNA, 799 bp, Homo sapiens
  misc_feature (426)..(426): n is a, c, g, or t
catgatttacaatgatatggatttgtaaacctgtttaacatgaaccagtcctctagggccgatcatgttaaacgagatttacaagatatggatttgtaaaccgtctaattcgcgagtttaataatcagtcagacaaatattcactctttccttagtgattgtgtgataattagtttattttttatttataataattatatagaattcaacggcatttgaacgagcttttagcagctcagtatactagtcgttgatgtcacttaacgattctagttcaggattacttgagagaaggctatcgggacagatgtctatccgtcaactatttgggacttatttcgctaatggtgactggagtaattaatagcgacatagacggccgtattacaccgcatagtaagttttcatagagaagccatctgttgntaagtaaaccacaattattctcggtaacgtctaatccttacatattatccgcaaatcaagctagggggacgaatgctttgtgagaaagttaatacaatttactcgggggtactcaaataccacaataagcttttaactctaatattctagtgagcaggtcttgttaccatcgatcgacatttgtgagggaaaaccttcacctctggccaaactcctgcacagtcacattatgtgtgaagaacagtgtacacgtaattcaccacaaaatgctcgctgctgtaaccttgatcgccactagagtaatgctcttgatcccccaataatgataatggtcctatggaaaacacagtcatgggaagaccaacttatttgc

SEQ ID NO: 508984 - DNA, 393 bp, Homo sapiens
tgatgataagttggcctaccccagtttttttttctggtctataagcatttacccccccggccccactcccccccttttaaagaaaaaaattgaaatgtaaggctgtgtaagatttgtttttaacctgcacagtgtctttttttggatagttacccccccccgaatgtgtctttaaatagccccgtcctgggggtattttcaaaagcccccacccctgcctggtccagtatgggggttgtaaattggcatggaaatttaaaacaggttcttgttggggccccgccccaattagttatatatggggaggggagttttttcctcctccggtgtctctgatccagcttatacgaaaaaattgttgttttgttaactgaatccccccccgtaattgca

SEQ ID NO: 508985 - DNA, 185 bp, Homo sapiens
  misc_feature (83)..(84): n is a, c, g, or t
tttttttttctggcaaaaatgttgtcccttgagactggccacagaaaaccccagttatatttgagtaataactacaatgtagnnaactagattgcattataggtgtttcggtgcatattaatccttcttcattacaaaaacttcagataacttctactataggacttatcatattgaatgtttca

SEQ ID NO: 508986 - DNA, 190 bp, Homo sapiens
aattcgcggccgcgtcgacgaacttgtagggtccggcgcaaaccggatgcaggccgaacttgtcgcctgcttccttcacggccttcggcgagaccatcatgccggcgcggtcggtcaattgggcgatcagcggcgagtagggcgtcttgagcaccagcttgatggtcaggggatcgacgacgtcggcctg

SEQ ID NO: 508987 - DNA, 659 bp, Homo sapiens
  misc_feature (22)..(22): n is a, c, g, or t
  misc_feature (66)..(66): n is a, c, g, or t
  misc_feature (76)..(76): n is a, c, g, or t
  misc_feature (103)..(103): n is a, c, g, or t
  misc_feature (109)..(109): n is a, c, g, or t
  misc_feature (112)..(112): n is a, c, g, or t
  misc_feature (158)..(158): n is a, c, g, or t
  misc_feature (166)..(166): n is a, c, g, or t
  misc_feature (301)..(301): n is a, c, g, or t
  misc_feature (430)..(430): n is a, c, g, or t
  misc_feature (469)..(469): n is a, c, g, or t
  misc_feature (546)..(546): n is a, c, g, or t
  misc_feature (549)..(549): n is a, c, g, or t
  misc_feature (580)..(580): n is a, c, g, or t
  misc_feature (587)..(587): n is a, c, g, or t
  misc_feature (652)..(652): n is a, c, g, or t
gggagggggggccgagggaccnggggcactgaccaggtcggggtcgggggcagcctctgcctgggngaggccgggngaaaagggctgcgggggccggacagcntctggngcngggcctcagcggagacagaggaccagaggtcaggtccctgggggcngagccttnctcagactccggaggaaaaatgtcccagcccagcaggcagtcccggggcagggccagtgtgtgagaggcgtcaaagcccttccgccggtggatgtggtaccggtgcgggggccccaggatcgacagcgggaggcncaccctgacgtgcgcgggctgcgccagggtcccagggccctgctggtctcgcggtgtcctgcacaggcggcagggggtaccgggatccacaggcaccgggaacaggcgccggttgacacggtaacagtncacgcattcatggtcttcctccacgccgctgccactgcnctcacgcaggcctggcaactggggtccaggatggctgccgacacactcctccttgtgggtttcccgaaactcctgcngcntggagaagaaggcctcaggctggctggtganggaaganctggtgttcagagaccctgcaatccagttatagcccaggtatggcctgaggcgccaccccctctnaggaact

SEQ ID NO: 508988 - DNA, 457 bp, Homo sapiens
ggcgtgaaaaatcggtgatgtactacctctgctgctcgaacacacagccacatttgatacacgatgacaccttgcttgttagagaaacatctaacacatctagtagaatactatgcaggctggttggctaccagtttcctgtctgaggtgtatatgttaacttcgtgatcagtttgtatgtaagggactcttgtcctatgtaaagttaaggtgcgccgggtgcagtggctcacgcctgtaatcccaaaggtgttctttttatattctgaatattacccctttatcagatacgttattgggaaatatttggtctcattctgtaagttaacttttctctctgtagatcgtgtcttgggatgcacaaaatttcttaagtttgatatagtcccatttatctaatagggctggtgtctcctttccttagggcgtcatatccaagaaattctttgccaaaatc

SEQ ID NO: 508989 - DNA, 409 bp, Homo sapiens
cgggcgcggtggctcacacctgtaatcccagcactttgggaggctgaggagagcggatcacctgaggtcaggagttcaagaccagcctggccaacatggtgaaaccccatctctactaaaaatacaaaattagccgggtgtggtggcacatgcctgtaatcctagctactcgggaggctgaggcagggcaattgcttgaacctgggaggtagagtttgcagtgagctgagattatgacgttgcacaaaatacaaaaattatggcatagcacgtgccgtaatccccactactgaggaagctgaggcagcagaatcacttgcgcccaggaggcagaggctgcagtgaactgagagcttgccactgcactccagcctgggcgacagagcaagactctgtctcaaaaaaaaat

SEQ ID NO: 508990 - DNA, 176 bp, Homo sapiens
  misc_feature (10)..(10): n is a, c, g, or t
ctcttgaatngaatattaatagaatatgatagtccttaacaatgcatgcttggtcaacagaaaagctgataaaaacaagaatttacctatttatacttaattttgttttttctaatacatttctttgtaattgatataaaaattaattttggaagttcctctaatttgggttttct

SEQ ID NO: 508991 - DNA, 389 bp, Homo sapiens
tagccacttaaacaattctacaaaaaaaataataaaataaaataggccctgtctggtgctcacacccgtcatcccggcacgttgggaggacaggcgtgagccactgtgtccagcctttttttctttttttgagatggagtttcactctcgttgcccaggctggagtgcaatggtgcgatctcagctcactgcaacctccacctcccaggctcaagcaattctcctgcctcatgtaccggaggctgctctgagccgagatcattcacgccgtgctccagcccccggatgacagaatgagaccctgtctagaaaagcaaaccacaaaaaaaataaactttttgaggaaaaccccaacagacctccagagcccgtgtgaggaggggtgtctg

SEQ ID NO: 508992 - DNA, 348 bp, Homo sapiens
gatatattgactatttctgctgcaaggatgggatatgcttgctccatttactcaagctttatatttattctttttagagacagggtctcgctatgttgcccaggatggtcatgaactcctgggctcaggcaatcctccctcctgaataactgtgaccagcaccgagtcactgagcctggcttattcaagccttaattttatgtttattgatatagttttacagtttccatcccagagatcttgcatatttctcactatatttattcctaaatgttttcttctgctgttgctgttgtgaaagggatcttttcctgaaatacattgtcctacctggtttttgataggaaa

SEQ ID NO: 508993 - DNA, 398 bp, Homo sapiens
tccccctgggattacagtgcgcccaccacgcctggctaattttttgtatttttagtagagatggggtttcaccatgttagccaggatggtctcgatttcctaacctcacgcctttaatcccagcacttcgagaggccaaggcaggaggattgctttgctcctgaagccaggagtttgagaccagcctggacaacatagcgacaccctgtatttacaaaaaatataaatttttaatcagctgggtgtggcgacactcacctgaagcaccttagcctcccatgtagctgggactacaggtgtgcaccaccacgcctggctaatttttttttgggtagagacgaggtcttgctgtgttgtctgggttggtcttgcctaagttcagagccagggggtaccga

SEQ ID NO: 508994 - DNA, 327 bp, Homo sapiens
tcaaggtaaacaattttaaaataaattttctacttttttttttttggagacaggggggtcactctctggcccgggcgggagggcaggggtatgatcagggctggcggcagcctcaacctcgggggctcaggtgatcctctcacctcagtctcccacatagcggggaatacgggtgcgcgcggccgcaccgggctgatattgggtagagaggggtctcactatgtggcccaggcgggtctccaactccgggactcaagcaatcggcccacctgggcctcctaaaatacggagataacgggtgtgagccaccacaccgggccccaaata

SEQ ID NO: 508995 - DNA, 1041 bp, Homo sapiens
tggttctccctggggtccgggttctgtgtttactctcggaggccatctgcgccctgctagtgtactcagggggcttctaggttctccctcccgttctttgtctgtcttggtcctcccatggtgggtggccccttgttgtcgtctgttccgcgctatgcgtgtttttggctagtctagcgctatcctttctgttcgtttcgttagtctctccttccttgtgctccttggtttggttatccctggtttccctgttctttacctttgctctttgtgggtacccttgatgttttcgcttccccggttccgggtgtttcctcggtgcctccctgggtgcccgcgcctagttacggagcgtatcgaccaccccggtgtggacccagtaccttcggggccttttcttggggcccctccagcccccgtcttatgttctgtcacagcattgtgcctttctggctcgcctgggcgcttccaggtgtgtcaccgtggcttcctaagccaggggctcccttgggctatttggtggccgactcttgtaagcagatgactggttactgaagggccaatggttccgagacccatcgatcctgaagcccgttcactctgtatcccgcgttttaactctgggagagcaaggtccaggagctcgacatcatctgagcatgttgtgctcttgcatcgggctccactggcttgcatcctgtgctgtgttcacagcattgtttgctgctgccatcgttccccagtactgtgccaggccttctccccctccccagtgtcctctcaatctcaggcaggctcattgcacccatatggactgggccaggcacatggcagtgatgacacgaggccaatagtcgagtggatgagcgggatcctaggatctgatctgtagcccatgctgatgtaacctcactcagggcaatccatctggaggcctgagcaacctggcccaggaccctggcttcatcctggcactgaccaggaaagactgacctctgaccctcttagcagacagaggcccaggcatgggagcactctgga

SEQ ID NO: 508996 - DNA, 177 bp, Homo sapiens
tcaatctttcattggcatttcaaatggcatttcaacatcagggtcatgaaagtaaagaatggtttccccaagtaatatctggcaccaggaacttaaggtacttaacagccatttacaatttccggcaaagccagatgtcgactggggtgctgtcagagccaatagaatgaggatcct

SEQ ID NO: 508997 - DNA, 584 bp, Homo sapiens
gacagatcacctcttccctgcatcagctcctacctgtgcatcgccccatatatactagggtgtagtatagtgtatgtagtgtatgagtgtgtataaaaaatctagtcccaccacacaaacttctctctataaagcagataacagggaagaacaataacaaaagcaaaacaagccaattgctctctctttgggatatgattcatttcccttgtgaatgaagtattcaacaacataagaaaaggaaaagaacgatttcttttgtatactccctaaacacacagagtttactgggtcagatttaactgtgagcatttatatgcctacttccaggcatcgtcatctgatgtttcactgctactggtttcggtgtctgagtcctcaaactctgctttgcaagtgcttctccaaggggagaacaggctggaactgcggctctgcaagaagccattcttcccaaagccatttcttctcagctgctctgtcttcatgtggaactccttgagctcatcctctgtgaggggaaggccattctcatcattttcaggatattcctgccaacccatagctttcaataccctgtgctc

SEQ ID NO: 508998 - DNA, 396 bp, Homo sapiens
  misc_feature (47)..(47): n is a, c, g, or t
  misc_feature (57)..(57): n is a, c, g, or t
taccgggccagattaaggttaatataatggccagattttggtttttnaaccctttangggaaatagggataaaataccacattaccggtataaaccttaattttttttaagacctcagcataaccctttcctttagtcccagtagatataccttcacctatttttgtgtattacccatttagtccactattttatgttttatttttattttttgctttttgaatggagaagctgtttgtttgttttaaaaataacagctttatctagctgtaattcacataccatacaattcacccttttaaaatgtaaatgggctcacacctgtaatcccagcactttgggaggctgaggcgggcagatcacttgaggtcagttcgagaccagcctagccaacat

SEQ ID NO: 508999 - DNA, 167 bp, Homo sapiens
ttaaaaacaacaattgtaactttttattagaggggattcatccttcattggcatttagctgtggggaataaagaaagccacaaagctcattagatatacctcccataaaatacaatacatagtttcaatttcggttctaaaagccaatgttattcatgcagtcgaag

SEQ ID NO: 509000 - DNA, 152 bp, Homo sapiens
cacattggcatttatacgcaggcgaccggtcagaatatacatcggcatatgcctcgaaggaaatcgcaaaggccacggctttgtaaccgcgtatacgctggagctctcccgagcacgataagttgatggatgcggcatcgagcgaaattcgc

SEQ ID NO: 509001 - DNA, 158 bp, Homo sapiens
ttgtgcttcgggacggcgggatgggacacccaacactttttcacttcttcagagggaaactcagatgtccaaactaattttaacaatacgcattaagaggtttatttgggtacatggcccgcagtgggctctctggcccccagaaaggggaacaggaa

SEQ ID NO: 509002 - DNA, 131 bp, Homo sapiens
agaggacagcccacagacttgctaaagagacagtatgaaagttcctgagtcaatgagcatcctacactgtgtatatgatggaagctggagagaaagctaagaaatggtctagttcagatggtctcatttat

SEQ ID NO: 509003 - DNA, 130 bp, Homo sapiens
gcctgcgccgactatagaggatacccagctcgttctaccactccatggagaagatggggtaaggaggggttaacgcgaataacacagctgtctatctaactatgcgctgaccccacttactttttctaca

SEQ ID NO: 509004 - DNA, 534 bp, Homo sapiens
gtgccccacgtgcttaaatggcgctggtcatcatgcatcccgctggtgcttgtggtcggtacttacgacctgaagacggtggtgacggtcagcgtggtgcagttctcgctgttctttgtggacttctggttccagctcgcccgctggatcgacagcaccatcctcgacgcactctacggctgggggtggggctggaaccggccgcactcgaacttcgatccggtgatggggctgaacaatgccttcggcgacatgttgctgaacttcgtcatggcgacgatgttcttgattcttcctgctttctgggttactgcgcttgcgtggacaggtatcagggctggcaacttcctccaaggccttgcaagcggcacaagggatgccggacaagccggtggcaaaggtgccggcgccctcatcagtgcagccaagaaatagtgcctagcgattcaatcgtcctcaaaccgagggtcagggtcatcgttgtaagaggcgggatggtaaaacaagccatcccggtgatcacgcgggttaact

SEQ ID NO: 509005 - DNA, 440 bp, Homo sapiens
  misc_feature (148)..(148): n is a, c, g, or t
taggtttctacactgacccagaagcttaaagaacactgcatagttaattaccaagttaaaacgttttctgggcaaactcatggctttgtgcatcggaagagagaagactgctcccctgctgacaagccctacatcgaggaggcaaggnggaacctaattgaatggctgaacaagtatgtctaacagcacccaagcacaaggcagctgttgcccaaatttgcctgaataattaaccatctcttactatccatgatagcatgactgttaggggaactgggggcaattcagggaccagctagattctcagatatggccttacattggtaattcaagtgttaaaatgtacaaaaccaggaagagcagttgtcactatgtatattcaacttcccctaatgagcagtgtcgacattcaacctaataaagtgatttttaaaacttga

SEQ ID NO: 509006 - DNA, 364 bp, Homo sapiens
gcagcggcgccctttttttttcatttccttcatttcttttggtggcttgctcctaaccactctgccttctgcatttcctttctccctggggatgtacagaccacgaccaaagtaatctgcatattataagtctgcgttgaaaaacaaatgacgcggcgggtgtggtggcacacacctgtaatcccagcactttggaaagccgaggcggttggatcacgaggtcaggagatcgagactatcctggccaacacggtgaaaccccgtctctactaaaaatacaaaaaatcagccgggcatggtggcgggcgcctgtggtcccagctactcgggaggctgaggcaggagattggcgtgaacccagaag

SEQ ID NO: 509007 - DNA, 372 bp, Homo sapiens
  misc_feature (168)..(168): n is a, c, g, or t
tggttacagggcatgtacggaccactttgcgtgacccttttgtgagctttggttgttggacgtgagtgagctgtgctcttgtgctggatggagccagggtgggtccggtggccatgtccatccctcttctgtgacatcaggcagtagcctttggctatggagacagcnccagtgcagggtgttgggatattgcagggccaggattgagccccgcagacctccccagcccctagctcaggagagagtaagccaggcaggtagccagggggactagcccttgtggagactggggggcttgatattgtccccgtggtctctttctttcctttccccagccaggggtgtatttagtcagcaggggctccagtgtgg

SEQ ID NO: 509008 - DNA, 563 bp, Homo sapiens
gagatggggattcaccacattatccaggctggacttgaacttctaacctcaggtgatccggctgcctcggcctcctaaagtgctgggattataggcatgagatgggaggatcactcgagcctaggacttccagagcagcctgggtaacataaggagaccaagtctctataactaattaaaaaaaaaaacaattagctgggtgtggtgatgcaagtctgtgttcccagttactcgggatactgaggctggaggattgccagagcccaggaagttgaggctacagtgggcggtgatcacacccctgcactccagcctgggcgacagagcgagaccctgtctcaaaataaaataaataaaacaaaatacaataaaaacatgtttagatacacgtatacttacattgtgttacaattgcctacagcatttagtacagtaacaggctgtgtaggtttgtagcctaagagtggtagctatactagatagcctgagtgcgcagtaggctatataacatctaggtttggataaatacactgcttgatgttaacacgacaatgaaaatcgcc

SEQ ID NO: 509009 - DNA, 805 bp, Homo sapiens
  misc_feature (388)..(388): n is a, c, g, or t
  misc_feature (399)..(399): n is a, c, g, or t
  misc_feature (431)..(432): n is a, c, g, or t
  misc_feature (434)..(434): n is a, c, g, or t
ggagggcgggagtgcaggagcgtggccaggagctgctgggctgtgagcggcggcgccgccatgtccgactagcgagaagctcacacctggatctcgatcatcgggcgcctgtctggaagtgcagggctcgcggcctggtcaatggaatgtcacagctgacatggagaacgagatccgcggtctgtgcctgaaatcccgggagatttgtccggagccagcccattcttctggagctggaggcagctcctcaggatctgctggtggacatacacgggcagtactacggaccgttcgtgccgactattcgagtatggctggtttccctcccggagagcaagtagctcgtttctgggggactatgtggacaggggcaagcagtccttggagnccatctgcctnctgctggcctataagatcaagtaccccgaganntncttcctgctccgtgggaaccacgagtgtgccagggatcaatcggcatctatggtttctacgatgagtggcaagagacgctcacacacatcgaactgtggaaaaccttcagtgagctggcttcaactgcctggcccatcgcgggcatagctggaggacgaagatcttctggtgccacaggaggactgtacccggaactgcagtctatggagcagattcggcggatcattgcggcccaagatgttgccttgaccagggactggtgtgtgactgctgtggtctgagccttggaaaggacgtgcagggctgcggcgaaaacgaccggggagcatcttgaccttatgagccgacgtggtggccaagttcctacaca

SEQ ID NO: 509010 - DNA, 707 bp, Homo sapiens
tgatgatggttgtgtgacagggggaagcaggatctattggtttcttccccctccccccaccccttccttttgtctctctttttttttctctaagaaaatcaccagactagtttttccatcttgagtaatttcttatgtgggacagttttgatcctcattttgaaagcatgcgtgtgcacatgtgtgttgcctgtggtgccaggtgagacaggtggcactaactccagctgcttggaaggcatcccaagggcgcatcttaaagttggagcagacctcccttttccagcccctggggccattagaccacgtgctggaactagcattgtaaaattcccatcccagttccactcccctgaagtgaaacccttttttttttggtgacagtaacttcttaaaaatcatggtctctttatgaacattctcctcaggtttcttctctgctgaaaatgtaagccaggctactttcaaaggtatctggaaattcggtgcctcatgggaaactgatatgctaagggcctccccaaacccccgcagattttttcttttaatacttggtccttgtacaagtgggtaggctgggcatgcgtgcgttgcctttagggcagcattttaaacctttgccaaacttggccattgccgacatgtacattcttctgctccacctaacttaaaacctaatcagctatttttatcttacccttctggtg

SEQ ID NO: 509011 - DNA, 774 bp, Homo sapiens
gtgtctctttggaaaagtatctccgcgtaggaaacaacgtttttaattacgggcctaacaggaaagcagtagggcgttgcgtgactcttgaagggtgctcaccaccccctcaagccagaagggatttagtgttacttctacagagcccgccagggcctcatctttgggcttaatgagggggagacgtgagcataattcaaacagtcgcaagctttgggcaggtaaagaagtcaacaacaccggggtcgaaacgtcgagcacttttgccattggaaccgctcacaagtacttgcacggttatgtataacaataattcaacgcgccccaacttttctctaaattgggagaattaagcgaacatgtggcccgacactgtacttggcatttgttgtgggggtaataaccaacaatacaactttgtcaacggggacatctgtggcatgcaaccaggaacttattcctcttacggtgaggaatgcgcggctgaacatgaattcctctcgtcaccacgataaaggagtcacggtgatctaccgctccgcttgttatgagggtcatgtctacttgttatgtatatatggcaacggaccggccctcaagtatcgaactggaagtagctcgacaatacaagcgaattaatcggactttcgcccgaccgcgtcggagaagggaaatacttcgtgatggtggcctaacctaaaaggagctgggcagacatttcggagccaactgacttatggcttagtcggccccacggcggtaagcaacattcct

SEQ ID NO: 509012 - DNA, 175 bp, Homo sapiens
acaggctctgtgtataagcgctgtacatattgagagcatgttcttggccagcacctgctcgtagagagtcagtcacactggtacatttcagctagtccggaggctggcggtcagatgttatcactcagtatctcagcagctctcttgcacttgaccacatccatagacccatctt

SEQ ID NO: 509013 - DNA, 202 bp, Homo sapiens
  misc_feature (177)..(177): n is a, c, g, or t
tgtggagaggggtctcacccgtcgccaggcttgagtacagtagtgctatcacagctcactggagccttgaactccggggctaaggatcctcctacctgagcctccggagtagctggggactggtagggtctccctctggtggtccaagggctgggagtggtagtacgtgctatcacnagctgactggcgagcctcaaccttc

SEQ ID NO: 509014 - DNA, 200 bp, Homo sapiens
  misc_feature (23)..(23): n is a, c, g, or t
ggcggacgggccccccgcggcanacggcgaggacggacaagacccccacaacaagcacacttttacacagggccacatgtttcacaggacgggggatttcagaggcgcgcgcgcgacatttgctcaatatttctttcgcgcccctctgtgtgtgacactctccaccgggctctcagacccccttttggagtgtatccccg

SEQ ID NO: 509015 - DNA, 504 bp, Homo sapiens
  misc_feature (34)..(34): n is a, c, g, or t
  misc_feature (450)..(450): n is a, c, g, or t
caccctccctccttctgcttccttttgctcccgngctcttccttccctccctctcgttttttatatttattttatggtgaatttttgtttatgttcctttacttatattcgcggttagggcacttgtttcttaatgacttaataggagttctttacatatttaagacattaatcctttgttatatacattgcgggttttttttctatttggtcatttaccttaatagtgggcttgtggcagatattttaaatgtttgtgctatcaagtatgttagtctttgcctttatgattttggtgggcagccatccttggaaaggcctgagaagaaaggcaggtccttgatcacagagagtctgaagtttatctttgagtagtatcagagccattcagagtagtggggtttaaaacatacatttttgtcttgtagagacagggtttggctatatggnccatgctggtctcagactcctgacctcaagcggtcctcccacctggggctccca

SEQ ID NO: 509016 - DNA, 190 bp, Homo sapiens
aactgcgtatcattcagtgtgtgaggtggaggcggtggggctgtgtagcctggtgtaactccctggttgtagggtggtggctgtaactcggctggaaagtgacgggaaaaaagccaaagtctgtggagggtgtagctgtgatggtgggggtgctggtattggcgcttgagccaggcatgttgctgtactt

SEQ ID NO: 509017 - DNA, 284 bp, Homo sapiens
ggccagagccggggcactttcacagtttgaaggtcactgatagcagaggggcctccatttcaactccagaagtgcggctctgggagggatgttctagccctccctgacatgtcagagccagactctgcctggaggatccctgcatgcggctcctgtcatcctctacactttggccaagcatgaggtgtgagaaccacttggctgctcatgccttctggaggacacacagtctcagtccagatgcctctctggctttctggcccttgctggaccagatcctactc

SEQ ID NO: 509018 - DNA, 233 bp, Homo sapiens
ccaacattggtatttgggttttttttttttgagctgtcactaggctcctgaccttccctctgaactccaccctgcagggcaggccaacagacaagctttctttctttctttttcttttttttaatataagagggaaactcgttctctggcccaggctgaaatgcagtagcacaatctcagttaactgcaacctctgcctcccgggttcaagcgattctcctgcctaagcctcc

SEQ ID NO: 509019 - DNA, 140 bp, Homo sapiens
gctgtgacatatggtgattgttggttaagagacttggactctagtcattggcttctttcagtcttctactgtcacctcaggcagacttcatttagacgaggaagcctatctgtacttgaagattgactttgaacatatgt

SEQ ID NO: 509020 - DNA, 1126 bp, Homo sapiens
  misc_feature (334)..(334): n is a, c, g, or t
tggtctgtcgtcgtcgttctgttgctttgctctgtctccctctgtttttgtctcgcgcgttttgtatctctgcgactgtttgtctcctgctctccttctctgttttggctgttattacacgggtcatttcccttgttttttctcttaccagagtgcgtgctccacggtttttctcccgggaccgccatgggccacaagtgctcgcctgtgccccaccgcccctttggggtgtctcccctgggggggccttactggccgcgccagcctctcgtgcgcgctgtcggcctttccgtccagggccctcccgcccagccagccgcccttttcgtgtganacattcttcagggcgggcaaggggcccaccttctgcttttgtttacccatctctggccgctcacggttacccttctgaaggagccggactccgcccagaattccccttagaccggggctgaaggagtgtcccccctctgatgtgaaaagaaaattgttttattgcgtcacttctgactgttttaactgtttggctgcaacttcccgctttagtttgagatggaaatatataaattttcgtagacttggaagttgaagagggccgaattccccacgcttctcacatccattgtgaatgtgtagcacatgtctgccctctgaactggaacactcacttggcccgttaaacttttcttctggggcactacccggcacagtgtgcaccgaatggcccacgaactttggaggcccaaggcacacccctggagtcacgtccagcactcactataagaatattgggtgaacaccccacctgtttaaaaatttaagtctttgtcccttaacagaccaacttcacgtggttatattattaaaacgttgtgttacttcgctcctataattaaaattgatagagaagaattttaaaaatgtgttttgctttctacctattcacggaactgcgaactagggaaaggttggtatgaaaaaatgtctttccttttttgacatgtaacactagttcaactcttttctttgttaccacttagaactatatccctggatatcacgtctgctttggactccttctgctagtgttaccagatggaaataaaacccttaatttgaacccaca

SEQ ID NO: 509021 - DNA, 905 bp, Homo sapiens
  misc_feature (6)..(6): n is a, c, g, or t
  misc_feature (72)..(72): n is a, c, g, or t
  misc_feature (88)..(88): n is a, c, g, or t
  misc_feature (99)..(99): n is a, c, g, or t
  misc_feature (145)..(145): n is a, c, g, or t
  misc_feature (179)..(181): n is a, c, g, or t
  misc_feature (189)..(189): n is a, c, g, or t
  misc_feature (219)..(219): n is a, c, g, or t
  misc_feature (234)..(235): n is a, c, g, or t
  misc_feature (302)..(302): n is a, c, g, or t
  misc_feature (304)..(304): n is a, c, g, or t
  misc_feature (329)..(329): n is a, c, g, or t
  misc_feature (374)..(374): n is a, c, g, or t
  misc_feature (385)..(386): n is a, c, g, or t
  misc_feature (389)..(389): n is a, c, g, or t
  misc_feature (396)..(396): n is a, c, g, or t
  misc_feature (401)..(401): n is a, c, g, or t
  misc_feature (405)..(405): n is a, c, g, or t
  misc_feature (441)..(441): n is a, c, g, or t
  misc_feature (452)..(452): n is a, c, g, or t
  misc_feature (458)..(458): n is a, c, g, or t
  misc_feature (466)..(466): n is a, c, g, or t
  misc_feature (471)..(471): n is a, c, g, or t
  misc_feature (505)..(505): n is a, c, g, or t
  misc_feature (509)..(509): n is a, c, g, or t
  misc_feature (514)..(514): n is a, c, g, or t
  misc_feature (516)..(516): n is a, c, g, or t
  misc_feature (518)..(518): n is a, c, g, or t
  misc_feature (525)..(525): n is a, c, g, or t
  misc_feature (528)..(528): n is a, c, g, or t
  misc_feature (533)..(533): n is a, c, g, or t
  misc_feature (536)..(536): n is a, c, g, or t
  misc_feature (542)..(542): n is a, c, g, or t
  misc_feature (561)..(561): n is a, c, g, or t
  misc_feature (614)..(614): n is a, c, g, or t
  misc_feature (621)..(621): n is a, c, g, or t
  misc_feature (878)..(878): n is a, c, g, or t
aagggngaggggttttacacaacatgaaagagggaatgcacggggtagggaagttgctattgcacccaggtnacaaagaacacagagngaccaacaggncgcatggcagaactgcatagaagatcgctcagggctcacgtcaggnaggcgcaggaattcagaaaactctaaagcttggnnntgctatcntttgtgccacaaagattaccctgaaaaggnagagagaggtcaaanngcagaaccaaattggggattttcaaaggctgctctctaacagagtttaaaatatccgtaaacatatntncttctgctccctccccttgccttcngcatctggtaaacactttagaaacttaaaccactgttagcatgtnagattgtagannggntgttggnttttntttnttctcatcttgtaccccaaacaacaactctactggnaattgtgatcntgtgantcctctgnttggnaacccggtgagggtcaccaagggggggggtctcngtgntaccngngngataccngcngtgcnaanggttgnggggttctgtgtattattnggggggggagagctgtaagacacaggaatcccaatacgtaagtgctaaagagnaaaaganaactcctttcactcatctattcattatataggaaagagcaaaaagacagtcaaaaccatctgcttcgagcagcagcacagcccagcaatacaggcataccaacaaaccgaaagcaaacactcaggaaagagcctcttggcccttctcaaaggagacttctctcagactggatcttgcccctaatgtagagaccaaagcattataacttcagagactggtactcttgagggagttgagaggtaaggtctaagagaccnaaataacagactgttatcaggtactaa

SEQ ID NO: 509022 - DNA, 133 bp, Homo sapiens
gaacttccccatgttgcaacataaagtcctaggctgcgcatgatggctcacatctgtaatcccagtgcttagtgaggcagcggtgaaaggatgacttgaggtcaggagttcaagaccagcctgggataacata

SEQ ID NO: 509023 - DNA, 499 bp, Homo sapiens
  misc_feature (48)..(48): n is a, c, g, or t
  misc_feature (164)..(164): n is a, c, g, or t
cctcccaggttcactgccattctcctgcctcagcctcccgagtagctngggactacaggcgcccgccaccatgcctggctaatttttttttgtatttttagtagagacggggtttcaccatgttggccaggctggtctggaactcctgacctcaggtgatccgnccacttccacctcccaaagtgctgggattacaggcatgagcaaccacgcccagcctctttccatctcttggctctcccttgtatgtgtgtatgcttcattttctctgcctgtgggctgccttctctgtggggaggtggggcaccagtgcattgggcataggtggcccaggtttgcatctccccagtttagaaaccctaggggaacgagagagcacaccccctccaggtaagccagacagtcgctagaagtgctctaatcaccccagctagggtcacatgctcattcagggccagcactgtggctggggttctaggattgtaaccactggggcccg

SEQ ID NO: 509024 - DNA, 407 bp, Homo sapiens
ttagagacgtgtcgcatgttatactgataaaaggttctatacacacatttagagatatgtgtgtgtgtgtgtgtcggtgtgtgtgtatatttattttacttttttccccccaagatggagtctcactctgtcgcccaggctggagtgcagtggtgcaatcttggctcagtgcaatctccacctcccgtggttcaagtgattctcctgcctcagtttcccaaagtgctgggattactggcatggcactccggccaagacagcttcgtatcccctaggttctgatgaggtgctctatggtactgctctcagggtataactgcagactagaagagtggtaagcggtggtctagaactggcttctccgcaacagtgtacctgtgcttggcttggcaccgagggtctctcag

SEQ ID NO: 509025 - DNA, 1286 bp, Homo sapiens
taaaaccctctatcaataaatggagacattatcagaaaattatgttcaaaccacattttacaaaatgtgccagttatcagggcggggagtttcgaagccaaaggtgagtgttgtggagtgttaaaggtgaaattattagtgtgggggatgtgaagcaaatagtgtgaggaaagtttgagcccaatataatgtgaccgttagaagttccggtgagaaccccgtgtgtggctaccaaaaaattgttgtgagcccgtataaattgcccgctgcggaaatgtgggtgaagggagacatcgaagtatactcgtggagggctggtatagaggagggtgtacaactatagaagaacccagtataaacagtgtggtaatataagcacagggcgctggaaatctatactgtggggttcgccggtgtggtcttccatatttagaactctagtggtggaagctcctccaggtgtgaatgtgacaatacctcccgtgaagtgcagacagttcacataacgggaatgtgtgtttacaggagagtgtgggacacattacatagggggaatataaagacgggggggtgaagtgccgtgtgtgtgggggggcccaaggttgccacccctcccataaagtgggggggggggcataaggggggcataagaggcagggaagagtgcgctcaaaaaagggggctccagaacaaaaaatccgtggcgcaaaagaaacaaaaacacctctcactgaaggggaaacatacaacgaggggattatatccgcgaaaactcaaaaggaggcccatatttgggggaaccaggttgggttgttgtttgtgttggcgcccatatggggatataggttgcatatacatcagagggtataaacaacttgggggacaccaaataaatcggaggacactacaggggacaaagaggatgaatgggaaaaaagatagggacccaaagaaatataagagaagacgaaaaaatgggcgagtgggacacagggacaccaccccagagtggctacaggccggaagggccaaaataaaagaggggactagatagtggcccccgttgaaaacggagaacacaaggaggacgggagataacaccaaacagtgaaaacaacaccacgaaaaaaatcaaccacacgcaaaaagaggaacaaatatagacaggaaagcactacaaccaacaacgagtaacacaactaagagaaaacactaaagaagcacaccagtaatcaccttatcacagagcaaccccaacacaataatgtggaccaccgaaaaaacgc

SEQ ID NO: 509026 - DNA, 988 bp, Homo sapiens
ggggtcacgcggggcgggtccagtcccgggctgggtcgtcgcgggagagaaataacatctgctttggtgccgagctcagaggagaccccagacccctcccgcaggcaagacgcgcatggaagccgtgctcagaggtgcattagaagatgccgggcaggccccgacactcatgcgtgttgacacgcctgtgttcgctgggcctgtgtgctgcgtggatggtgctcgatgttgcttctgagagcactggcggctgtggcgcctgtggccttcatcaggcatggaaccggatgttcactcacgtgcagagccactcacagaaagccttgcgtcgatgcggtgagcacctagattggatgcaagctcgatcgctgaatccatagttgcttgcatgcattgccggaagccctggagaacgcagcaagatgccgtgcatgtgaaggccacactttgaccaccataactgtcgagcgaggaacggagtggggtcgcatgcacacggtgggctgaacagagaaaaggcaacgatcgtgggacagccgtcgatacagcgagcaccgagccctccgatgctgcatggagctgggggcctactgtggctactcagctgtgcgccatggcccgcctgctgtcaccagtgggcgaggctgatcaccatcgagatcaaccccgactgtgccgccatcacccagcggatggtggatttcgctggcgtgaacggacaaggtcacccttgtggttggagcgtcccaggacatcatcccccaagtgaagaagaagtatgatgtggacacactggaacatggtcttcctcgaccactggaaggaaccggtacctgccggaacacgcttctcttgggaggaatgtggctgctgcggaaaggggaccagtgctactgggctgacaacgtgatctgcccaggtgcgccagaatatctagacacgtgcgcgggagcagtgcttggagtgcacacatacaatcgtcctggat

SEQ ID NO: 509027 - DNA, 191 bp, Homo sapiens
tccccttgcgttcacatacacagaatgggataggggatcagcatctggtggccggctccatcaagggcatggctgtggaccacattacttctgcttggtctactagctaggtgctggttgctaggagtagactatatgaagtggcagggctcagtgcacctatgggataggcatggctctaggaaccttgg

SEQ ID NO: 509028 - DNA, 1480 bp, Homo sapiens
  misc_feature (1)..(1): n is a, c, g, or t
  misc_feature (545)..(545): n is a, c, g, or t
  misc_feature (554)..(554): n is a, c, g, or t
  misc_feature (556)..(556): n is a, c, g, or t
  misc_feature (561)..(561): n is a, c, g, or t
  misc_feature (572)..(573): n is a, c, g, or t
  misc_feature (593)..(594): n is a, c, g, or t
  misc_feature (598)..(598): n is a, c, g, or t
  misc_feature (604)..(604): n is a, c, g, or t
  misc_feature (615)..(615): n is a, c, g, or t
  misc_feature (639)..(639): n is a, c, g, or t
  misc_feature (641)..(641): n is a, c, g, or t
  misc_feature (652)..(652): n is a, c, g, or t
  misc_feature (654)..(654): n is a, c, g, or t
  misc_feature (656)..(656): n is a, c, g, or t
  misc_feature (665)..(666): n is a, c, g, or t
  misc_feature (693)..(693): n is a, c, g, or t
  misc_feature (697)..(697): n is a, c, g, or t
  misc_feature (713)..(713): n is a, c, g, or t
  misc_feature (717)..(717): n is a, c, g, or t
nccctggtatagatagtgaacaggtagttgtctgaatgacgagacaaacagcgagttaatctgtggctgggttggccccgctatggtcgccacctcgctgttggcgtcctctcggtcgtctttgtttctgtggtctgtttctgcgacccagcgtttgtgactctcgtgttccgcttttgctccagcaagtggtggagccctggtttgtggcggccgagccttctttactcgtggtttttgaactgcacccgtgtttgtcgcccggggcgcgccgttttcgccatttcctctgcgtgacccttcgtgtggggccatgcctgtagggcctccctgatgttcccgattctgtgcgggcctcgcgtgtgcgcacccctgggattgttgccccctgaggggccctttcttgttcttggtcctatgtgccttgtgctcaacactgttggtggcttaagtcctggcacgcttcgagtatccggcacgtctccgaggcccctcgctgccgctttcgacaccaccctgctaccccgtgaccgctcctctggccnccgcgcggnanagagnccgagatggcnnatgagattgccaaggctcanngtcnctcggnctggtggcganacgatctttgggaagatcatccgncnaggaaataccngncnaaatcattnntgaggatgaccggtgccttgctttccntgancatttcccctcaagcnaccnacaccattttctggtgatacccaagaaacatatatccccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaccacacttatttttgcctgtgtatggagagattcaagaaataattttaaaaccgcatacataataaaagacattgttgcatggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaattataatcttaggccaaaagacaaaaaaaaaccaatatataaaaatttaattgaagagttttatataaaacctgggaaatcttgttttttgattaccatattggatttaccagatttaatcccaactatttttaaactttaaggacctaaattttaaaatttatgaacaatttttaaggtaaacaaattataacgtggttttgtaaatactagttatcaaaccaaaatttacctgttaaataaatgccat

SEQ ID NO: 509029 - DNA, 868 bp, Homo sapiens
  misc_feature (15)..(15): n is a, c, g, or t
  misc_feature (138)..(138): n is a, c, g, or t
  misc_feature (147)..(147): n is a, c, g, or t
  misc_feature (245)..(245): n is a, c, g, or t
  misc_feature (251)..(252): n is a, c, g, or t
  misc_feature (267)..(267): n is a, c, g, or t
  misc_feature (270)..(270): n is a, c, g, or t
  misc_feature (281)..(281): n is a, c, g, or t
  misc_feature (291)..(291): n is a, c, g, or t
  misc_feature (311)..(311): n is a, c, g, or t
  misc_feature (329)..(329): n is a, c, g, or t
  misc_feature (340)..(340): n is a, c, g, or t
  misc_feature (356)..(356): n is a, c, g, or t
  misc_feature (361)..(361): n is a, c, g, or t
  misc_feature (371)..(371): n is a, c, g, or t
  misc_feature (375)..(375): n is a, c, g, or t
  misc_feature (380)..(380): n is a, c, g, or t
  misc_feature (384)..(384): n is a, c, g, or t
  misc_feature (401)..(401): n is a, c, g, or t
  misc_feature (405)..(405): n is a, c, g, or t
  misc_feature (417)..(417): n is a, c, g, or t
  misc_feature (423)..(423): n is a, c, g, or t
  misc_feature (438)..(438): n is a, c, g, or t
  misc_feature (460)..(460): n is a, c, g, or t
  misc_feature (467)..(467): n is a, c, g, or t
  misc_feature (473)..(473): n is a, c, g, or t
  misc_feature (475)..(475): n is a, c, g, or t
  misc_feature (478)..(478): n is a, c, g, or t
  misc_feature (483)..(483): n is a, c, g, or t
  misc_feature (487)..(487): n is a, c, g, or t
  misc_feature (489)..(489): n is a, c, g, or t
  misc_feature (495)..(495): n is a, c, g, or t
  misc_feature (497)..(497): n is a, c, g, or t
  misc_feature (502)..(503): n is a, c, g, or t
  misc_feature (520)..(520): n is a, c, g, or t
  misc_feature (674)..(674): n is a, c, g, or t
  misc_feature (784)..(784): n is a, c, g, or t
  misc_feature (866)..(866): n is a, c, g, or t
gcatcaaccaaatgncccagccacttggttacagtagctgataacaacactagtggatattattgcttataccccaagttcatttatacatccattatattttggcaagattacaatcaaatgggagctttggttgtnaaatttcanctatgactactcattgacaactcatcttctaccattttatggtgggatacatgtcaattcttccacatcttgtctcctttctccttccatcgataagntttacnngcctattgccaatcnttnagatggctgcntttgtcactntccctactctactgccttcncttttgtcatgacaaggngatgcatttcngggcctctcctaagancttcnatctggggtntccnctgcnagtnataaatgcccatctgtnatcnagatagattttnaaatgnatatgggtgtgaggnttggggtttgggctcaactgtntcatttncatctncnganaagcnagangngaaaananaaatnnaaacaaaatcaacagtncttgggattggtaatttgacctcccaacagaatgggccccaccccctgccacattaacatcccatggcaggtgtggagctgtggccttgaaatgctctctgtgtgtgtatgtgtgtgctgtaacattttaatttacagagaagcaatgactgantgcctcacgaaagctcccctgctgtcacacttcctagtttaacactgaaaactcagaatgagaaagagtcagaacgaactcacaatagcaccatttcctagactcttggnattagattcctttccgtgtaggagaacgcaggcgcccagcctccagctttgtgctttcacaggctcccaatgcatttgggcnga

SEQ ID NO: 509030 - DNA, 1502 bp, Homo sapiens
  misc_feature (1)..(1): n is a, c, g, or t
  misc_feature (545)..(545): n is a, c, g, or t
  misc_feature (554)..(554): n is a, c, g, or t
  misc_feature (556)..(556): n is a, c, g, or t
  misc_feature (561)..(561): n is a, c, g, or t
  misc_feature (572)..(573): n is a, c, g, or t
  misc_feature (593)..(594): n is a, c, g, or t
  misc_feature (598)..(598): n is a, c, g, or t
  misc_feature (604)..(604): n is a, c, g, or t
  misc_feature (615)..(615): n is a, c, g, or t
  misc_feature (639)..(639): n is a, c, g, or t
  misc_feature (641)..(641): n is a, c, g, or t
  misc_feature (652)..(652): n is a, c, g, or t
  misc_feature (654)..(654): n is a, c, g, or t
  misc_feature (656)..(656): n is a, c, g, or t
  misc_feature (665)..(666): n is a, c, g, or t
  misc_feature (693)..(693): n is a, c, g, or t
  misc_feature (697)..(697): n is a, c, g, or t
  misc_feature (713)..(713): n is a, c, g, or t
  misc_feature (717)..(717): n is a, c, g, or t
nccctggtatagatagtgaacaggtagttgtctgaatgacgagacaaacagcgagttaatctgtggctgggttggccccgctatggtcgccacctcgctgttggcgtcctctcggtcgtctttgtttctgtggtctgtttctgcgacccagcgtttgtgactctcgtgttccgcttttgctccagcaagtggtggagccctggtttgtggcggccgagccttctttactcgtggtttttgaactgcacccgtgtttgtcgcccggggcgcgccgttttcgccatttcctctgcgtgacccttcgtgtggggccatgcctgtagggcctccctgatgttcccgattctgtgcgggcctcgcgtgtgcgcacccctgggattgttgccccctgaggggccctttcttgttcttggtcctatgtgccttgtgctcaacactgttggtggcttaagtcctggcacgcttcgagtatccggcacgtctccgaggcccctcgctgccgctttcgacaccaccctgctaccccgtgaccgctcctctggccnccgcgcggnanagagnccgagatggcnnatgagattgccaaggctcanngtcnctcggnctggtggcganacgatctttgggaagatcatccgncnaggaaataccngncnaaatcattnntgaggatgaccggtgccttgctttccntgancatttcccctcaagcnaccnacaccattttctggtgatacccaagaaacatatatccccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaatttccagtatgttaagtaacacacttatttttgcctgtaaccacacttatttttgcctgtgtatggagagattcaagaaataattttaaaaccgcatacataataaaagacattgttgcatggttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaattataatcttaggccaaaagacaaaaaaaaaccaatatataaaaatttaattgaagagttttatataaaacctgggaaatcttgttttttgattaccatattggatttaccagatttaatcccaactatttttaaactttaaggacctaaattttaaaatttatgaacaatttttaaggtaaacaaattataacgtggttttgtaaatactagttatcaaaccaaaatttacctgttaaataaatgccat

SEQ ID NO: 509031 - DNA, 167 bp, Homo sapiens
ccacgtggtatctttaaatattgaagcctttaaatcctactttggaacaccgtgctagactccagatactcttgtggcttctgtctatttcctgggcatgtcctacaatgtgagctaaaataaatctctacagtgatatgagaccttcgtgagacttctgcgtttac

SEQ ID NO: 509032 - DNA, 134 bp, Homo sapiens
ctggtgaactctcttttaattgcgtgaatttgttgctgtatttgttgaggattttgcctgtagttttctttctttgttgtgtccttgtctgttttgtatcagggtaatgctggcctcatagaatgaatttagat

SEQ ID NO: 509033 - DNA, 893 bp, Homo sapiens
gatctggtgtccggatccgtgtctctgtgattatgtataatgatgatggtgatgctgatgtgtcgtgcctgtaagggccgcggtcaacggtgcaggcgctattcgcgtggcactaccttgtgcccgagtgcgtgtcccatagggtacatacggcccagttaagcaagattcgctcagttcgacaacatacgtggacggccgtcagtcagtcagggcacatttctgaagcgagactgtcttcgcatgcctatgtgcttcccaatgtctgtactgtgaacgctacattgactgtgtgagttgtgcaattcacatgataaagtagtcacggaatcgatctcgtgaagcccgcagggaccgaatacccggagcaccgaatgttatgaccatgtcgggtgcgtagcaccccatggctacgcgcgcccagccaaatagcccactgtcaacggaagcattgacttccttgactagacattgcacagtacagggcctattcctcgtggcatgccaatacacgtaaaacactgggaaacttgttacaacaagaacaagaattccaagacatgtaccaacacagagcatttggcgctgtttccctcgagccgcaggggccatgtattgcttagatgggcaataagtttttggggcaggcactgtccccacaaagtttgataaccgacatctaggaagccattcgattgttcaactttcaggaggaccacgcgaagcaaggcccagtgacaacagagattcccccgcataacgttggagacacgggtacgtccaccgcgaacacttcgtgaatcaaggcccaaaggacgctttgacacggaagacaccagcggggtgcctctcgaaggagttccctcatgctacccacgcctactagatagagc

SEQ ID NO: 509034 - DNA, 1231 bp, Homo sapiens
gggtaacgggggaaacgtggggaatgtgggtgaaccgaggtggcaaccagtgggaagatggtgcgtgcttggaggagatgcttgtgggagccaaggatgcaccttgtgacatctggagtcttggcagtgagtgatgactgggtggaggggctagctctgatggcagggctggtgggtgcctgatggccatgtggacggacgttgttgagagtatgtgttgcccaatgcatctgttgcatgacatgtggctgacatcaggcttgtggtgactgattgtggccttaggctagtgggctggaagagaagtggtggagccagtggcagttcgatccctggtcacctttttggttacagggactgttggcatgcttggtttggcactgacgtgtggatgctgggttggtgcaagtggctttgtgagtccccatgggtccttgggtgcaaacgtgagggttgtaagctagtgcaggacatgccgagtggcatcggttgagtgaaccgccagtctgggcctgtgtgcatcggttgatgtccccttaccgctctcccatgggcctctggcttcccccaaggcgcttcttggcaaagacacgggagcgtctcacggggactccgcgggtgctggcgagggggagaaagcaagaacacgcctcccagtcagcagtggggccagtggaactgtgggggccaggacgagctaaagcgaacacgggtggacattctttcatcggggggggaggcctgtagacgtggcggcaaggggatgagcgggggcttatggagccccggttccaggggcagaaaaaggagccacgagtgggcaccggcacggggagcaccaggggcgctgtgcccagacggtaaggggtccccaagcaccggtgtgggcgggtgggggtaccccccaagggccctaggggtcacagacacagggggcacagaggggcatgtgagacgcaacgtggagccacagaaagggggggggccccccacagttggtcaagcccagttaaccagccgcggcaggaggaacacagtgtgagaagcactaggggagccgagagtggggctcgcccactcgcgagacaggcggagttccaaaagggaacgaaagatgagtggagacaccacaacagaagcgggtgggagagcagacaggaagagaaaaagcaggatgccctcggccggagtacagtgtgtacaggcaggagcaaccaaccagtgaggcggg

SEQ ID NO: 509035 - DNA, 244 bp, Homo sapiens
  misc_feature (70)..(70): n is a, c, g, or t
  misc_feature (82)..(82): n is a, c, g, or t
cctcctcccccttttcctcccccttcgccgacctcacccccggcggagggggctcaggctagcactacgnacagcaccttgnagtaattgccctttatcggacacaccttcttagtgctgcacagggtcacatggacgaagatgttcaggaggctctgctccagatcatacaaatcgcggcacgcggcttgctgtgctagccgttagccactgcactgacagtatcctgttttactcttgctgg

SEQ ID NO: 509036 - DNA, 275 bp, Homo sapiens
cagactagagtgcacacctacaaaattagtaactgtccgctcagacaggttaagccccaccgcgtgttacacaggaataaatggcatagctccaaattcacacccgggactccctgggctttctcaccgcacatattgccttcttactggatctcacctgacataatgagactcacgttattacccgggattcaccaggataacgggcaaagtttgcatgacccgaactagaacacgggccagtgactgccgttctggtgttgtaccatggcctt

SEQ ID NO: 509037 - DNA, 718 bp, Homo sapiens
tctggctccgatccgggcgactatggcggcgctgcggctcctggcgtcagtgcgggggcgcggggtccccgccggcggctctgggctcgggctgtcccacggctgcgcccgctgctttgcaccagtccccggctccgtgcaagttctacgcggacccggtggatgatggtgaaggacatctctgacggggcgacctgtcatgatcggtggcttcgggctctgcgggatcccctgagaacctgatcgccggctgtcaggacccgcgtgaaagacctgcaggtgtgtcaggcagcaactgtgggctgtggcaggacttcgggctgggcctacctgctggctgccaggcaggtccgtccgcatcgtctgttcctacgtgggcgagaacaccctgtgcgagagccagtacctggcaggagagctggagctggagctcacgccccaggcaccctggccgagcgcatcccgcgcggggggcgccggggtgcccgccttctacattcccgcacggtgctacgggaaccctggtccagtgaagggggcgccggccctatccgctaaaccaccggaggggcacctggcgctcatggagcccagcccgatgaggtgagggagttcaacgtgtgaccacttccttttggaggcgcgccatccgggcagacttcggcctggttgaaaacgggtggaaggtcgacaggtgccagtgaaacgtggtcttcag

SEQ ID NO: 509038 - DNA, 864 bp, Homo sapiens
tggctgaccggattctgaccatgatatctgaactcagggcacgattagaagcgctcaaaacccctgggacctggaaccgcatcactggatcaagattggcatgttcaggtttcactgggttgatcccccagtgcaggttgatgtatctggtcatattgaaaaggcacatctacctgctgccaagtggtcgaatcaacgtgagtggcttagaccaaccattaaatctagattacgtggctcacctccatccatgaagcagtcaccaaaatccatgtgaaggaaacacacaaccgtccagtaccaccaaaggtagttctctgtcatgtgtgtgccctgcctgcacatgacctacatgtgcatatccatggattagagacacttgcgggactgaaagggctgcgtctggtgagggcggcctcttgtgtaatagccgggcccacgagtgaagaagaacatccccttgatgatcgaagtttaggaagacgtgggattagggcctcttggaggtcaaagcagaactcaagattcttaaattaaggacataaaccatgcagtacttcgatcctgtagaacattaggtctcttgtgcctctcactgaaggaggagtgtttgtgtgtggacggcacgtggcttctgatgtggtgtcgactctggtgctgatgctagtcccccgggattcgagttggtctgaccggaggccacgggtgaatggtggtgtccggccggcggcgtaaattctcatctgcacccgaagggtctggtcccccggggcttctggctggtgggcctgagccaagggtggtcctagggactggcggggacggtttacatgagggcggcgtcatttactgccactttccacg

SEQ ID NO: 509039 - DNA, 278 bp, Homo sapiens
gtagaatgtttatatctccagcaaactctttacactctgcaatttttctccagttgcacttcgttctctgaagattcgtaatccttatctgaactgtcatgttcctgacgaatccttagtccaaggatgtgccttaatattgagggaatttaaattctgtgtagtttgggttacatttctctgatttgctcccttgttaggagttcccaggaccttaattatttctaccaactgatccacaccactatcccctgtaaatattggttgtcctagtaaca

SEQ ID NO: 509040 - DNA, 870 bp, Homo sapiens
tttatggctgcgacctggggcccgacggccgcctcctccgcgggcatgaccagttagcctacgacggcaaggattacatcgccctgaacgaggacctgcgctcctggaccgccgcggacacggcggtcagatcacccagcgcaagtgggaggcggccgtgaggcaggagcagctgagagcctacctgggagggcacagtgcgtgcagtggctcctgccagatacctggagaacgggaaggagacgctgcagcgcgcggaaacacccaaagacacacgtgacccaccatcccgtctctgaccatgagggcaccctgaggtgctggccgccctgggtttcttaccctgcggagtatcacactgaccctggcaggggcgaatggcgatggacccaaactcaggacaccgagcttgtggagaccagtgccagcagggaagatggaacccttccagaagtggcgcagctgtggtgtgtgccttctggaagaaggagcaggagatacacggttgccatgtgcagcacgcgaggggctgccggagcccctcaccctgagatgtgcgagccattcttcccagcccaacaatccccatcgtgggcctcgttgctggcctggttgtcctggggtgtccctagcttgtccctaggagctggtgatggctgtgtgatgtgtagagaggaagcacctcagcgtgcacaccggagggagctgccctcagggctgggtccagcacagtgcccgggctccgattagtctctccatcgcttgtaaagcctgaaaagtgcctgtgttggcctgaaagcacgattcttaaccttccttgggatcaaagctcggattcttcgcacagcctgagttccgctggacagtggg

SEQ ID NO: 509041 - DNA, 1744 bp, Homo sapiens
  misc_feature (88)..(88): n is a, c, g, or t
  misc_feature (98)..(98): n is a, c, g, or t
  misc_feature (147)..(147): n is a, c, g, or t
  misc_feature (186)..(186): n is a, c, g, or t
  misc_feature (287)..(287): n is a, c, g, or t
  misc_feature (420)..(420): n is a, c, g, or t
  misc_feature (422)..(422): n is a, c, g, or t
  misc_feature (542)..(542): n is a, c, g, or t
  misc_feature (584)..(584): n is a, c, g, or t
  misc_feature (633)..(633): n is a, c, g, or t
  misc_feature (695)..(695): n is a, c, g, or t
  misc_feature (1165)..(1165): n is a, c, g, or t
ggtctcccttgtctccgacaagggttgttagcgccacaagaccctaccgactcttgacgccatcaccttcaccaaacggctgcgatgntagagcactncacagaacactttcagtgaacgcaggactcactgagtagacctaagagnagcacctgaatagagtctcgctctggacttgtcgactcntacattgacctcacacgaactagattaccatgagagccactaatgcactggcgcaggctacgctaagcttgtaactcagtctctttatgatgtccgcgcgnctgctaagtatggtagtgccacccaaactctccactgacattgagtgcctacgactctagatcgaaaccggtaacttaggtgcgagccgacaacctaaacacactcgtagcgtcagaggtctggagcgtaaancnccttccacacaaagcataattgcatcacggccgagtgaccagcacttacgtgaatagtgcatgagagccctggagtcttccttaatatctacgggtattcccctctagatgctactcttngctattgtggcacacctagagcgtatcatcgatctcttccgngagcttgctcttagctcatcaacatacatttgtagcacgaacaacgcanacccaaataatacctcgataatcacaccgactaggcccaattaggccgaaatgccctccccntattattagaccaccggagcgccgctagggatagaggtttaattatgaggcctatctacttgctccgtaacttgaagtttagaatatagcttggcgccgtaagccccacagcttatacgtctaccctacaaagaaggcgtaagcgaccccatagaaatttccctctttataattgcgccccctaggtagctttaagggtttaattatacaattcgggaaagacctcaatttccaagtccccttattcattcaaatttccaaaaacgcgataggtaacggcgccccgttcgcggtggcgaggggaaacggccccttgtataggaccttcggctttgagacagacaatttatcgtgtgggcgaagggcgcccaatcacccttattgggtcaaattggcaagccggataaaagtcatgtgggacaaggtcgggccgcaacaccacttaagtgctacaacttactggcacaagncatcttatgttaaagacttcctttaggcggcttggttataggagactatcaaattcattgcttttccagctaaaattggcttaaagttttacgctgactggggaggtgaataaccttataaaaaaatcactcatgggaagggccttttgaagtggcccaaaaggcgcccaggttttttgacaccgcatctgtatagagataagacgccttataaccgtgggacgacggaaatgagaaaatggagccccacgcaaatagaagttggcggaatataatgatggtgagcaaccaaacggcacggagcacccagaaagaaggggggcgaaaaaggagcccccagaataaagcaccccgggagaagcacaaagtagagaagcaccgccacacaacacataaggagggcagcgaaacaaaggacggagagccaccaacagacggatgaacgacaacgaaggcggcgagcaactgagaaagaacagatcaagagcggaccgaagaaaaccactgaaacaagcagctcagagaaaaggacataacaaccacgagaaataaccagaagatacatgaacgaaacacgag

SEQ ID NO: 509042 - DNA, 436 bp, Homo sapiens
ctcggtacccgtgtccatccccctttgtgatccccctgccctctttgaggcaggggtgatgttgccagagcaccctgcacatgacaatatggatgaggatgataatgtatcaatgggtgggcctgagagtcctgattcaatggatcccgttgaacccataccaaccatgactgttcaaacaacacttgttccaaatgaggaagaaacatttgcattggagcctattgatttaactgttcaagaaacaaaagccaagaggcgatttaatgtatacgttacaaagtcacagcctgatttgtcaggtaagaaaatggccaaagccctttgccacctcaacgtccctgtcactgtggtgctagattctgctgtcgggtacattatggaaaaagcaaatcttgtcataatttgtgctgaaggagttgtttaaaacaaaagg

SEQ ID NO: 509043 - DNA, 174 bp, Homo sapiens
agcttgaacacaggcatgcttttaaagcattgttacaggaatgggtgaatgaatgaaggagagaaaaaaatcccggctgcattatctacctataaaagaaatacagaaccatctggaaggtgtagaacaaagaaaggtgatcttctgccacgataaggtgatcttctgcacgat

SEQ ID NO: 509044 - DNA, 362 bp, Homo sapiens
  misc_feature (53)..(53): n is a, c, g, or t
  misc_feature (352)..(352): n is a, c, g, or t
tcttcttggctaattcttggcagggatctttctggaggaaaagctggggccanccagggcaggagaggtttaaatctgccacgagggcctcctgtttgccacccagccaacttcctgttgctggccctgccctctgcccttttgcctgtcctaggccgctggagcaaaggaaggcagctcattcctcatgggcgatcactccgcatctatagggtcgagcctaggggagctttaggaggctgggcctcctcgtctgatttcagctctcccatgcccctccctagaacacagacgcttcaacaaggctgctggtttcgagcactgctcacctcccaaatgtatgaaagggtgngatgagggac

SEQ ID NO: 509045 - DNA, 949 bp, Homo sapiens
  misc_feature (31)..(31): n is a, c, g, or t
caaaatattaatcctccaaccacacataatnactcactcactcactgtcgtttatttcaccatcgtaacctactatgtaaacagtgttttggccccaagcattgttctaaaaattcttgagatccatctcttcccgggtattaacccctcctctactaagatggacttcctctatacgccacagttcctgccacaaatatttgaacaccccacgggccccacaatgtcgtaacgccccaatgtatttacattgcgcctcagcgcttgtaaccaatgcaaaacttgcagtctcttttcaaccgcccccccgtcccccatgtcagcaactcccaccttgtattacaaacatgtcgttattccaaaaggattttaattcaaagtcaccacaccggataaacaacttattgcttcgtggaaatccatgagagccacccctcgttttccccgaccctcattgccacccccttgtggcttataaatagttctttcatgacaaggctgcgatatagaaccttcagttgtgcgcaatcctcccgccccctcataattcgcccgtcacaattagatgcctctaatacccccatgcagagcattttcatccccctcccgaaatctattctatggataccgccccttaccaccagtaggcagctgaatggtcggtggaccacctttagcgagatgcaccccgatggagccttacctcccccggacctcctcatgtcccgccccgcagaagcacccagtcaataggcgaagggtgtaactcagatgattcgaggtgttttgttactcgtcaagattcggagaccccaaaagtatgtttaagggatgtgagaaatggggactctgggtgataaaaataggggagccctaatcaagatccaaattccggctctccagtgtggggcgtgcaaaacaaaacaaaatcccccaaaccacaagacaa

SEQ ID NO: 509046 - DNA, 166 bp, Homo sapiens
  misc_feature (13)..(13): n is a, c, g, or t
  misc_feature (36)..(36): n is a, c, g, or t
  misc_feature (102)..(102): n is a, c, g, or t
actgtttaggatnaaggacacactatgaaaagtgancattatgcaacattaccaagacaatatacattcacggaatatgagagtcataaatgacatgggggnaaactgtaaacagtgctacggggtttagcgagaaatacattccttctagacagggttcgagatc

SEQ ID NO: 509047 - DNA, 131 bp, Homo sapiens
cagctccaagtaggctgggagtacaggtgtcgccatacaactggctaattttgtatttcttagtagagacgagggtattcagtatgttgaccaggctggtcttgaactcctaacctcaggtgatccaccta

SEQ ID NO: 509048 - DNA, 487 bp, Homo sapiens
cagaggatccttgctatcatcggcacctatttttaaataggattattgtctttatggtggagttgtaagtgttctttatatattctagatacaagtccccagtcagacatgtgattggcagatattctgtcctttccataggttgcctttcactctgtggtttctgtggtgacactgaagccttttaaatttgatgtagtctagttggtctactttggctatgtggcctgtgcttcatggccagatccaaggtcatgaactttcctcctgtattttctgtaggagtcttatagtttcaggcctttcatttaggtctttaatccatttggagttaattttggtatatgtagtgagatagaagttcaagttgattctttcgcatgtggatattcagttgtctggtaccattggttacaaagactattctttccccattgaattttcttggcactcttgttgaaaatgaattgaccatagttataaggat

SEQ ID NO: 509049 - DNA, 1027 bp, Homo sapiens
gagtgcatatcatcttccttataaagatcccaatcccatgacatatagatgcctatcgttcaagcatgcgagttggacctgggtataggtgcatgtccgaactcctgaaccgaccaatgtttacccagaattagattcgtgtagcaagtaacagcgaggtatggacactatcatatacgtacctccagaaatcaattgcatcccagtacggatctagtacagatctggatggtcatccatagaatggactttccgtgaaatgtctataatgtctaggatgatacaagacgtgtgcatgtgtggatgccagatgaaagtataccacattcgagatagtatgttatgaagaagctgtggtatgattcaccatttgaaaagtatatatatatccgtatatgaccatatttacctctagggaagagataggcttccatattgactggtacactgacgatatagtccagggagccgtacggcaatcttacagggtacctaccttgagactggaaacaaggcctgagatggaagcttggtcggctcggtctgaagatataccataagaaagctaagggggcgaggtccatatctcgcttgctttagaaatgtgcattgaactgtagtgctttaaacaatgtatctcatttaacagggggttgcgtcagcctggatggtttactattaacttgtcgtgtgggaccataagagaatattgtacttccgtgctagggtagttacgtcttctaaatcctgaagagtaaatatagtaatttggggtttcaaagtatgaaaatttgggtggaggcgtgggtaccaaggaaggacaacattgagtccacgctgtaggtaaagttcggaccacttaagtaattcacccaagtgttaccctacggatttttaaactttatccgtgttgcacaagagggcagcgttggaaactggtgtggccgtaaatctttacaatttttttaacctcctttcaaaagaactcggacgacacggctgtttcacctaacagtgtcacgcatgc

SEQ ID NO: 509050 - DNA, 583 bp, Homo sapiens
tgggtaggatctcactctgttacccaaagtggagtgcaggggtgtaatcacagcccattgagcctcccatctcagcctcccaagtagcggggactacgggcgtgcaccaccatactgggctatttttttttttttcccgtagagacggggtttggctatgttgtccagaggggtctggaactccggggctctagccatccactttttctcagccctcccaaagtgctaggattacgggtgtgagccaccataccgtggctgcgggcttctggtggcaaacgtgtcccttacaaccccggggccaagaccctgcacagccccttgtaatttcacaccgggggctctgtttcttcatagcaggtgtaggggagcagaaaattagcagaaccccgggaatttaggaggggtgaggctcctaattcctaggtgcctcccttcgtgcacagggctcgctctgggatctcttgcatatcctgggggctgcagttcccctcatatggacaacgaggattgaccctagactctgcggtttacaaacagggttccagggaaactctggcagaggtacctcagggggtagaag

SEQ ID NO: 509051 - DNA, 1092 bp, Homo sapiens
agtgatgaaatgaagagtggtgacggagatgagggagctgatgagccatgtgcgatgtgcacctgcagggctctggtggctaggtgagtgagctgatggtgcaatggcagagacgcagtgatggcctggagatgaaatgaatcgctgcctgctgtgcagtggaatgactagtgcttgcgggttccctgtgtgacttgcaagtgtccatgtgctatgtggctacgtgtaacctgcttgcgccagtggtcgagctagtgcagtgcatagctgtgcggcacgcagcacgcatgcgacgcggcacacagagccgggcgcgttggcgcgcacggcaaacgtgggggcagactctgagtgtgtgcgacgacgacgaaagcccactgcacggcgcacgcacgcagcacgcggatgtgacatggccttgtggaaacgggacgcacacccgcacacccacgcggcttcgacgcgcacgcgcgcggacctacgcaagccgcgcacgcacacgtgcacggccacacgacacagcagctggtaccgcaaccgcgccacgccacgagcacacacgcggggacacgcacggcaacacacggcggacgaacgccaagtcgcaaggggcgctacgggagcaggagacttgcccacattgtaacagtgggcacgggctgcgcacgccaacgcggcgcacggacgttactcaactgcctgccttgcgggcacgtacacgcacggtcgtcaccccggtccgtggcctcaagcgggtcacgccacggccacggcaatgcaaacgcaaggcgcgcgcataggcaaagcgtgtgggcacacacccttgcttaggccgcaccacgcgcggcggaacgaacgcgaaggactctcacaaggtgacggagtggtgtgaacagtcacccccaacggggggccgcggtacgcaaggcactaccacatcttgggcgcaacaaaggaggcggacatccaagagaagcatatgggcgtgacgatacatgcacccatggcgcgagacgacgcgtgcacctcaaaggcgagcagcgaacatacccttgggcggtcgtgcaatccccagggggaaggaagcacacg

SEQ ID NO: 509052 - DNA, 491 bp, Homo sapiens
gagggggaattctttcccgccccttcactggcaaagggccacattaaaaggccaggctcctcttttacaaatagaatttgagcatcagttgggtttaactaaggccctcttgaatctctgaatttgaaatacaacactgtctctgggatccctgatggctttttaatctttgtaaaagcaattgttggagagcccctcacacagccttggcctttgctcaattagcaaaaacagggataaggcacacctgtctttcttaaggagggtgaaagccccaactgttgtcccaaacatgcgcttccttgtttaaggtatggtccaaacaatgcctcccccttggagagaaaaaccttaattagataagggaataagagcccccccattttttttccccttaggaaaaattccctgttaaaaggggggacattctccccgattattttttccccacacatgtaaaaaatgtcttttttttttaaaaaggggtgctc

SEQ ID NO: 509053 - DNA, 377 bp, Homo sapiens
ggtgcgtacccttcccatactaataaatcccattatctacactagccttatcataacagtaatatccggaaccatactagtaataatcagctcacactgactactcatctgaatcggatccgaaactacacctattagcaataatcccagtattaataaaaattttaacccacgagccacagaagcagccacaaaatatttcctaacacaagccacagcctccatgatactaataatagccatcatcatcaacctcctatattctggccaatggaccattacaaaaatatttaacccagtagcaataacaataataaccctggccctggccataaaactaggactctcacctttccacttctgagagaccgctcttc

SEQ ID NO: 509054 - DNA, 339 bp, Homo sapiens
catgcgcgcagccattctccactccaaagttagacaaaatgccaggattgttcttctctgcttaacccaaaggatttggaaagggacccactcattccactcttaggacggccaaaattgcaaaaagaggaggcccaagagtcttttgggaattggtatattgaaggccatacctgaggttctatggatcccaccaatcttgggatcctgggaattgaaatccttcccaagtgcccaaggtggtactttcctgctgctggaaggaattggcaatggtcttcaaatcctcctaggaaaaacctacttcgccaaccaaaactagtgcaaaatagtccttgt

SEQ ID NO: 509055 - DNA, 466 bp, Homo sapiens
  misc_feature (62)..(62): n is a, c, g, or t
  misc_feature (82)..(82): n is a, c, g, or t
  misc_feature (112)..(112): n is a, c, g, or t
  misc_feature (183)..(183): n is a, c, g, or t
aagccaaaggggcagccccaagaacccaggtgttcccttgccccctcccccgggttagttgncccaaacccggttagcctgncctggctggttaaagggtttttttcccacncccttcccgtggggtgggggaacaatgggccaccggggaaaaaattcaagaccccccctcccgggttgggntccggggggtcctttttttttttcaacaagctccccgtgggcaaaagcgggtggcccccggggaactttttttttttttccgttgggggttggggtttggccccccccttccccccaaaaggcctttcccttttttcgggttaattggttggccgggcggccagccccccccccccggggtttttgggttgcccgaggattttttggccggtcccccctgtttattttttccgggggccccgcctgggaattaagcccccccccctgccctggggcccctcca

SEQ ID NO: 509056 - DNA, 560 bp, Homo sapiens
  misc_feature (24)..(24): n is a, c, g, or t
tggtgggttggggggggggggggngggtgagaagaagagggggggtctggccgcatcagcctttatttgaactactgcattgctaccagattacatcacttttcagagttagagtaacataatacctgtggaaacggtagcaaacagcttgacaaagcaagagtacattaattcctacatatatacttttatttttagggaccacatttctttgtttcaggtgtaaaattaaaaaatatatgtggacactgtagcatactgtggcctaccaaatcccggtctaagttcgtgaggggggcgtctctcctcaaaggtatcatattgaacagcattttaaatttagagagagagtttgatgatgcagggtttaaaacaaataagcatgtgtgggaccaagggatttaagacaaaagttttcaattggttacaggcttgggtatgagagggaagatgcaaattaaggggcctttttgttctagctacgatgtgtggttgacttactcgagaaccccttaaaaaaagggggcagagtaccggtcttgggggatagtgagcaacgg

SEQ ID NO: 509057 - DNA, 182 bp, Homo sapiens
  misc_feature (71)..(72): n is a, c, g, or t
gcttaaacgcgccccatctcgtctgatctcagacgctgagttttcacattaccgttcttcgacttataaanntcagctgatttgtttatacccaggtcccaaataatctaatcaaacttcaggcacgtgtgttttgctctcctaggcccttgtaactcttgtacacaagtgctgtcagacat

SEQ ID NO: 509058 - DNA, 353 bp, Homo sapiens
  misc_feature (185)..(185): n is a, c, g, or t
cacagcctaattattagcatcatccctctactattttttaaccaaatcaacaacaacctatttagctgttccccaagccttttcctccgacccccgtaacgaacccctcctccttagagtactaactacagctgactcctacccgctcacagatcatgggcagagccaacgggccacttatccangtggaaccactatcacgacaaaaaactggtaccgtcgtctatactacgatctccctacagaatctcctgtaagttataacagttcacaggctcacaggaacttagatcagtactttgtactatccttcccttccgccacacccacgacgtttaatttccccgaccgtg

SEQ ID NO: 509059 - DNA, 714 bp, Homo sapiens
gtcctggtgcttgatggtcgagcccatttcctgggccccctggcggcacattgtggctaaaccggtactgctgggcccgaaagtggtggtcgtacgctgtgaaggccatcacacatattttggccaaattttcaccagaaaccagattgaagttacctggctttcctcccccaagcggtatggacaccccaccctttccgagggcccctaccacacttccgggcccccacagccgcaattgttgttgggcgtggccgtgcgagaggtatatgctgcccccccaaactccacgcgaaggccacaggccgccttctggaccgcttctccaaagtgttttgaacggcatttcccacccggcctcttcgacccacgagataaagccggatggtggtttcctcgctgccctccaaggttcgtggcgttctgaagcctacacacaagaaagtttgcctaatctggggcgccctggctcaccgagggttggctgtgagagtaccacggcacgtgacacgccacaccctggagaggagaaagaggaaaagaggaaaagcccaagagtccacctatccggagaagaaagaaaccacgctcatgaggctacggaaaccggccgagaagaacgctggagaagaaaattgacacaactacccccgaggtccttacagacccccggactcctggttctgagccccataaagactgttaattcctcca

SEQ ID NO: 509060 - DNA, 436 bp, Homo sapiens
ttgtgagaggaggttagtcaagctcagaactccaaacatggatttagtcacctatgatgacgtgcatgtgaacttcactcaggaagagtgggctttgctggatgcttctcagaagagtctctacaaaggtgtgatggtagagacctataggaatctcacagctataggttacagttgggaagaacatacaattgaagaccatttccaaacttctagaagtcatggaaggtaattttcttctgcaagctgatgagaaaatgcctatgaagaaagtttaaccgtgtgctacaagtaataaagaaaaccaatagggtacaataagcactgctttcagttatgggatgtttacttactttccataaaatccatatatgtccatggtcaaatacgtaattattgtttgcaaggcattccattagttccaagacagagaaat

SEQ ID NO: 509061 - DNA, 103 bp, Homo sapiens
gtggcataggggcagtgactgctggggtcatcatatcaaaaggctccaggaactgaggtgcagggtgaggcccgtcacccggatgctgtagtccagctccggt

SEQ ID NO: 509062 - DNA, 1163 bp, Homo sapiens
  misc_feature (329)..(329): n is a, c, g, or t
ggaagtcggccatggtactggataacgaagttcttcgtcggcgccttagcgatgcccaatcacctgtccaagacaaacacacaaagtgagacagaagtaagttacgatagatgcatcgaaatggttttattaaacctaagtattactccgattggaagggaggtataaaaaacgactagaatgatttctatagaagcaaccatgccccgggtatttgattatgagggataatgctagttgttcataatcacacatgtcctgccagagtgctcgtggctgaacgtgaagaccacgccatgtgcagtcctgctcgtggcgtaagcagaagnctagaacattgggtcttcggaaaacagaagagagcaaatgagaataatgcgtgttgccaaagagtggcgcacctgtgggtccttctggtggggacctccctgtggtcacgagccacctcgacctccgtggtcctcgtgatcatcctgtgggtccaccaataatctcgttggtttgtagatcgtagcggatccccggagagtgtgcgtggcagtgtgtgcgcacaaaatacaacagttcgttctgataacaatcttgtttgcctacgcgaaagtagtggtttcgtccctatgaataggacatttggaaaataaatctcttttataatgccacaagcaaaagacgtgttgtcacccaatgtgggtctatcaccccgcaaggttccggtccaacccgtatgttcactgatccctgtggaaagttaacttcatatagtgcgtactttctacgacacacgaggtgtggtcaaaccccaattgaaagaacgccccgtttggtccatctcctcaaaagcccttgtgtggggtgggaacacaacgtcattgcaaggggctccctggggtgccctcgcaagatggagagcttccagttccaatagagggcgcgcaatttttcgacctctttgggaaatgtactgtaatttcccccttggtgggccgcgaaaaacatctgcgtggaccaggggggggttttatgacaaacgggggagaggtttatatccgacacccaaacagttaagatcactttcgtggaagacaacgaccatgccagacaaaattcctgctcaactatgggcacaccaggttttggagcgtcacaggcaaaatgttgtacac

SEQ ID NO: 509063 - DNA, 435 bp, Homo sapiens
cttcacagcaaagacccaaaaatagtagattcactgacagcttgcactatgcacctggaaaacccacagacactcagtgcctggctttgagagcagctgtgtgggatgggccctgcggagccacagtggagaagctgctcaaggccttgggagcccacccttcgcatcagtgcggcctggatgtgagacaaggagtcaaaggagattattttagagctttaagatttaatgactgccctgctgggttttggatttgcttggggcctggagtccctttcttttggtagatttttcacttttggaaagggattgtttacctaatacctgtagcctcatattatcttggaagtaactaacttgttttttgttttacaggcttataggtgaaagggactaggcttgtctcagatgagactttggactttagacttttta

SEQ ID NO: 509064 - DNA, 184 bp, Homo sapiens
ggtccggtcactcatccatggctgaaaaaaaaattaagaagactgattaatggaaagatgttccaggttaatagttggaagattcacatgtgttaagataccagtattctccaaagtgacctacagattcagtgcatccctctcagaattccaagggtcttctggcagcaatggatgagtggaa

SEQ ID NO: 509065 - DNA, 95 bp, Homo sapiens
ttaatgggacagaaaaaaatatccgctttttgcaacaacgaatgccaacccttcgaacactaccaccaaagtcattctacgccactggacgcgtt

SEQ ID NO: 509066 - DNA, 288 bp, Homo sapiens
ggggggggggggggcccccccccccccttaaaaaacggccccccctttttgggggaaaacccctggttccccggccccgggggggaaaggggggggggccccccctttgggggccccccccggaaaaaaaaaaaaaaaacccgggggggtttttgggggggtccgggccccccgggcttttttttctttggggcccccccttggggggaggggggggcccccccccccctttttttttttttgggttttggggtttttttttttaaaaaccccctttttttggcccca

SEQ ID NO: 509067 - DNA, 107 bp, Homo sapiens
gagccacggaaagagctgtaagtatgggatgccaccaacacacaggttcttttctttggggagcaatactttcgaggtaaccccctttcctttctggtgcaatccat

SEQ ID NO: 509068 - DNA, 373 bp, Homo sapiens
tctagcaggatcccccgttatagcacgtggtacgaatagtggttgttttgtttcacttcttaagaatagttcatatatttcttggagactaatagtagtatatatgtcgtaaatctagctacaaaattgtttcggagatagattttacaatgttgtatgtatatgtatcaatgtataattaaatgtatctacagaatatcttattcagattacttttgaataaccttgaagattgcctattacactgctagattgatcgttgacatgttttttgtcattaaataagtatgatatttacagtatattgcaccgaaggtgttacaatgaacttcatagatcggatctttattggtgaattaactaccacggtgct

SEQ ID NO: 509069 - DNA, 142 bp, Homo sapiens
  misc_feature (130)..(130): n is a, c, g, or t
tatctaacgttgagagatatacaggatatgtacgtacatcttctttgagaaatacacagtttacaatggctccgtaaagtgaatgcttcctcactaaggcagattagagtgaaacgcattttcagtctangcagcataatgg

SEQ ID NO: 509070 - DNA, 809 bp, Homo sapiens
agcggggcatccagttgggggtccactgccgcagtgtgggaggttgttctttcgctctttgcaataaatcttgttactgctcaccctgggtccacactgcttttgtgagttgtaacactcactgggaaggtctgcagcttcactcctcaagcccaggagaccgcgagcccaccgggagaaacgaacaactctagacgcgccgccttaaaagcggtaacattcactgcgaaggtctgcagctttactcctgagccagcgagaccacgagcccaccagaaggaagaaaccccgaatacgtctgaacgtcagaaggaacaaactccagaagcgccacctcaagagctgtaacactcaccgcgagggtccgcggcttcagtcttgaagtcagtgagaccaagaacccaccaattcgggacacaatacctataatcccagtactttaggaggccagggcaggcggatcatctgagctcagggggttggagaggagcctgaacaacataccgaaaccccgtctctacaaaaagtacaaaaattaaccggttgtggtggccggtgccggtagttccagctagtgggggactgcggaggtgggaagctgaagcgggaggatcgcttgacgctggcaggttgaggctgcagtaaaccagggattgcgtcaggacactccaagctggggaacaggagcgatgccctaaaacggctgggtgagcttggactggagtccaatcttcttgactctcaattcttccaccatgccggaattccactttgcatttctggccaagaaggtcgtttacgcttcaagg

SEQ ID NO: 509071 - DNA, 911 bp, Homo sapiens
  misc_feature (15)..(15): n is a, c, g, or t
  misc_feature (67)..(67): n is a, c, g, or t
  misc_feature (128)..(128): n is a, c, g, or t
  misc_feature (149)..(149): n is a, c, g, or t
  misc_feature (160)..(160): n is a, c, g, or t
  misc_feature (162)..(162): n is a, c, g, or t
  misc_feature (176)..(179): n is a, c, g, or t
  misc_feature (181)..(181): n is a, c, g, or t
  misc_feature (185)..(185): n is a, c, g, or t
  misc_feature (196)..(196): n is a, c, g, or t
  misc_feature (208)..(208): n is a, c, g, or t
  misc_feature (218)..(218): n is a, c, g, or t
  misc_feature (220)..(220): n is a, c, g, or t
  misc_feature (223)..(223): n is a, c, g, or t
  misc_feature (246)..(246): n is a, c, g, or t
  misc_feature (250)..(250): n is a, c, g, or t
  misc_feature (254)..(254): n is a, c, g, or t
  misc_feature (260)..(262): n is a, c, g, or t
  misc_feature (272)..(272): n is a, c, g, or t
  misc_feature (287)..(287): n is a, c, g, or t
  misc_feature (309)..(309): n is a, c, g, or t
  misc_feature (316)..(316): n is a, c, g, or t
  misc_feature (340)..(341): n is a, c, g, or t
  misc_feature (343)..(343): n is a, c, g, or t
  misc_feature (366)..(366): n is a, c, g, or t
  misc_feature (379)..(379): n is a, c, g, or t
  misc_feature (381)..(381): n is a, c, g, or t
  misc_feature (385)..(386): n is a, c, g, or t
  misc_feature (390)..(390): n is a, c, g, or t
  misc_feature (393)..(393): n is a, c, g, or t
  misc_feature (397)..(397): n is a, c, g, or t
  misc_feature (402)..(402): n is a, c, g, or t
  misc_feature (410)..(410): n is a, c, g, or t
  misc_feature (436)..(436): n is a, c, g, or t
  misc_feature (438)..(438): n is a, c, g, or t
  misc_feature (467)..(467): n is a, c, g, or t
  misc_feature (480)..(480): n is a, c, g, or t
  misc_feature (489)..(489): n is a, c, g, or t
  misc_feature (497)..(497): n is a, c, g, or t
  misc_feature (514)..(514): n is a, c, g, or t
  misc_feature (519)..(519): n is a, c, g, or t
  misc_feature (541)..(541): n is a, c, g, or t
  misc_feature (558)..(558): n is a, c, g, or t
  misc_feature (564)..(564): n is a, c, g, or t
  misc_feature (578)..(578): n is a, c, g, or t
  misc_feature (607)..(607): n is a, c, g, or t
  misc_feature (615)..(615): n is a, c, g, or t
  misc_feature (638)..(638): n is a, c, g, or t
  misc_feature (651)..(651): n is a, c, g, or t
  misc_feature (668)..(668): n is a, c, g, or t
  misc_feature (685)..(685): n is a, c, g, or t
  misc_feature (736)..(736): n is a, c, g, or t
  misc_feature (759)..(759): n is a, c, g, or t
  misc_feature (803)..(803): n is a, c, g, or t
  misc_feature (805)..(805): n is a, c, g, or t
  misc_feature (810)..(810): n is a, c, g, or t
  misc_feature (814)..(814): n is a, c, g, or t
  misc_feature (839)..(839): n is a, c, g, or t
  misc_feature (848)..(848): n is a, c, g, or t
  misc_feature (900)..(900): n is a, c, g, or t
ggcaacattttaaantcaggcaatcagtaatcacaactaaatacaaaatttcaggtgaacttgcctntcaaaataaatcagacccttgccacaggaaattgccccccgagtctttttccttgtccaanaacagtcaacaccactttgcnaaaggcatacnanaatacaatataaannnnanaagnctcccccagcntaatagccaacngccgcctatnanacncaagccattcagtcgagacaccngtcncccncacccnnnctgtcctccntagacaatcccagangtcagccggcttttgtcaaccntgccccngacgggtagagaggctatctcccnncntcccctggggtcctctgaggccnagaagccaccccngncagnnaccnttntggncaatngatttggnagtcgcagccggttttccagagccananctcgtcctcccccccccccccccaccccnacttcccaacccngagccagcnggcccctnccgtcctgggccgagtnctggnggggctgccggtccttcttccnggacaggcttagaggtnccttangttacccacatganaactgcaaggttgggtgactttcccagantagaagcngcacgtggattccacttggagcngccgagtccagcnggggtaaaatccatcanggttggctaagcatatntcctggaggctcctttaaaacccaccagaagcaagttcaccttctggagcnctggatgagttccaacagctctncccaaaacttcagaaacgcccagattctgggaaagaaatctgantnatggnaggntggaaggggcccaagggtggctgcngagccagcnagccccttggaattgcatgaggaggacagaattgcatggttccagaagaacnttcaaacttgc

SEQ ID NO: 509072 - DNA, 134 bp, Homo sapiens
gagaagacgacagaagggtggggaagattagaatctcccccagggttgggtgtggtggtttgagccaaggtgggtggatcacttgagcccaggagctggaggccagactgggcaacatggcgaaacctctctac

SEQ ID NO: 509073 - DNA, 361 bp, Homo sapiens
aaccaaataatatgaaacatatttcaaaagataaagagggaatcctccctcaatcattctatgaagtcagtatcaccctaataccaaaaccagaaaaggaaataacaaaacagaaagacagcagcacaaaaatagcagcacaatttgcaattgcaagatatggaaccaacccaagtgtccatcgaccaatgaatggataaagaaaatgtggtatctatataccatggaatattactcagccataaaaaagaatctctttagcagcaacttgaatggagctggcagccactattccaagtaaagtaactcagggacggaaaaccaaataccatatgtactcactcgtaagtgggagctaagc

SEQ ID NO: 509074 - DNA, 521 bp, Homo sapiens
  misc_feature (55)..(55): n is a, c, g, or t
  misc_feature (67)..(67): n is a, c, g, or t
  misc_feature (76)..(76): n is a, c, g, or t
  misc_feature (78)..(78): n is a, c, g, or t
  misc_feature (115)..(115): n is a, c, g, or t
  misc_feature (117)..(117): n is a, c, g, or t
  misc_feature (127)..(127): n is a, c, g, or t
  misc_feature (138)..(139): n is a, c, g, or t
  misc_feature (153)..(153): n is a, c, g, or t
  misc_feature (155)..(155): n is a, c, g, or t
  misc_feature (157)..(157): n is a, c, g, or t
  misc_feature (161)..(161): n is a, c, g, or t
  misc_feature (170)..(171): n is a, c, g, or t
  misc_feature (175)..(175): n is a, c, g, or t
  misc_feature (180)..(180): n is a, c, g, or t
  misc_feature (193)..(193): n is a, c, g, or t
  misc_feature (201)..(201): n is a, c, g, or t
  misc_feature (203)..(203): n is a, c, g, or t
  misc_feature (218)..(218): n is a, c, g, or t
  misc_feature (232)..(232): n is a, c, g, or t
  misc_feature (234)..(235): n is a, c, g, or t
  misc_feature (238)..(238): n is a, c, g, or t
  misc_feature (255)..(255): n is a, c, g, or t
  misc_feature (263)..(263): n is a, c, g, or t
  misc_feature (271)..(271): n is a, c, g, or t
  misc_feature (283)..(283): n is a, c, g, or t
  misc_feature (288)..(288): n is a, c, g, or t
  misc_feature (307)..(307): n is a, c, g, or t
  misc_feature (330)..(330): n is a, c, g, or t
  misc_feature (336)..(336): n is a, c, g, or t
  misc_feature (339)..(339): n is a, c, g, or t
  misc_feature (349)..(349): n is a, c, g, or t
  misc_feature (402)..(402): n is a, c, g, or t
  misc_feature (421)..(421): n is a, c, g, or t
  misc_feature (444)..(444): n is a, c, g, or t
  misc_feature (460)..(460): n is a, c, g, or t
  misc_feature (491)..(491): n is a, c, g, or t
  misc_feature (493)..(493): n is a, c, g, or t
  misc_feature (502)..(502): n is a, c, g, or t
cgtgttttttctctctctatagatcttattaataaattttatttggacaagagancttgtgccacancagtttaancngcatgattaacgcctgccgccctcccaccccccgtcncncgtatgtacngtatgtgaagnngttgcacctcaggncngntcangatcaggtnnaaancaccngggatacattatnggtctaantnatttccttcgggtcntggccggcatgggngnntcngacacagacactcagcnaccattcngtaaatgngtacagcaatangctgngcttaggggtttaagtcantcctacttgtgttggcatcaggncctttnggngatgtaaaancccctcctttcccatttgcgcacgtcacaaacgattcacacacagggctgggntgggcagctggccacagancccagcaagtccttcctgggagngaagagttagggctgntactgaaggtctctttcacatctggggacangnctgccttcnggctgtaagaatttcattt

SEQ ID NO: 509075 - DNA, 257 bp, Homo sapiens
aacagaagtatactcagtacaggttggttaatgaatttgggagaagctcagctctgtgaaatagctcccgtattaatacaatgggaccctaaatagttccgtgtgctcccattgagagcagattaatatctgccaatcagaacccatccctaacacatcagataatagtggctttgacctagggaagaagaggttgagcgaagaacccccaccaggtatgatttgagagtctttagtaagggttaaattgggcggga

SEQ ID NO: 509076 - DNA, 635 bp, Homo sapiens
tgataaggggcgcggagcggcccggagggggtttttccggtttttggggccaaagttgggcaacgcgccctctgccccttttttgggccgagggggggggagggtggttttttctcggcgttcttttccgcggcgccttttttttttggaatgggggccaagggcccccctttggggaggccagggggcccccctggtgttttgtggttcccgccttcttttggggggtcccacccccccaggccccccttgggggtttgtttagtgtttttttcccggggggtgggtccggggggtgggggggcaatgggcccccccctcaggggggggggggggccccccccccccccccaaaggggacccccagggggggggggggcaggttttttgggcttggggccgggggggggggggtccccccagggttccccttcccgggttcccctttgggggggcccgggggggaaaccgggggcccccccaaatgttttttgggttcccccctttcccccccccccggggggtgtggtgggggggggttcccggggggggggtttttttcccccccccgggttttccgccctttttcccgggctttttggccccccctttttttttttttttggccccccgga

SEQ ID NO: 509077 - DNA, 845 bp, Homo sapiens
  misc_feature (270)..(270): n is a, c, g, or t
  misc_feature (311)..(311): n is a, c, g, or t
  misc_feature (315)..(315): n is a, c, g, or t
  misc_feature (336)..(336): n is a, c, g, or t
  misc_feature (363)..(363): n is a, c, g, or t
  misc_feature (378)..(378): n is a, c, g, or t
  misc_feature (385)..(385): n is a, c, g, or t
  misc_feature (387)..(387): n is a, c, g, or t
  misc_feature (392)..(392): n is a, c, g, or t
  misc_feature (396)..(396): n is a, c, g, or t
  misc_feature (441)..(441): n is a, c, g, or t
  misc_feature (468)..(468): n is a, c, g, or t
  misc_feature (554)..(555): n is a, c, g, or t
  misc_feature (586)..(586): n is a, c, g, or t
  misc_feature (588)..(588): n is a, c, g, or t
  misc_feature (610)..(610): n is a, c, g, or t
  misc_feature (623)..(623): n is a, c, g, or t
  misc_feature (638)..(638): n is a, c, g, or t
  misc_feature (670)..(670): n is a, c, g, or t
ttagaactgatcttccatttaactactacagaaagcagtaactatgcaactatctaatagttcacacaaaagaattaaaagcttaaaaataatttttaggaaacacaatattcaaaatctaaacacactgataaattattaagattaagattatttatgtgataaatgaaatctcctaccaatccatccagcctttaccaggaagaaaagcaattatttcatttcagatagaaatacaaaaaaaaaaaaaatacttttcttaaaagccanatatggttaaatgttttattatccataatgatctaaactantaanattcaccaaaaagtaaaaatncaattttacaatatacttttttttttnaaactattgggcttnacctttntnacctnggtnctccttactggaagtcctctggcttccacttggatctgggttttngaagtctcttaataatgggctggggcnttggtgactcatgcctgtaatcccggcacttggggaggccagggaggtgatcacttgagcccaggagtaaagaccagccggggcanncatagtgagactccgtctctacaaaaaatanantttagcggggcatggtggtgcncatctgtagtccnaccaattggggaggntgaggcaggagaatcgttgagccccaggctcnaggctgcagtgagctatgattacgacactgcactccagcctaggcgacagagcaagaccccattctcttacaaagtctctattataaaagtacttccatcaataccatcccatttaaaatgggctatggtaatttacccacattatcacattctcaggaattatcaagaatgtgg

SEQ ID NO: 509078 - DNA, 1199 bp, Homo sapiens
  misc_feature (498)..(498): n is a, c, g, or t
  misc_feature (539)..(539): n is a, c, g, or t
  misc_feature (541)..(541): n is a, c, g, or t
  misc_feature (543)..(543): n is a, c, g, or t
cgggtaccgggatcgcgggcaggctcggcacgagcgccgagccccgcgcctccctcgcgtgctgtccaatgtccctgccccgcaacatgagcgtcacttccgccatccccgtgcagcggttggtggcggggcgcacgggggagggggccaggtcggatttgaagcccgcccgtgcccgagcccgcgcccgagcagggactacatttcccgaggggcctcggctgttttttgcggcgactgtggcgcggaaacgtcccccggaagtggagcccgggacttccactcgtgcgtgaggctgagaggagccggagacgagaccagaggccgaactcgggttctgacaagatggccgggctgccccgcaggatcatcaaggaaacccagcgtttgctggcagaaccagttcctggcatcaaagccgaaccagatgagagcaacgcccgttattttcatgtggtcattgctggccctcaggattccccctttgagggagggacnttttaaacttgaactattccgttccagaagaatacccaatngnangccctaaagtacgtttcatgaccaaaatttatcatcctaatgtagacaagtggggaagaatatgtttagatattttgaaagataagtggtcaccaggactgcggatccggcacggaggtctgcttatcggatccaggccttgtcaagtgctgcccaagtccgagatgatccagttagcacaaatgatgtagcggaacgcacgtggaagagcaacagaagcccaagccagtagaagaacagtctagagcatgggactaggctatatgccatgagtaatatggaacatgatacgatcactcaagtgtgatcattctcctgttctgcaagagttactcctctttgttgcctttaatggacacagtcttagaaacattacagagtacaccagagccagagatcttcgaaaggaggcacatgatgtacaacatcgaagagcaaagcatagggggacttatgatgccggggggggaccaggggcatctcagaggggcatgggggaaggacggtgtccgagcccactgctttaccagggcaagctgggggcaccgaatgcgcgggcgaaaacaagacccggtgacgcataacataggcagggacccggcaccacgagagacgcgccggacaagggcactcagcccaaaggcaagacagtacag

SEQ ID NO: 509079 - DNA, 325 bp, Homo sapiens
catgaaaattatcatgtaagcatcattatccctattttactggtgagcatttggggaagaccagggctcctcattttttgacagagtgggtttagaaaagtgccttagttaccttcttgtctaaagtatatatattacctgaatctttctacatctttttcttcctttaaaaaatgaattattagctgggcatgctgcttacaactgtaatcccagcactttaggaggctgaggtgggagagaggatggctcgaggccaggagttcaagactagcctgggaaacacagcaagaccccatttctgttcaaaataaatcacaataaa

SEQ ID NO: 509080 - DNA, 902 bp, Homo sapiens
ctcatgtgggcgtctgttggtgccgccccttgtgctgccccctggcggttgtactcgtgcggatgtggccgcgctgtgttgtgcggccggagttttggcccagtcggggggttgtctcgccgccttggtgcgtgagtgttccccgcgtgtgtgggaccagggttcccctctaagggattaaagggaggtcacctctcgaaagccgctgccgttgcgccctgtaaacgcccgctggggagacagttggtagtccggcccgcgccccgactgtttcttagtgacgcggccccccccctttttggggacatcaattaccgagggggaggttcatgagcccacattctttaggcgcccgttttcctcagcaccacagggggaggacatggtccggtgcaacttgcgcccgtgggtcatcttggctcccagatctcccctcctgtgtctacccctcctccgctggcccctctgtttcccctgcggttgtacgacctccgggctcgccgccctcgcgcccgctcgtgttgtgtgcagggccagctccacttgccctgcccccgcgggcacgctgcgtgaagactcatctatggcgccccgctgtctcccgtctccgcgttatcccatacattgttcacatatgagcccgtgtttcaccagtagctagcccatggctcctcctgtatccccacaacctctgtgattccaccaaccgcagaaatagtcaaacctccctttgttcccacacgcctgtgagaattaacttgtctccacataacaagttcctactcctcttcacggactcttatattttatagtttcccctttattgggggcaggaggatatatttcttttatattaaacaagacccaatatttccccacccagaaaaaaaccccacatgaca

SEQ ID NO: 509081 - DNA, 120 bp, Homo sapiens
ctagctacagattagaatgatgacaagagtaataccttcctagtgaagatgacttttatttcaggactatattaagtttcccaacttctgtcatgactatagtccacacagagaacctgg

SEQ ID NO: 509082 - DNA, 1423 bp, Homo sapiens
ctagtactagtcgcgagcgcgcccttatttattttttattttccagtgttaaagtatttaattaaatcaaacaaggaaatctcccaccactggttggccacttaaacagcttttatcacaatgataaaggactattatctattggtttcacaaagaaagtctaaaatttcaaaaacattcaaagagctaacacagtaaaaggtcatgcaagttccataaaataggtgaatcagtgacagaaactcattacatttaatccattatacctccaaagaggcccatcaaccttaacaaaaaaacttctcaaaaccagagaaccattatcacataatcgtgaatattcacattctacaggaattattggacccgtgttaaaacaccgatacgtggctgagataggaacgtacattcaaacccataacgtggtaaaacaagggttttccgtagaagagacctcacgtgcgtgcaaaaagtgcattgacccgtgatatttacaatattgtgagtgtattaatacgaatgaacacatgtgccaacagtgactttatcccccacaaaaatatagagagagagccacgtggcccccacacaagaggacagtcacccgcgaataaaatccccctaagaaaattccacatatacttaaaaaccaactatccagtaataaaacctacgcattcagagagtatccaaatacaacctagaaatctacaaccataaaatacttacatacgaaaaaaacccgaaaaccaaaaattaataacacagacaactgactataatacaccaaaattataaacgtgagggaatcacaataatatatacacccgatacatataaagagagccttacaagagataacattgacgacagtgcaccccttttacagccaagttgttcgcgaaaggagacatctaacaggagatcacaaacataataaacatggataggacccaacaggggcgtatcacacaggagaacatatccagcgacacaattaagtagagcgccgcagagtttatcacctaaagtaaataggtggtttaaaatccggacgaaataatatatttgacaacttatttaactagtcccaaaaaatttcacaatatagtgagtttaaaaaagaccgacacggcacagaataaacagaggacatatgaagataaacaacgatgaggaatgaaccaaacaataacgcgaaggttgttagccacacacaataagcaagatcggagcgcctataccaaacaacacaacatggcagcgcgaagcaaaaaataaccaccgaagagcgcaagaagcaagtacaacgagcgatacaacagcacaaaaagtgacaaatagacaagcacagagcaacataaagagagaaagcaccaccatatacaaccagggagatggacacgaaccacaacaagcgaag

SEQ ID NO: 509083 - DNA, 384 bp, Homo sapiens
ttcatttgctagaccgactcagttatttttaaaagcacattatcatacattgaaaagaaggatgtcttcatatatctgataagggggttaatatacaaaaaatatttaaggaatacaaaggcaagaaaacaaacagcctgatttaaaaacgagcaaataatctgaaagatacatttctcaaaagaagacatacaaaagggtcaaccaatatatgaaaaaaatgctccaacatcactaatcatcagggaaatgcaaactaaaaccacgatgagatatcacttcagaactgttagaatcgctattgccaaaaaaagacaaaagattacaagtattggtgaggatatggaaaaagagaacccacgcacactgttggtagaaattgaa

SEQ ID NO: 509084 - DNA, 130 bp, Homo sapiens
  misc_feature (18)..(18): n is a, c, g, or t
  misc_feature (69)..(69): n is a, c, g, or t
  misc_feature (71)..(71): n is a, c, g, or t
cagagtttcactttgtcntccaggctggaggagggatagcaaagccaatagagaaacagagattctgtngncctagggcactctgccttggctcatgcccttccctcttttaaaatttactgacaatgat

SEQ ID NO: 509085 - DNA, 429 bp, Homo sapiens
  misc_feature (91)..(91): n is a, c, g, or t
  misc_feature (215)..(215): n is a, c, g, or t
gaaagattaagtcctgtaaaacttgtctaggccactccccaggaacttcagttggccgagtctttactgtcaccttgactggatttaggantcatcttgggagatgccccttttgagtggctgggctgtgaggacagcaggccagttcttgccaccctggacagaaacacatctcaccttttctggctcaaggaatctgaacacctgtctcttgnctactcgggcttctagtcaggcattttgtcaccttgtcaagggtcccagggacacaaagctccctcctctcacccacagcactctgggtcctaccctcagtgcttcagggacatttaatcaggtcaaattgggatcaatggctttgatgcagaaaagaactgtggactaatagagatagggtttaattaaaaaatatatctttttaattttaaa

SEQ ID NO: 509086 - DNA, 673 bp, Homo sapiens
  misc_feature (135)..(135): n is a, c, g, or t
  misc_feature (310)..(310): n is a, c, g, or t
  misc_feature (320)..(320): n is a, c, g, or t
  misc_feature (371)..(371): n is a, c, g, or t
  misc_feature (412)..(412): n is a, c, g, or t
  misc_feature (417)..(417): n is a, c, g, or t
  misc_feature (440)..(440): n is a, c, g, or t
  misc_feature (459)..(459): n is a, c, g, or t
  misc_feature (483)..(483): n is a, c, g, or t
  misc_feature (497)..(497): n is a, c, g, or t
  misc_feature (506)..(506): n is a, c, g, or t
  misc_feature (575)..(575): n is a, c, g, or t
  misc_feature (582)..(582): n is a, c, g, or t
  misc_feature (625)..(625): n is a, c, g, or t
aaccacactgtgatggccctaatggcttccttggatgcagagaagccccaaggacaaaagaaagtggaggagcttgagggagagatccctacatttaaccataagcttcaggacgcgtctgcagaggtggagcgncttagaaaagaaaaccaggttttaagcgtgagaatcgcggccaagaagtactaccccagctcccaggactccagttccgttgcggcgccccaactgctgattgtgctgctgggcctcagcgctttgctgcagtgagatcccaggaagctggcccatcttggaaggtccgtcctgntcggcttttngcttgaacattcccttgatttcatcagttttgaacgggtcatggggcaacncggttaacggggaaagcccggggtaaccggaaaagggcctntggancaggtttggaggggccatggggnaatcctgggtgtggggacncagtcgggtttacccagggctgtntccctccaaagccnccctccggncaatgagtcccccctcttgtttccccccctaaaattgggcatggggtgcggtgtggggggcatgtgctncctgttnttatgggttttttttgcggggggggttgcttttttttggggtntttgagctccaaaaaataaacccttcctttgagggagagcccccctga

SEQ ID NO: 509087 - DNA, 186 bp, Homo sapiens
actacagcatcacaatagtagctgggacacaggctacacaccactacgacccagctaatttttgtatttttagtagagacggggttcaggatggtctcaatctctctttttttttttgaaaatggagtttaggccaaaactgggggtgaataaggaaaaacctaatggaagccttaacttcggggg

SEQ ID NO: 509088 - DNA, 238 bp, Homo sapiens
ccagtcgctctcctgggttcatccgcctcccatgccaaaggaagaccctccctccttggtcacagccttctctagcttcccagtgcctccaggacagagtgggttatgtcttcagctccatccttgctgtgagtgtctggtgcgttgtccatccagcttctgctcagtgcttcatgacagtgtccagcacatgtcagtctccactctctcagtgtggatcccacccctcttttcatct

SEQ ID NO: 509089 - DNA, 157 bp, Homo sapiens
gtatactctcagtcagattagcacggtatggtggaaggtactgtggaagggccgtgaatagtccaatccaggagggctgatgtcagttaatgagatggattttgtcaatgggagaggaagatggctgatgtacagtaattaaatccctgctgcttag

SEQ ID NO: 509090 - DNA, 425 bp, Homo sapiens
  misc_feature (260)..(260): n is a, c, g, or t
  misc_feature (300)..(300): n is a, c, g, or t
ttgggcctcattcagggcggggtcagaagcagaacaagtccaggtagcttagtcctttcaaatgaaaaccttggtcagggcctgcatcaggaaggcttttctatcctgctcctatggctccagaacggcctgatccgagcagctgatgatcgggaagaggatggctgctcccaggccgttccatgggtgccactcacagaggaaaatgaggaagccagggaaaacgaacaatttcagcagctgtggcgcaagctaggggntcggccccctgcctcggggcaggaaaccttcgggcgaatnccagccaagctgagtcctacccagctcgggagggcagcagcttcttggagtcaaccagaggaggaacagaagctgcagccagagcggcagcctaaagtcccgggagagcaagggcctgaagggag

SEQ ID NO: 509091 - DNA, 1379 bp, Homo sapiens
gtctgttttctctccttttgcttttgcgcggggtcttttctttttctcgttttcttgtttgctctgtccgtcttttctgctgttttcttttttcgtcttcttttgttttttctcttttttttcttttttttctctttctgtcctgcgtcccttttcctgtcctgtcgtgtgtccgtcttcctctgtgctctcgtgcttctctgtgctcctcggcctgcggcttgtgtctgttccgtgtcccttttggtcctgtttttttcgtcatttttcttctgtgtgtgagttgtgttgtgtgcccgttattggtggtgtcttggtccgtgttttttggtgtcctgtttttgttgtccttagttggtatttgtggtttttgttccctttggttctttcttgtgggccttctggttatcttgatttctgctgttgtctcctcctgggcctcttggtaggctgtctgtgttgggtgttctttccttttttttgttcctggtttgtgtctctttgatgcgctattgtggctgcttcttctgtccttcgtgctgctattggctcctctttgttgtgtctttgtgtgttctctatcagtcctcttcgtgtgtctgtatgtggttctctctgcgctttgtcgtctcttgtgtccctgtgtgtctcttgtctatgtggtgcgctattggtgccttgcgcctatgtggttttctggtgtgtcggtttcccagtcttttgttccgtgtcccatcggagtatggatgtcgtgtgccttactgttcggtagggaatgtctgtccgtctaggtgtctcttttgtgttggagtctggtatggtccatgcttccttgtgtggtggccagtgttgtgctctgtcctagagtatttgtgtagtaattctgtccattcgcatttgctactatggatagtatgtctcaataggtacattaatgtctatcgagtgcggtccatcgtgtctgtatcgtccgatcattcaacgactggagtaattgtggaagtgcctaatggtggtgtgggtgtgtgttatatgttctgagtctgtccacgaggtggtctcgtatgagagcctggcctggatgatgatatggctatgatagctgagtggccgagagattggacgttgcgaatttgatgagtatacgcttaatgcagttggcctgtgtggttaaacatcgatatcgagacctgctgaatgttgttattgtcttgtcttgttaaccattttaatttgttggctggatgtataatatgatgttctctaaaatattctagttgctttttcggggtaatctgaattacttttttaatgatctggggttccatttgactgtttgcatgtgagacttgcgatgtgcaccattctggtttgtagtt

SEQ ID NO: 509092 - DNA, 277 bp, Homo sapiens
tgtgtacctacatgcagttcattgaaggagggaggcgtttccagtgctgtatttgcagctgtatcaatgatgtacccccccagtattttcagcagctggatcataccggggttgttggggagagaggcttcaccgtatgtagtggaccatggggaatctggccctttgcgcgtgcaaagcgctgcaaagcatacatgtgtcccttcatgcagtacatagaaggagggaggcgtttccagtgctgttttagcagatgtatacaatgatgtccccccca

SEQ ID NO: 509093 - DNA, 123 bp, Homo sapiens
ggaattatggcacagaaagactggctaactacaccggaggcattatccgaataccaggacaccacattttaaccattgtcgtttccgtggctgggtggggcatcactgatgggagaagatgcg

SEQ ID NO: 509094 - DNA, 524 bp, Homo sapiens
atagagcaaatgaatatagatttaaacatggtcaattagaagaattaaaagatgaaacaaagaagaaagaagatagaacagtatgtaaaggaacaagaggaatttatcaacaaatgattaaagtaatagaagaaagaatgagagtatatgaagatgaatatcgtgattataaagctgatttgaagaaaacaatagaaattataaatgtagctcatggaaaatgttataatggaattattgaaggaattgaaggtgatcaagctaaatgtaataaatgtttaaaattaagtgaatttattttagataaagcaagagaaggaatgaaaaagaaaacaattacaagaatgttattagcaagatgtggtgcagatgatcaacaaagaacatgttattcagctgctttaagtttaatggcaaactttgatgaaaatatcattaataaaacaccattagagttttgtgttaaatcaaataaatgtgtagtcaaagattggtaagccattttttgaacaatttaaaaaaaa

SEQ ID NO: 509095 - DNA, 277 bp, Homo sapiens
cgggctggagtgcaatggtgcaatctcagcccacagcaacctcagccttccaggttccagcaattctcctgcctcagcctcccgagtagctgagactacaggtgctcgccaacacacccagttaatttttgttttttttcttagtagagtgtcaccatgttggccaggttgatctcaaactcctaacctcaggtgatccactgcctcggccttccaaagtgctgggtctacaggtgtcacccaccatgctgggttaataaattgcatcaatcgtaaa

SEQ ID NO: 509096 - DNA, 382 bp, Homo sapiens
cagctgttgctgcggtgactctccaggatccccggagtgcgttgactggcatgtcggtctgggctgttaagtgctccaacgtaggttgtcaccgccatccgtggggccatcatcctggccaagctctccatcgtcctcgattcgcagaggctactgggggaacaatgatcggttagcccctacactgtcccttgcaaggtgacaggtcgctgcggctctgtgctggtacgcctcatccctgcacctcaggggcacttggcatcgtctccgcacctgtgcctaagaagctgctcattatggctggtatcgatgactgctacacctcagcccggggctgcactgccaccctgggcaacttcgccaaggccattcaacgcctccg

SEQ ID NO: 509097 - DNA, 393 bp, Homo sapiens
agactttccatctaatgaccccactgaacacttaacatttacctgaggaatttaagtgtttggccatgcctaaaatccaggatgccatgcctttcattcttatctaattattaatgaaagctaatcgtgaaaactctaccgctagacgttgaccggctccttgatttgtttcccaaggtggaccaattggtttctagacacttatggagtccaacctgtttaagtgaatattaaaaagtggcttagtcaactcatacctgaccaatctccaacgaatggcttaagctcagttttcatagtactcatgaactatatcctgcgacatgccaattataatacatggaccatcgttagttcgaaagcctctcactaagtatgacctatgctatattc

SEQ ID NO: 509098 - DNA, 436 bp, Homo sapiens
caaattgcgcacagaaatttatttctatacaaattactacatgaactaagtctaaatcataacaaaaatgcctatcctctactttgaaatcaatagtcttctctcataaacattttattcaaattattaccctgtctacaggcttgtgtgcactaaccaggaagtgaaaccaaatatcatcattttgtgaaagcagagtaaaatgaaagaacacaaatttgaattatctgaagcattattaatatttcatctgaaaatccaattcccttggagacaacaatttaatccaggaagttataataggaatttcaaaagcatgattcttcattttcttgtgtggcagtgtccccagtcttctatgcgaatatcttttcctgtagcctggctggctcatcttaaacacaagctttcaccaacccgcctggtgaatactggg

SEQ ID NO: 509099 - DNA, 724 bp, Homo sapiens
  misc_feature (330)..(330): n is a, c, g, or t
  misc_feature (461)..(461): n is a, c, g, or t
  misc_feature (468)..(468): n is a, c, g, or t
  misc_feature (511)..(511): n is a, c, g, or t
  misc_feature (532)..(532): n is a, c, g, or t
agcgggagtccgagcgcgtcacctcctcacgctgcggctgtcgcccgtgtccgccggccgttccgtgtcgccccgcagtgctgcggcgcgcggcaccatggctgtgttgtcgtgctcctggcgttggtggcgggtgtttggggaacgagtttagtatattaaatcacagggtctgttgttttccgaaatggaaatttgcctataccaggagagcggatcccagacgtggctgcattgtccatgggcttctctgtgaaagaaacctttcttggccaggactcgcagtgggtaacctgtttcatcgtcctcgggctaccgtcatggtgatgntgaagggagtgaacaaactggctctacccccaggcagtgtcatttcgtaccctttggagaatccagttccttttagtctagacagtgttgcaaatctccattcactccttattttctgaggaaactcctgntgttttncagttggctcccagtgaggaaagagtgtatatggtagggaagncaaactcagtgtttgaagacngttcagtgcaccttgcgccagctccgtaatcgcctgtgtcaagaaaactctgttctcaggtcactcctcctcaattctctgactaggtacaatgaatcgacctgtcatctcgttcagcactgcaagtgatacatgatatcttcaagccttctgtcttcctacatcagtacctgggataacgaggataccaag

SEQ ID NO: 509100 - DNA, 823 bp, Homo sapiens
ggcgactgagctgttccctgcgctgaaggtgcttcttcctaagtgactgtgtcgagattttgaaaagtagccagactaagttgctgctttgtcctgtgtgttacaacatagatttagtcgtatgatattgggagtgtaattacaaaattattcaactctgggttgaagggacccaggaatctttagtcgattgcttgtgtatctatgagatttgagttctatttagcatgtgcttttgttaattataagagttgagagttggaatagagtattgtcgataatctctagtatattctgtggggaatcccagtgcctcggaggttctgcaactagttatgagctgtcggatgaatgcgtgtttgcttcaggagccggacttgtatttgagattgatttttccgattcatagacgtccgtccatttttcgactacctacagtcttgtatgtagcatcttcctgctcattataaatcctctgagctggaagtaaaatacatgaaacggcctatgtaccctctaactagcacactggagtgcagcttcctgcacgctccagggtcatagagggttacctccagttccttttgtacatgtcttgtttaccttccgtgtctggcacgtattaccgtgctaaataaatgaataagaggaggaatggggattttgacgtgcttggtggaggctgctcagtattgtagctgtggaagacgtgcgaatatgaattaataatcctgtggatgtctggaatgcctgcccgaggtgcaatgtagagactaatccctaattttgaaaagcttctttatctatgcaatttaaaattgac

SEQ ID NO: 509101 - DNA, 760 bp, Homo sapiens
  misc_feature (330)..(330): n is a, c, g, or t
  misc_feature (497)..(497): n is a, c, g, or t
  misc_feature (504)..(504): n is a, c, g, or t
  misc_feature (547)..(547): n is a, c, g, or t
  misc_feature (568)..(568): n is a, c, g, or t
agcgggagtccgagcgcgtcacctcctcacgctgcggctgtcgcccgtgtccgccggccgttccgtgtcgccccgcagtgctgcggcgcgcggcaccatggctgtgttgtcgtgctcctggcgttggtggcgggtgtttggggaacgagtttagtatattaaatcacagggtctgttgttttccgaaatggaaatttgcctataccaggagagcggatcccagacgtggctgcattgtccatgggcttctctgtgaaagaaacctttcttggccaggactcgcagtgggtaacctgtttcatcgtcctcgggctaccgtcatggtgatgntgaagggagtgaacaaactggctctacccccaggcagtgtcatttcgtaccctttggagaaatggcaagtttccctttttagttctttggaaccagggtggctttaggcccaaaaaactttttttcccccaaatttttcactccttattttctgaggaaactcctgntgttttncagttggctcccagtgaggaaagagtgtatatggtagggaagncaaactcagtgtttgaagacngttcagtgcaccttgcgccagctccgtaatcgcctgtgtcaagaaaactctgttctcaggtcactcctcctcaattctctgactaggtacaatgaatcgacctgtcatctcgttcagcactgcaagtgatacatgatatcttcaagccttctgtcttcctacatcagtacctgggataacgaggataccaag

SEQ ID NO: 509102 - DNA, 379 bp, Homo sapiens
  misc_feature (104)..(104): n is a, c, g, or t
  misc_feature (295)..(295): n is a, c, g, or t
  misc_feature (375)..(375): n is a, c, g, or t
aagaaatgttggaataagacgctccctaatacatttgcacactcattccctacacagtcatgtattcatttgttaaataagttcctgacttgggtgggtgtggngtggcacgccctataatccccaacacccagaagtcccaaggtggaagaatcgcttgaggtctagaattcgagaccatccttggcaacatagtgagaccccatctctacaaaaagtaaaaattagctgggtatggtggtacacacctttaggcccagctacttgggaggctttggcaggaggatcacttgancctgggaagttgaggctgcagtgagctaagattatgccactgcactccatcctaggtgacagaacggcagacaccctagnacta

SEQ ID NO: 509103 - DNA, 768 bp, Homo sapiens
  misc_feature (615)..(615): n is a, c, g, or t
  misc_feature (644)..(644): n is a, c, g, or t
tgcaccactatgatagaaatgtagaatcatttggaaaaatgagatgtatgtagttccaagtatgcaaagaaatgtcaccattttattccattcaataaagaacaaaaccaatagtgtgttatattactttcatctgaaacaattccatgtgtataatctgagccttgaagactttcatttggagtatgtaacccgttttggttgcatttcattttggggagaacttaattaacgtgagattggcaatgtgaaatgcaggtgcagtttgctgttaatgtctatgcgtgttgtttaggtaataggaaatattaagtaattggctgtagatttttgtaattttgtttccctgagttcctgtctagattccgtatgtctagtaggtcacatgtatttttcaggtgaaatgcaaaaatattcccattatctttgaccagtatgaagtttttgagatcttactgctgtgtcacttgaatcccgtgattgtcatacatctctggtgtaagcaacatttgatttttgaagtgttgtagaccatcgtgttcatatgtgcaagatgttaatttgaaaatttgtgcattttaaaacagttgtgggcataatcctagatggaggctnctaagttacatgtacctgtgcatgtgacnctttgtggaaaggagattttggatgtataattttgtgtttacttgtaacttgtctggttatttactgcttgaatctggggattccaagttactgaggggataccataaggaggaaccgcaggag

SEQ ID NO: 509104 - DNA, 112 bp, Homo sapiens
gccgatagtggtgacggccggcaacatgtctgtggctttcgcggcccgaggagcaggcaagggggagattcacttccgcttgcgattcagaagatgttggatgacaataacc

SEQ ID NO: 509105 - DNA, 193 bp, Homo sapiens
ttctgagctaatgggaagaaaactgagagtcatgcgttctgttaataaagaaaaactaaaacaacagaattcaaatccaagcttgaagaaggatgtcattaaacctaagcaaagacttaattttacttccaaagaaggaaaattccattccaaagaaggaaaattccattccaagaagcatttatggagaaaa

SEQ ID NO: 509106 - DNA, 240 bp, Homo sapiens
tgttggcggtcgaaatttaagggtaaacttgcgtgaacaaaggtccccgaccttttctcagatgtcacgggggtggagactgccagcagtgacccagtgccaggcggggccaactctgctagggcccccttccggcttagaagtgtgagcactgataagggattttggttctagaagttcttaaattttagtttggctgtgattcgaagtggttgcaattttagggatatttccaccttg

SEQ ID NO: 509107 - DNA, 280 bp, Homo sapiens
taattcatacccctttcgacattttgctgtttattcaacattgcatgctcgtttgtcatgtggctcgttaggcaaagcttgctctttgtgtgtggcttccttcccttggtgctgcctgtctggtgaccacctctgcctggtttccacttccatgaactctgtgtgtctccttcctgattttccatatgcttatgcatgtatcgttgttccttttcctttattttcccttttgtacacttagggtgactttccctgcctctgtttctaaggatgtattgta

SEQ ID NO: 509108 - DNA, 115 bp, Homo sapiens
tgccgacctagatgatcccccgttcctgcttcttgaaagggaggcctcgtgggtctgaagaagtagaagtcacacgtgttcctaggggaactggtttcaagaagcaggaactagg

SEQ ID NO: 509109 - DNA, 1309 bp, Homo sapiens
tttttttcctgcgattgggtccattttacgtttgttttttgtgtgctcctgtttgctgtttgtgtcgtaggggtgtccttttgttctctgctgcacttggcgtattcttgacgtgttcttttgtgttgttgctgtgttttgcgtattgtgtgctgtttgtttttcgctcttttcttctcttgcttctttttttgtttcttttttgttttctctcattatgtgtttttgtttgtgcttctcttgttcttctcgtgcttttgcgggtgttacagttgtttgggcttcgtgggattggttttctttggtgtgtctgcttgttgttttccatttactttggttggtgctctaattgtgcggcttctttcgttttatcttcgcgtgtgtcctctttgtttcatgtggtattgttgtatttcttttttttatttgttgtgttgctcccatctgtcttgtgatcgttgcacaacgttttgtggggtcatagtttgcatgtgcggttatgagtacttggcatcctcatatttcttctttgtagtggatttagtggttccataccaattttattttacacctcgtcatcgtcttcgtcgtcgtcttctcttgggtggaggttttagtagtggttttggtttggttcctatgttgtcttctcgcgtgcgccatgcgtggaggcgacgaggcgtgggggtgctcgggtcgacatcgagaggggagcgcgcgtgttggatgcacgccgcactgcgaccacttgcgctctcacaccccgagggcccattgagaggaaggcgggggatcacagagtgcacagcctactctcttttcgctgttttgtttgtatcttgtgtgttaaggggttttttgtgttcgcttgtggtcacgcgcgctgctctcgctctgggccgcttgtgtctcctgtgtctcttgttttcgtcgctcctctccccttgctgtgtgcgcgcagaagtgagcccgcttgcgaggcacacacccaccagcgccataataccacattcgcacacacagcgcactcatttggcaagggggcgtcagtgcacagctatgtggctctctcgccgcgcgcgcgcctcgcgcgcgcgcacgcgcacacaccaccacagccccaccgggacagagcaccaggactgccctgcgggggacaaacacacaccacaccacccccgcgtgtttctcccgcttgtacacacacaataggatagcgctgggccccccccccacgccacgacaccggagaccccggcccccccccggagggacggacacacccccccccgttccctacgacaacaca

SEQ ID NO: 509110 - DNA, 147 bp, Homo sapiens
cacatgagccttgtgactgccaaacatggaagaattgcgctgcaaaaaataaccgaaatgaaaccagaagaactgtgtgggagttagtgaagcctacgaggatgaccgccaatggtctgctgagtgatgaactgaactgccaagcct

SEQ ID NO: 509111 - DNA, 371 bp, Homo sapiens
atgcctgctagcctgactctagagtatccccctggagtccacacgggagtagagcggctgcctgccaaggacatacagaccaggtgtctacatcaagcacccagtgtccctggagcaatacctgatggacgcggcagctacaacacagtgttcctggccaacgggtaacatccccgccgagagctacaccttcttcattgacatcccgctcgacactatcaggttattagatcgctgccctgccatcgagtaatgcctaccgagaaaactccttttcactgaggtccaccctggatcctcttcttcatacacaccccagcaagatcagccccccggtgtacctacctcggaattcgtcaatcatcgtccta

SEQ ID NO: 509112 - DNA, 352 bp, Homo sapiens
  misc_feature (285)..(285): n is a, c, g, or t
gctaaaatcttttttcttatttatttgttaaggttcttttttaggtttgttattagaaataattgaccttggccgggcgcggtggctcatacctgtagtcccagcactttgggagcccgaggcgggtggatcacgaggtcaggagatcgagaccatcctggctaacacggcgaaaccccgtctctactaaaaatacaaaaaaaattagccgggtgtgtggcgggcgcctgtagtcccagctgctggggaggcttaggcaggagaatggtgtgaacccgggaggcngagcttgcagtgagccgagattgcgccactacacttcagcctgggtgacagagcgggactccgtctc

SEQ ID NO: 509113 - DNA, 228 bp, Homo sapiens
gaccttcccaagaggcctagaattgatgtggcttcctcttaaatattaattattagtcctgaaagaaagataacatatgtgatttttgtgtggtaggagagtgtcaagatatgtttttttcttcagccttctctgacttttctctttgggggcttcagattttatgattacatcttgtcccccccagaacatcctcctcttctccccatactgctttttaaacagatg

SEQ ID NO: 509114 - DNA, 498 bp, Homo sapiens
tttggtggcaggtgcctgtagccccagctactcgggaggctgaggcaggagaatggcgtgaacctgggaggtggagcttgcagtgagccaagatcacgccactgcactccagactgggagagagagcgagactttctcaaaaaaaaaaaaaaaaaaaaaaaaaaaactttgtgtggggcgcggcttgggccttggaaaaagttttttaaacaccatatccgtgttggggcgcggggggcccacaggtaggtgctacggtgagacctggggccaaaagcgcgtggttcccaaaggagaaactccgggggccattgagccaagggcgctgggggttctttcccaattttaaaagagagcgcccgggggggcacaaccgggagcgcgtttctggacacaatttccgaggatgtggggttccgggaggctcatcaggggctctctttcacggggggttccagggcagccccgaatttctcaattttgcccgccgtgggggcg

SEQ ID NO: 509115 - DNA, 235 bp, Homo sapiens
tagcccacaaacaccgcaatctcatgaaaatgtattcctttaaaatattgttttcctactttctatttaacaagatgattcattttactgtatggggttgttgttaatataaatgttgctctacaccagattgcttaaaagcatttttattatatttatgttgttgaactaatatatgaaataagtaaatgtagctcccacaaggtaaacttcattggtaagattgcggtgtttg

SEQ ID NO: 509116 - DNA, 293 bp, Homo sapiens
aacaggttagtttacctactgatatggttgttgccatggaatcctgtcagacagagaacgcaggtcagacatttggtgatggttggtaggagccaatggggaagtacattgtgggatatatgaacgcttaatcaaatcccgccagcgaagatacggcagcgcccggagctcggttggctcgataccggtcccccgcctgtcccccgcggccgcccccccccctccacgcgccccggcgcgcgggagggggtgccccccgcgcgcgggaccgggtccggtcggagtgccttcgt

SEQ ID NO: 509117 - DNA, 201 bp, Homo sapiens
gacgctctctctgttggggccctgaggacggggccctcaaatctcagtcctgctgtgagtgagaccaggcctgcctcgcttaccatcctgctctcgtgtgtcgtgtgtgagcccagcagaaccccgtggaacacagtgcagcgtgtggacaagtgtgccatggacgtcccgtgcactcgtgggccctgttcctgtggcatc

SEQ ID NO: 509118 - DNA, 383 bp, Homo sapiens
attcccatacactacatccgcatgttctggattcgagagatacttgacaatgtccacagagcaatggaagagcagacagatggtgacaagaaccgctgaatcatgctggaacaaaagtggcagcaagatgttgtcagagaggtagcctgagtccagtaagaactgcttggattgggagtcggaggcgagctgggcagcattgacgacgacggcccgcgccatggtagggatgcagccccgccacagtgtgaggacaccctcttcccgggtgattcgcatcagggcgttaaacacatttttgtagccacggcgctggtcagctggaagccggccatcggcagtcatgcggatgagagccacttcggctggtgttcccacaacgg

SEQ ID NO: 509119 - DNA, 917 bp, Homo sapiens
caaagaggaacagctctttggacactaggaaaaaatcttgtagagagagtaaaaaatctaagacccatagtgggcctaaaagcagccagcaatctaagaaagcgttcaagctcaacagtcactacctacaaaatcccaagaccatataactgaactcctcacacccaagtggaccaagtctatcaccctatagaagaacgtagatgttagtcataatgtaacatgaaaacattctcctccgcataagccctgcgtctagcattaagacactacgtgaactgacaattggaagcgagcccaatatctacaatcaaccaagaagtcattattaccctcactgtcaacccaacacaggctatgctcataaggaaaggttaacaaagaagtcaaacggaacttcggccaaaatcttagcccgtcgctgttaaccaaaaagcatcagctctagacatacaccagtattagaggcaccgcctgcccagatgacacgatgtgtaacggccgggtaccctaaccgtgcacaggtagcataatcacgttgtccctgaattagggacctgtttgaatggttcaccgagggttcaagctgtctctaactgtaaaccagtgaaattgaccctgccgtgaaagaggggggcatgacgaccagcatgaagagaatgaccctatggagcttgaatttattaatgcaaccagtaactaaggaaacccacaaggttctaaactaccaaacctgcttctaagaatttcggttggggcgactcggggcaaaaccaactccgtgagtcattgctaggcttcccagacaaaggaactctatgtccatgggcatactggccaacggaacataccaaggtaaaacggactctttaaagacaatcaaacaggttcgcacccattgagagaaccctgtgaca

SEQ ID NO: 509120 - DNA, 439 bp, Homo sapiens
  misc_feature (439)..(439): n is a, c, g, or t
tcgtcgcaccgtgagctggtggtcatcctcactgcatcattacatgctaactcatactgcattagcatgctaagagacactcccaccagcaccacgacagtctacaactgtcctgcaatcaggacagttaccctatatggtctaaaaaggggaggcaaccctctgtggcggagaattgccccatcgtctttcctcagcacactcatgaataatccaccccttgtttcgccatatactcccagcaattccaaataagtgtccagcaactgagcctgcccacaccgctgctctgcctcatggcagtcagcactcttttcattacttcactctcttaataaaacttgctttcactttattctatggatttgcctcaaattctttcttgagtgagcaccaagaaccctctcttggcgtctggattgggaccctttccggtaan

SEQ ID NO: 509121 - DNA, 872 bp, Homo sapiens
  misc_feature (162)..(162): n is a, c, g, or t
  misc_feature (218)..(218): n is a, c, g, or t
  misc_feature (383)..(383): n is a, c, g, or t
  misc_feature (498)..(498): n is a, c, g, or t
  misc_feature (545)..(545): n is a, c, g, or t
  misc_feature (636)..(636): n is a, c, g, or t
  misc_feature (639)..(639): n is a, c, g, or t
  misc_feature (642)..(642): n is a, c, g, or t
  misc_feature (648)..(648): n is a, c, g, or t
  misc_feature (659)..(659): n is a, c, g, or t
gagatcggaggagactggccggtcgttttacacgtaggaggcggggccttcggctttgggcgcgatggttaaaagacagttggtgtcggttcggcttctcgggtcggattccgggtcccaaccttccccatggccgaccctgaggagttgcaggttcttcgncgccccgcgcctccctctctccctcctcttcagacgcctctgcagcatcttccccngcggccagtgagtttgggctggccagttccgagcaggagcagcggccaacggtggaccagctggaggaagtggagctgcagatcggagacgcagccttttcattaaccaaacttcttgaagccacatctgcagtatcagctcaagtggaagaacttgccttcaantgtacagaaaatgcacgtttccttaaaacgtggcgggacctcttgaaagaaggctatgattctttgaaacctgatgactgatttggcatacttcgtttgtgtaataatgactgcnataattcatacttcttatgtcatattttgtacattaccacacatatnggatgacctctgtccagcagttctgtatatctcagaatgaaatttttcttggttttcttggtttttgtgaaagcagaataccgatgctatnttngtngcggancagtacttgtntgtccttaaatactttatgcctctgaactttcatagaatcctttatgaaagttaacttcatcaatagacggttaatattaatagagccacagcgctaccagtagcaaactaggtagaccattatttgttttgcaacaagatgctaagcatggcagacttgaagttgcgtttcatcttaaggaccagggaggtacttaagtgcacagcgtgact

SEQ ID NO: 509122 - DNA, 761 bp, Homo sapiens
  misc_feature (48)..(48): n is a, c, g, or t
  misc_feature (178)..(178): n is a, c, g, or t
  misc_feature (191)..(191): n is a, c, g, or t
  misc_feature (272)..(272): n is a, c, g, or t
  misc_feature (387)..(387): n is a, c, g, or t
  misc_feature (434)..(434): n is a, c, g, or t
  misc_feature (525)..(525): n is a, c, g, or t
  misc_feature (528)..(528): n is a, c, g, or t
  misc_feature (531)..(531): n is a, c, g, or t
  misc_feature (537)..(537): n is a, c, g, or t
  misc_feature (548)..(548): n is a, c, g, or t
ccaagtcccagccggggagcggtgaaacagccacagcgcggccagagnggtccgcgaatcccacagcacgacgcacgcgcagtgaaaggcagtagaaggcggggcgacgcacacggcttcctgggaggtgtagttttctctacgagtgcccttcgagatcgattggaggctcgcgcangagccgtgagttncctaaggcagccttttcattaaccaaacttcttgaagccacatctgcagtatcagctcaagtggaagaacttgccttcaantgtacagaaaatgcacgtttccttaaaacgtggcgggacctcttgaaagaaggctatgattctttgaaacctgatgactgatttggcatacttcgtttgtgtaataatgactgcnataattcatacttcttatgtcatattttgtacattaccacacatatnggatgacctctgtccagcagttctgtatatctcagaatgaaatttttcttggttttcttggtttttgtgaaagcagaataccgatgctatnttngtngcggancagtacttgtntgtccttaaatactttatgcctctgaactttcatagaatcctttatgaaagttaacttcatcaatagacggttaatattaatagagccacagcgctaccagtagcaaactaggtagaccattatttgttttgcaacaagatgctaagcatggcagacttgaagttgcgtttcatcttaaggaccagggaggtacttaagtgcacagcgtgact

SEQ ID NO: 509123 - DNA, 1785 bp, Homo sapiens
cgtagagtcggtctgaggagtgtacgtgtttcaagctatgtgctgggacggaacccgggtcgctagttcagcatcccgtgcctggcgaccatattcaaccgtccgccaaactttatacagccagccagcactcagttacagtgtcgctccaggtccgtcgaacggaacgctaccacgattctcattgagggcacagtctggcggaacggagcagagcggagctgcgtgcagttgtactggcctgaacagggaacagtctgggtatcatcgtgcggaagagagcggcacatgtaacatccacgaggcaatcggacatctttgagatgcactgatctaatctaatcacacgcctagtgtcaaaacacgttgggtaatcgacataatctggcacatgcacgtaactatcaagcccgaggtcgcactaggtctttgacctgatcattttgggactcggaggtattgatgatgaagaggaagcagagacacctgtggcagcgaatcaatatgttttctctacaagcatgtacttcaatgcaggacgaaagagggcatatgactgtttaggaaggaccatctgggagtgggaaaagcctcgatcgaacaacctataattgtagggatgaggcgcgtcacttgttttggatatagaaaggaatgaatacacggggtaataaaggacagaatacttgtcgtaacttgcacgctgtggtacggagcgtaggcgtagacctggacacttgtgaaaataggagaaggattgcattggacaatagtgcacatgtaattgtgagagacacgaataactaatagatagacggattcacagataggccactagacgtgtgagttacaaccgttggacaaccaccataggcggttggagttcccaattggtaggaagggcaaccccaaatatgtaacgggcgcctctcgaaatatggggtaggggttagaaacgaacctaattggggaagtacggcgtcaattattaaacctttgcgagatttgacacgccagggggttggcaaccattggcccacacttcgccattcttggacaatcttgagaggggtcgccaggcacacttcttgagaatcacacaagaggaaaggtaatgttttcgcccatggaggacgaagggaggcacgcggggcgacccgcaatcccccaatggaactggtcatgaggcgcaggcgcatggttacatcaacggtatttgcaccccgaggcgacatattggaagtggagaaagagcacagggggcgagagtcacacgaaaatgggggggggaaaatgacatctggggcgcccaataaattctacttaccccgtattaacccgcgtgtgagctgctgacacattttccccagtggatgtccacggcgcgcaccaggcaatagtttcggaagcctaagagcggcgataagcccaaggcaaccaccgggatactgagtatacgtgttggttcgtcacaagcccaccacttaccaacaagacgacgcggggtaatagagcccaacaccgtgaacgacacgaggaaaatctgggcccccaaacaaagaagaaacacaaaggggccggcaacacagaaaaccaaccgacacagaggacagacgatagcgacaacaccatggtgaccaggcagaacgaccacaagagcggagcagaacaagagaaaggacgaggagaaccaaacgcaagtagcacgacccaggaacaccaagacaacagaggagtaagaagcagcagcaaagacgcaaacgtagtcagaccaaagcgaggaat

SEQ ID NO: 509124 - DNA, 107 bp, Homo sapiens
aaattgcataggggaaataccataaaagtactggtctcatttgttggctttttcattactgtccttatcttcctgggctcttagttcctcagctgcctcgaaatcac

SEQ ID NO: 509125 - DNA, 340 bp, Homo sapiens
  misc_feature (196)..(196): n is a, c, g, or t
  misc_feature (201)..(201): n is a, c, g, or t
  misc_feature (220)..(220): n is a, c, g, or t
tctgttctagagcggtgtaatatttgccgagctccttgtactataatgaatcctatactgtataagccttcctgtgttggcgtatgacagccagggtaataatgacttgttggatgaaagttgatatcgggcttgtaaattgtcagttcagtgcttctaatctgcactgcatgcttatgctggaggagcaatgttntcatngttacttatactaacattngttcttctatagggtgatagataggtccaattgggtgtgaggagtccagttatatgtttgggatattaaaggtagtgggtgttgagcttgaacgcttacttacctggtgtctgctttaag

SEQ ID NO: 509126 - DNA, 360 bp, Homo sapiens
gcagacgggaggtgaccgatccttggaggtagcacagaggggcccaaagccctagatcctcagggcaagaccaactccaagtccagggaacagctctatgcacagggctgcccgtcatctctgacaaacttaagtggcgtggcttatcttctgaccttaaagatgtcgttctgggtaggggtgtcaatgcacaaatggagcatggcctctctggtcacctcaaaacaatcctcttctaagctcctctctgggtagggcagccaggagaaggcagcaccctcaggaaggtgccactggagcctctcgtcctcaatggctcctttgcaaatctgatagaagatgtggaagttcctctcactg

SEQ ID NO: 509127 - DNA, 435 bp, Homo sapiens
taaagatggtcgactgaagaggattccatgtgcgccgccaggttctgtggacagtcacactgggaatccaatgaagggtctgtcctgttcgagctgctgctcgatcctggctgtcttctgccattcaggtcatagccttgttcctgtttttaaaatcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctgg

SEQ ID NO: 509128 - DNA, 363 bp, Homo sapiens
acgtgtgaatcagtggccctcatgaatcattatgccttagctggttgctagtgcctgctatgcccttttcctatactctcgaaaggaagctaactaaatactaacgtctctagacgctcaggagctagaacccggctgaagtatcctgtccggcatcatcctaggcctcatcggcctaccatccctacggcatccgtttagataacagaggaggtcaacgatcgctcccttgaccatccactcaattggacaccaatggtgctgaacctacgagtacgccgactacggcgggctaatctgcaactcctacgtactgccccccattattcgctagaaccatggcggactgtgcaatcaggtgtg

SEQ ID NO: 509129 - DNA, 223 bp, Homo sapiens
gatgtggtggcatactgccatgtactcccagctatacaggaggctgaggcgaaagaattgcttcaaccatgggagacggaggatgcagtgagccgatctcacaccacgttggagtgccaaacatgggcaaaaaagtaaaactcaaagaaaaaaagccataaaaattttccacattttttatgaaacacacaagcaaagcaagtgcagcaatggctgggtgtgc

SEQ ID NO: 509130 - DNA, 189 bp, Homo sapiens
tctttaattttagggtacttgtgacatatagtatgccttagagtaaaagtatttttcttcccatgaggacagataatatgtcttcattcatttcattcatgcagtcaattattcttctagtcatttatcaatctgataaacatttattaaaaatctacactgtggcaaccactgtgttacgtaagacat

SEQ ID NO: 509131 - DNA, 888 bp, Homo sapiens
  misc_feature (1)..(1): n is a, c, g, or t
naacaagcgaaatgacagaaaagaacaccctgcaatacacgcatgccacacatgatgtggtcgctgccccacatccccggggagcaacagtgcgcaccaagaggtgtcgcgagcgccgtgcgttggaccgcgtgccccggcatgaaccgattcccgcccctccaagtcataaggcaaaccaggacaacaacaaagccgccttcgaacaaaacctgggctgggctcgcggagccaactacctccccagggcgtcaaaattggtgaaatttcaaacccgggcccaagagttgcaaccaccctggacgaccacgggaaatcgcgcgtccgtcaagaggccccctccttatttccgggaaggaggaaccccctggcaaacctgcaccgccgggcaagagccgaaattaataggaaatcaggggcatttgcgcatgagcctaccaggagagccctcactgcgctccatgggccacccggtcatgccaagagtgtttgggtctttcacatccacacacccgaagtgtcccgttacaacacacaagggttccccgcacatcccacgcgtatggccccagggccatccccacacacgacaaaaccctgggttaacacaccaacacgggggtctcaccattgcgtctatgacaagaaagggaggggtcagaatctcggggcaggccgagccctaggaagaaaacccacactcggctggctgaggagcacaacaaagccgcttgtttcaaaacagtattcccaagcaggcgtgccccaagccagagaaacgccgcatcaacgagacgatctctggaggcataataattgaagtacggttcaccaatgccacccattcaggaagcattttaacaaaagcttaaggttcccaacaaaaaa

SEQ ID NO: 509132 - DNA, 237 bp, Homo sapiens
gcagagttacggagtcgcaggcagaggttttataaaaacttttaggatgtataataatagacctgtccgggggcataggagataaatattcattatctagcagaggatattattacttgaatgttctcagggaggcaacaggtcagaaggcctaggatctagtcctagctacatcatttaccaactgagtgaccttacttcacctctcagtcttgctcttctcactagcagcagtat

SEQ ID NO: 509133 - DNA, 526 bp, Homo sapiens
ggttcaaccaatcaaattccaatgcttattagaaggaaagagacgaaggattatggaactaacgcgtctgtacgaaggaactcattaatccaggagaaacctgtttaatcagttgaagatgttgtcaccaggtggatctagtgtatggaaactgttgaggttcttcagaaggagggcttgatggtcactgagtgctatagatgctgttggacgagagagcagggaaggtgataggacaatgttgaaggctgccacgggatccgggcgtccacgtctagttgtgtacattgtacgaaaatgttggagattctcgagcgaggagaaaaaagttgatgctgagactagttgggagagtgaagaggtttattgcatggagaatgtctttgtggtacgagacagtcatgagtggttctcccctttatctaatcgaggaagcgacccaatagaaacatcatgcttatcgggtgacgacggtgctgcagcatgctgcggggactccaaccggattcgaattccgaacgctgtg

SEQ ID NO: 509134 - DNA, 225 bp, Homo sapiens
  misc_feature (38)..(38): n is a, c, g, or t
tagtgtatagtgagcggagcgagagtagtgtgcataanatgataggtctagttagagatcagtcgctttactgtggttggttcatcgtcgggtagtgatcagcatgtgggtggatagcgatgtgagagaattggggtgggatcataagggggaataaatgtccgactgcgggggtaggctagattgtgggggcctgactgaggaacgatctcgccatttaggtcc

SEQ ID NO: 509135 - DNA, 546 bp, Homo sapiens
ccccacactgggttcgagttcctgacggctcttatttgaaagactctaatttatttccttacgtgtttgttgtttggggtcctttaccttctttgttctgcccccgatttaaatactgtgaggactaagggagaagactaagtcaaggacgatcccccaagtttctggtttgggcaactgggtggaagatagtgccattcactgagatggggaacagatttgggactgacagagggaagatgatgagctctgttcagggtacctacctgatgtaaggtacctgtggggcattgagaaagagatattagtaaatgactggatgcgaaggaagcactgctctggattggtgacttgtagagagggtaactgaagccacagggttcatactaagaaagtagagaacaagaagactagagcacctaggatacagctctgaggaacagcaacatttgaaagaccaagaaaagccatgaaaaaccagagcaggtccgggaaaagacaagatcccttggcaagaaagacccacagagccctactctgcatgca

SEQ ID NO: 509136 - DNA, 653 bp, Homo sapiens
gcaacgcatccgggtcggctcctggccgggagcacagatggctgacggcgatcgggagccgtcggcagcatgctctcatgaggagggccttccacgccacgtcgatgaacttcatcgatatccagaaagataggacaatccacatcgagtgtccagacatgggaaaatgtaagcgttctcaggcatacgctgactagatcggattcatccttagcctcaaggatggtgtgaaggggaaggaagctgaccgttcgaggtacagcattgtctcacgatggcctattgagaaatctagatcgctcttctcaatcacagctgtgacgaaggtgcgattgagtgagactcctccagtggaccatgcctctcggtttgggagtatcggcatacaggacctggtatgtccaaagttgatgagtgaaagcaggaacacttgtggtggacacagtggtccctacccatctggcagcttgctgtgcctgacggtggctgtttacctaaaggagtcagtggggaactccacgcgcattgactacggtcacagggcattgaggcagccttcgctgctttcctctgctgtctctgcaagattggggtgctccgggtggatgaccaaatagctattgtcttcaaggtgttcaatcggtaccttgagg

SEQ ID NO: 509137 - DNA, 290 bp, Homo sapiens
agaggatggttactgtagaggagtgagaaaaggaagaagaagggagaggaatggcatgaccagagagcagagaggagatggggagaagagcctgggaagggaggacagatgtgagggtgacctggacggaaccaacagtggccagtaaagcaaaacttccggccctgaaacccaggctggggaactctcggtttcgggcccctcgtcggtactctctgggggcgccaaggactccagggctcacttgggcccctgcggggcaattaagtccccccaagctccaagggggg

SEQ ID NO: 509138 - DNA, 113 bp, Homo sapiens
ttcttgggatttttctcatgaaccacagacagctggttgactgtgacttcttctcaggttctgtttttacagccttggtttctgtgggattcgtactggaagacttgctgggg

SEQ ID NO: 509139 - DNA, 700 bp, Homo sapiens
cgcgatgtctcgcatagtcaagagttacgccccgcctgagccgaaatcggccatgatccacctgggcgaaagagcgaaatctgtctcaaaaagaagaatttccctatttaggaaagaagaagaaattagaaaaactacctggttgagtctcaattctcctttgtggacccttggaatgaatatctgtgcacattccccagcctggtatctatctttgtccagcagcctgggagccacagagggtgaatgtgtgtcacttccctctttgctcaaggcccagagcagcgccggcagtgcaaatgctctgggccaacaagttgaatgagtggggatctggggcctccggggagggaaacagtgacctctgccctacagagctgaggaaggttctcagaggaagtgaattccagcctgacctggagaatagaggggttggagtattgcagagaagggaaagttgcacaagaggtgccgggaacggttaccaatgacacaggggagcatgatatgtgaggcgaccgtaactatgctgctaaacacgctcgcatggttgagagaattggcaggagcaccaggctcctttctcacccgggcaaggaactggcgcagtgttcggatagacacactacatcaagcaggcacgcactaccctagagagagaggcaccacccgaaagggaggcaaaaaacggagaaggaat

SEQ ID NO: 509140 - DNA, 110 bp, Homo sapiens
gcggccgcctactactactactgctcgaattcaagcttctaacgatgtacggggacatgcaacgtatagagtttccgatcaccttcggccaagggacacgactggacatt

SEQ ID NO: 509141 - DNA, 135 bp, Homo sapiens
gtgagggccacacgtcctgactcagctgctcagaccacccctcgcatggaagtgttaaaggccaagagtaaaacagcacgtaggcccattcgcctcaaagtgactaagaatacaacttgcccttgcatctcgacc

SEQ ID NO: 509142 - DNA, 903 bp, Homo sapiens
cacaaaagggtttttattcaaaaaacgccaagtataaaaaaaaaaataagatctctttaatcccccgtgttaacagtatttcacctcagaataaggaccagcgagggtaccggagggtcaaaataaatgccccagaagaaggaatctggaaggcacaccaatccagaactggctgtggcataattatcctatatacacacggtcgggaatgcccctcgcgatctacccacgagagccggggacccacctggataagtagtgtagacggggccccacagaatgccacgggagctgcagcactttgtccctgcctgattccctgtgaccccagaaaaaggagcaatgctgtctggagacctcccccaaaaggtccccagggtcagaggaggagaggaggaaacgaaaaacttagggcacgccagcgtattggaacgctttggcaataggcaacgggtaaccaagataagctaacgtaagctaatataccttaacattggacctccaggttaaaaggccgcatctttcaaagacaagaaacgaaaaaacgggtaagccctaccttaaaggcaaaagtttcttaaacaattagatccactacaagtctttctggtatacgtaccatgccagagttgtacacacatttacagcgtttcgcggtgggaatgcatggtggagcattaagggcagtgtgaggactgggtttggaaaacagttaagtaaaacccaaagaggggaagaccaggtcactcggaggttccaactaaaggggcggataaaagggccaggtggtcacaggtttgtcctgaagccctcttccagggaccttcataattaaggagggggggtgggcacacccggcacaaaaaaaatggggacaaacccggcaagtttggggaaccccgg

SEQ ID NO: 509143 - DNA, 680 bp, Homo sapiens
tacaaatgaggcaatttttaaccccagccagggttgggctaatgcttctggtgggcagctgccacctgtccgggcaattctgtccaaatctcttggtccctggagttgccaggtttggcgggccgccattctgggtccttttccaccattttcaagcccctcccagggtctggagaggacccggggggccaacctctctagggacgcctcggtctagaatgtggggctgggcgctctagaccgcctgtttcctcctagactgtcccccataagtatcttgggccatggagagcgccaaacccacagggagcccaccccggagaggtgtacagtggtggcccgctcctggtgggaacacacggtctccgcgttgtaagaaccatgttcctacatctgaaggagacgcaagctccttatggtggctagaggccacgtttggaccggtatccacccatttcggggagacttaccaagcttgcccgggactaatttgggagagaagggcttgccaagagcttcttgacagaacctccattgagtggacacacgcttttttttcccacgcccatgtgacccctataacaaggggcccctcttcagcccctcctaatgaccctccgggcctagccaatgtagaattacacttccactccataaggcttcctaataataggcctaat

SEQ ID NO: 509144 - DNA, 356 bp, Homo sapiens
ggtggggtcttgcattcaagatgtgtgatcacagtagagagcacctcctcagcctcctgggtagctgggattataggcatgcatcaccatgcccggctaattttttttaaatttatttttagtagaaacagaggtctcgctgtgttgctcatgatggtttcaaactcctggcctcaggtgatcctcccaccttggcctcccaaagtgctgggattacagactgtgctcagctgctgttggtttgcttttgtttttgtataaatggggtttttttgagacggagtctcaccctgtcgccagtctggagtgcagtggcaagatcctggctcactgcaacctccgcctccctggttcaa

SEQ ID NO: 509145 - DNA, 182 bp, Homo sapiens
tactttcacaggtgctatgtcctatctggagaaaaaggtctgaccttccaaactcttcacaagcacactgagcatacaaagcaagtgtcatgccaggtgatagcccagagcttccacgaacatgtcaccagccttctatgcggaaattcacactccatggacatatacgtaccaacagaggg

SEQ ID NO: 509146 - DNA, 909 bp, Homo sapiens
  misc_feature (379)..(379): n is a, c, g, or t
  misc_feature (557)..(557): n is a, c, g, or t
  misc_feature (588)..(588): n is a, c, g, or t
  misc_feature (591)..(591): n is a, c, g, or t
  misc_feature (595)..(595): n is a, c, g, or t
  misc_feature (600)..(600): n is a, c, g, or t
  misc_feature (604)..(605): n is a, c, g, or t
  misc_feature (609)..(609): n is a, c, g, or t
  misc_feature (617)..(618): n is a, c, g, or t
  misc_feature (624)..(624): n is a, c, g, or t
  misc_feature (626)..(626): n is a, c, g, or t
  misc_feature (637)..(637): n is a, c, g, or t
  misc_feature (657)..(657): n is a, c, g, or t
  misc_feature (659)..(659): n is a, c, g, or t
  misc_feature (684)..(685): n is a, c, g, or t
  misc_feature (690)..(690): n is a, c, g, or t
  misc_feature (699)..(699): n is a, c, g, or t
  misc_feature (704)..(704): n is a, c, g, or t
ggaatttgaatgaggagcctcagcgctttcgggccattttcgagtgatgcctgatctcatcaatctagcgggagagacaggcatcatcgaaaatggcaaaaattacttggagcaaagggcagtcggggagttcgccaaggtgggcagtcggtttgtgacctgtagcagagaaccaattctggagaacagcctcacttcttgtgatggaatacttacataatgcattggaacatgaccatgagattaaggttcaatcaatgatagaatggaagaccacaataaaagagacctctacttagctcagcaattcttacctttcttacctatttgatgaagatgtcttttgaaaggtgtactggcaagggacacacaaatgttntgtaaattctccttttaccaagggtggataatttactgtaccttcctcatggaaaacgtttctatttaaaagtgttatttctcattgaatacttatcaaaaaggaaaacaaaaatgactaaatttggagatagatgggtctagtaagtatagttatatcacttgcatatctgggagangaaataagagatatcatcagtaattcccatntantaanaattntttnncctngtcagggnntacttntnacttccattantactatagttgaccctttantnagactaatctcacagaaataagtanngtctnacttgttcntaaanacatcaggattcgagagctttgtagcatgaagggaattttgggaaaagtgtaccttggaaaatgaaacaagaggcgtgggcgataagagagggataaatacgggtacagaggagaaagagaagcctagaggaagagaaataggggaaagcttttgtggttgtgattttccttgttaagagaaggaagaataagggaaaaagaaag

SEQ ID NO: 509147 - DNA, 1053 bp, Homo sapiens
  misc_feature (129)..(129): n is a, c, g, or t
  misc_feature (523)..(523): n is a, c, g, or t
  misc_feature (701)..(701): n is a, c, g, or t
  misc_feature (732)..(732): n is a, c, g, or t
  misc_feature (735)..(735): n is a, c, g, or t
  misc_feature (739)..(739): n is a, c, g, or t
  misc_feature (744)..(744): n is a, c, g, or t
  misc_feature (748)..(749): n is a, c, g, or t
  misc_feature (753)..(753): n is a, c, g, or t
  misc_feature (761)..(762): n is a, c, g, or t
  misc_feature (768)..(768): n is a, c, g, or t
  misc_feature (770)..(770): n is a, c, g, or t
  misc_feature (781)..(781): n is a, c, g, or t
  misc_feature (801)..(801): n is a, c, g, or t
  misc_feature (803)..(803): n is a, c, g, or t
  misc_feature (828)..(829): n is a, c, g, or t
  misc_feature (834)..(834): n is a, c, g, or t
  misc_feature (843)..(843): n is a, c, g, or t
  misc_feature (848)..(848): n is a, c, g, or t
ggaatttgaatgaggagcctcagcgctttcgggccattttcgagtgatgcctgatctcatcaatctagcgggagagacaggataacctgtccgagagtatagcgccactatgactccgccggaaaaatnactttaaaaatcgccatcatcgaaaatggcaaaaattacttggagcaaagggcagtcggggagttcgccaaggtgggcagtcggtttgtgacctgtagcagagaaccaattctggagaacagcctcacttcttgtgatggaatacttacataatgcattggaacatgaccatgagcatctacgtggtataaaagccacaatgtcccgttctaaacagttgcgaccattgtgcaatagcattctattctaacaccggtattaaggttcaatcaatgatagaatggaagaccacaataaaagagacctctacttagctcagcaattcttacctttcttacctatttgatgaagatgtcttttgaaaggtgtactggcaagggacacacaaatgttntgtaaattctccttttaccaagggtggataatttactgtaccttcctcatggaaaacgtttctatttaaaagtgttatttctcattgaatacttatcaaaaaggaaaacaaaaatgactaaatttggagatagatgggtctagtaagtatagttatatcacttgcatatctgggagangaaataagagatatcatcagtaattcccatntantaanaattntttnncctngtcagggnntacttntnacttccattantactatagttgaccctttantnagactaatctcacagaaataagtanngtctnacttgttcntaaanacatcaggattcgagagctttgtagcatgaagggaattttgggaaaagtgtaccttggaaaatgaaacaagaggcgtgggcgataagagagggataaatacgggtacagaggagaaagagaagcctagaggaagagaaataggggaaagcttttgtggttgtgattttccttgttaagagaaggaagaataagggaaaaagaaag

SEQ ID NO: 509148 - DNA, 582 bp, Homo sapiens
ctcttcctcacagagaacaaactctttatattcaccacggagtgccccacaccagaagctcattaaaagattttctgtttaatatgatgctataacgcaacctctcttatatcaacattgtatttttatattaggttccataagaaaaccaaaaaccagtataaatctgcccccgccccttttataaaaaatttctttctttattccccccacacctctcccacctcccccaagttttttgaataagctcgaacgcggttataattttgcggggtgtataaacacccgcggagaaaattcttgtcgccctccttcgttggtttatgtctatcagctcgggatcgagcggaggattttagaaacaagccaccatgcatcccccattaaaataaaaactgtcaaaaatcaccccgttcttgttgcaaacaacaggtgtttctttggtgccgcgtcgcgcgctgatctcctccactggggttcctgttgtcccccgggtgttgcccttctgttgttattcttgttgcgtgccagacgaacaaataacaccgtgttaatgggctggatataacaatagacagacaa

SEQ ID NO: 509149 - DNA, 265 bp, Homo sapiens
taaatgttagagttagcctgactcagcatgagcctggcttctcctgccggccggcacaggggtgggtaccatgcacatggtctccccgccctgcctaccatctgctgccctggaacccttggtgggacccgctgcccacagacaccttgcccgtgccccaatgccaggcagaggcccctgtgctctgaagagtgaataaaacgtgaaactggctgggcacggtggctcacgcctgtaatcccagccttgtgggaggccgaggcgg

SEQ ID NO: 509150 - DNA, 220 bp, Homo sapiens
gccgcggcttatggtgcagacatggccaagtccaagaaccacaccacacacacccagttcccgaaaattggcacagaaattggtattcatgagaaccccgttcacaaaggatacggattctcttaaggggggtggaccccaaggttccttagggacaatgcgcttttgccaaggaggcacaacaaaaaagggccttataggaggatgcaggccaacaatt

SEQ ID NO: 509151 - DNA, 218 bp, Homo sapiens
tccccccggtaacacgtagatatggccatgttatatatttcgattatatgctgcttatattactgtacatgtctgtaaaattcacagaactgttcacctttaagatgggtgagattttattcgtatgtacatattatacctcaccgaaagtgctcattgtaaagacagagaatgggaatcttgacgaggaaatcagtacatagcgtggcatcgatcgc

SEQ ID NO: 509152 - DNA, 940 bp, Homo sapiens
  misc_feature (940)..(940): n is a, c, g, or t
cggcctcgccgtatacgcaacaacgagaagcggctccagcatagactggcactacattttggaaaggtggtcgttaaacatttcccagcacacacctcggatctgcatcttgctgtgtcaattgaaccactcactaggatctgtgacctcagttcttcgtagactctggaatggagctggaagctcgcatcctcagcacactaacgcaggatcagacaacccagcactgaatgtccccacttatcagcgagacctgacgcagcagatcacttggacctatgaaggggaacaacacactctggggcctgtgaggtgctaggacagcccatctaaaacacccagctgccccctcgggctcattccgtccgctacccgcccatccccgtcgcaaaccccgccagtagtgcgcgccactaaactacatccagttcatcatgccccccgccatgtcgatcttgtacagatgcgcctgtcaaccgtacccgcgtccccccgccacagacaaagtacgcagcgtccgcttgaccaccccactgtacgcaactactggtagacttccaattcgccactactggccggctcgacattctgtatgccacttcacctaccgtccgtcgggtctctgtacgacattcctcctgcacccctgtgtctgctgttcctcacatctgccttcgtacttctcgactgctcctcaccaccctgtcccccatacctcactcgttctaaccacctcatcccccgctgtctctcgccccgctcccccatcccctatatacattcccccatatatttgcccctgtcttacggttgccatagacttgctctctcctctctcccacacttctcactctttccatactccctctcacaacaaaggctcgaacccaacccacccctcacgcgggtgctcggcatgttagccatgtccccccacctn

SEQ ID NO: 509153 - DNA, 108 bp, Homo sapiens
atgatttcatgtttgaactctcagacaagcctcttctcccatgctacaacctccaagtgtcagtgtcccacgggccctgcaactggttcctcttttccgatgtcttga

SEQ ID NO: 509154 - DNA, 324 bp, Homo sapiens
aaaaatatctcccaacagtttccttaaagtccataattttgggccaggcacggtggctgatgcctgtctgtaatcccagcactttgggaggccaagaagggcaaatcacttgagctcacaagtttgagacagcctgggcaacatgatgacatcccgtctctacaaaatacaaaaattagccaggcatggtggtgtgcgcctgtagtcccagctactcaggctgaggcaggaggatcgcttgagcccaggaggtggaggttgcagtaagccgagatggcaccactgcactccagcctgggcaatagagccagcccttgtctcaaa

SEQ ID NO: 509155 - DNA, 531 bp, Homo sapiens
ttagggcacttatgaaaggcgccgggtaggtttggagcgtagccagagcattcgacgtctgtgcgaatgtcagtgacgcgtcgtattcggaaagcgtcgcatggccggccagcaggatgcacccggggctggcgcgccggagatctgcaggttacgggttggatgggcgtgggcttccccgtgaaggctggcgcgacgccgtccctgatgttctgaagtcgagtagcgtcgtccaagtagtacgcgtcgaagtcatcaccaagtatcacgctggtgagatggcatggcgggtcggcatcgaccagcaggacccgatgcccttgctcggcaagcatccagccaaggttgtagacggtcgtagtttttgctgacgccacccttgtggttaaacaagaccaatcgctttgccatcactgaactcccagagatcaatcatctcaattgtaagtatcggggatggagagccctatcttgctccaaacggaaggcacttgcgcgattcaacggggcttaagttgcccgccaatcgaa

SEQ ID NO: 509156 - DNA, 220 bp, Homo sapiens
cgtggtacggagtgactataggagtcactatgatatgaggggtagttttagccctaatgggctgagccaactggaggtatatagggaagtgctaaattgcagaggtatcatgttgcccagcacttgatcaaatcctagatcctaggtctgcttggtagcatgcttcctaggtagtggatctgaggctacctatagaacttcctttgcagtcgtagtcact

SEQ ID NO: 509157 - DNA, 229 bp, Homo sapiens
acatgatgctccacgctcatcctggctcgctgtcaccttccagcagatgtggatcagcaagcaggagtatgacgagtccggcccctccagtcgcccaccgtaaagtgcttctaggcggactatgacttacgttgcgttacacccgtttcttgacaaacacctaacttgcgccagaaaacacagatgacgattggcactggctttatttagtttttttgtgttttcgttt

SEQ ID NO: 509158 - DNA, 558 bp, Homo sapiens
tctcagacacactcgaaccgcatcaccagatgatcaagatagtatgtggtattgatgaatattacgaagtgcgtgtgtaagagcaaagttccgcagctgctcctgaagacattccccatctggaaggagaaaattacgcatctcgcatggaggaagtcgattaaatccatccgtccatctgtaaatccctgatcactttaatttccgcaatcattccttaaaaccctgttctctttgaccctgtagaaaggtatacctgatatctctgtaatgattcctgaaaggatcataacgtgtaactgaagcatactgtccacttttttctctgttttgagccataatgaacttttgttttttttacgtaacgtgttcatggatctatgggttgctacagtattgtctgagcacaatgagcactgtgtttcactgatactgagtctgtgctggatcgagtcgagcatgattttattctgcatggaaaaggcggaaagacctttgcttgagtgctggcctgtgttgtgttggtttccagaaattaaaacacatggtgaaacctga

SEQ ID NO: 509159 - DNA, 1184 bp, Homo sapiens
cgcgagcttggagctgctgtgcctgggagcctgggagccgagcgcgcctgggctggtggccggggcctggagcggatgcggagtagggagctgctgcccggcccagccccgagtcccgcgcttccctcccgccgcagcgcgggcccagcggctgccgcccctagctcatggagcaagactaatcagcccccgaaagatccgagttcacggtccctgctgctggagcccgcaccttgtacccccgagtgcggcgggagcagattcggagtgcgccggccctacccctggctaccctcgtgctgaccagtgaccagatcatccccagagatagatgaagaccggatccccaacccacatctcaagtccactttggcaaatgtctccacagacaacggcaagaagatgaccaaggaatcacacccaacaaatgaaacgagctcccacactgactcgcgttcgaaacatcaaacctggacagccaaaccaaccagcacacggcagaaggcaacacctgaaacgagagcaccagcagcacaaccaacagccaaaccgccaaagaagatcacacaacacaacccaagagaacaatcccccaagcacaacccagcaaagtgcaccactccaaaagccatagaaacaaacccatcaatgagcgcacccaaccccacaaacccaccacctgcccccccaactgccacacaacctaacaaaacaacaacccacacacaacacaccaaccagaaacacccagacacacacacccaaacaccatcacaacccacactcaatcaccccaaccaacaaggcgacaatacgacaaaacagcaaaacccccaaacccatcacccacatcactacaacaaaccaaacccaacgcgaacacagcaaactaccaacacggccaaaaccacagaaccacaccaactgcaccagatcacagcgcgaacacaatctcacacactccaaacacaacaacgaagaaaaccacacgagaacacaccacaaaaaaaaatacccaatctcaaaacaacacacaagcacaaaaaaaaaacaacaaccacacaaaccaccaacaaaacaaacacacatacaatacacaccataacaaaacaaaaaccaacaccaatacacaccaacacacccaaaacacaacacaccacaacctcaaacaaaaaaacccacac

SEQ ID NO: 509160 - DNA, 174 bp, Homo sapiens
cagctaaccatcttaatgccccatctcttccaaacaagctgtccccaaaatgtagtggcactttcagtggctcagccaatgcaacaagcacagcccaccgcacccattacaaacattcagtgcatgcagcatttgaccaccaccatggcagctcataccctcaccatgcaacac

SEQ ID NO: 509161 - DNA, 359 bp, Homo sapiens
gagtacccgcccgaaattaatactgaacagtacacaaccttcacttctcataaggggtgatcgctaccaacggctcgctccagctggaattacagtaactgataatagaaagacaactgagaatattaactcgcttcaaacaatatattagtcattacgccgacattacataaaatcgccagtttcaagctcagttcagaggctcggaaaaaaatattctatacctagtaaagtgcctccattcataaaatgaaacatccaagattgagacaatatcatactgatgcgcatctaaaataggtcgacgtatacagtatataaccagcgcctctaagttgccatatttcagtaagtggaat

SEQ ID NO: 509162 - DNA, 602 bp, Homo sapiens
  misc_feature (261)..(261): n is a, c, g, or t
  misc_feature (417)..(418): n is a, c, g, or t
  misc_feature (443)..(443): n is a, c, g, or t
  misc_feature (456)..(456): n is a, c, g, or t
  misc_feature (458)..(458): n is a, c, g, or t
  misc_feature (464)..(464): n is a, c, g, or t
  misc_feature (480)..(480): n is a, c, g, or t
  misc_feature (486)..(487): n is a, c, g, or t
  misc_feature (499)..(499): n is a, c, g, or t
  misc_feature (502)..(502): n is a, c, g, or t
  misc_feature (505)..(505): n is a, c, g, or t
  misc_feature (507)..(507): n is a, c, g, or t
  misc_feature (510)..(511): n is a, c, g, or t
  misc_feature (514)..(514): n is a, c, g, or t
  misc_feature (517)..(517): n is a, c, g, or t
  misc_feature (522)..(522): n is a, c, g, or t
ctacaaccagtcaagcaacaaatgtttattgagcagctattatgtgccaggcactccactgagcatttggaatacaaagatgaattgaataggatccctgggatagacagataaatagggaacacaataaactgtggtaagttgtgctagaggggagaacaggtcctgtagaggccttggggagggtcagctaataaaagatgctgtggacaggccactcatttatccgcataggtgtgcatacatctcacaactcccgtntgccactcacagacaactttgtaaggtggtcctggtcttgaagttatccaggagagaaagataggtttgaaccaagggagagacaattcaggaggggaatcatttaattcaaaaagtattctggagttggaattgacaatagatttgagataaggnntaagggagaggaagggatccggctnataacagtccctntnaaggtnctgaggcttgagtgtntaaggnnaaaggaaaaccngcngancngcnnatnggnatgancaaaacctgagggacccctgccctctcacgcctcacttctccttatcttagaacctaacccagagggaatcacttctctc

SEQ ID NO: 509163 - DNA, 109 bp, Homo sapiens
  misc_feature (51)..(51): n is a, c, g, or t
gtacaatgttcaacttcctgcatctctctaaggattactccacgctcacgnttcaatctctgctactcccaatgtgctagtattgtattactatcagcaagaatttcta

SEQ ID NO: 509164 - DNA, 150 bp, Homo sapiens
ttaggggtgtgggtacaatggtcagcctggtcctcgcacctgccctggcgtcatgtggctgcaacgtgccaaatgatcagcggactgtggtctggggcacacagagagtgcaccttgtgattagctggatgtctattcctgtgattcaat

SEQ ID NO: 509165 - DNA, 898 bp, Homo sapiens
  misc_feature (698)..(698): n is a, c, g, or t
tagatattaataattaaagctgataagggtatcaaacatgcacataacttggatcatcatgattaagtggtaacttggtgtatatataaatataggtggtttataaatatatggcagaaagtatctggtaaagctctttaaatgaggggactgtggttaagagtatatattcgcttattttaaacttcaattatccattcttctgccttataataaaattttaaggcagagaactgaactaatatagaatttctccttgggagagtacataatgtacatagtgaacattcttataagaagaacagaataggtctaaagtggatgaatattataggctgcaaaggattttttacttaaaaaaatccatgaatatcttggatttattataaagcatttgtaaattatgtgcatttgagctgtaagattcataaacatttacatttcccaatgattctattgggattgtaaaacaatatacggggcagctacattttaaaagcataaatcaacagtttattatatacacatccagtgcacaaacacacaatatcattaatacctccacagtagtacctgtgacactatatcagatggatatccctaatctctaattttacagcagagggaaaccggaaatccggagaatttaacatttccaaaggtgacacaggctgcacatgacccaaattggaagtccntaacatccaggttcataatgccgacccctctaatgaatggtatgacccccaatgtcaaatactaatagtcagggaggagcatggcaaaatggtttacgcaacagaagtcacacatctggttcgaaaaaccggaaatcggggggagcgggaaatttacgaaattgataacgtgaatatcccgggggagaaaaaaaagtcgg

SEQ ID NO: 509166 - DNA, 620 bp, Homo sapiens
ggagcgaggagcccaagagcgagcgcgcgagcacgaagctcgagccgcctccgccgcgcgagcccacctcggccgccgccgcctgcgccgcgagatccgccccggcctccccgagagcgagccccggccgccgcgaccaccagccgcgctaaccggccgaccaaccgccaccgaggcgcctgagcgagagcagaggaggaggaggcatgagtgaggcgggcgaggccgagcaccgagcaggcagcaccagcctcgccgcaggctccggacggaggcggccgagcgcggatcccgcaggaccccgacgcccagagagcccgcgtgggcagctggtgcgccaccaggccgcaggacccgagcgcccgacgaccacgatcgcaggaaaccccggtgagggacgcggaccccgcagccacgggcaccagggccgccgcctctttagcccgcgccgacgtgcagctgaagacgcgcgagaaaaaagttctcgcgcgacaaagtacgttggacaactgtcaacatggttcaacggtcacgaaatgcgatatggcatttataacatcgagaatgacaccagaagaagatgtattagtaacatcagactggcatcaagaagaataacc

SEQ ID NO: 509167 - DNA, 896 bp, Homo sapiens
ggtcgtgccacccagaaatgtcgcctcccccgagtacagggggcaccaactccgtgcacaaatacgcgggccgtctacgggatgcccttaggccgctgcgaggttgtgcgcggtatcccctgtgcgggcgaatagacggcacctgccgaggttaagcccccacaggcccgcgccgtctgccgccgctaagggaacaattggcggagacaaaaccgggccacaggagacagtacacgcgcgcccgcgttggcaagttccatgtagacactggggaaaaacctctattgagggcgccgagcgacattcaaccactttccggcctggagctttctttcaaaacgacttaaaagctataggggcgttgtacttctaccccctacccagagggagaaggcccgcgtgatcctcctacctcttttattagtcctgactccgaggaacgccctcgctgcaccttcgggatgaaggcaccaccgttgggtattcaaagtgcactgtccgtttattcgccgtcgcgaccccatttctataccccgtggtcgcaggctccccacgcaccactccagggcctcatttccggtacctacaaacacggggcttcatttaaacagcgtgaaaaagtctggtcgagtgtaaaacgcccggagtaccaagcttcttcgcgcggattagagtactaattaaatgctccgagaaccccatggagaggtggaatgaaaccaaaacttttgtttcttctctataggcccacattccaagatattgtaataacagcatgtgtatgttgtcaccaaaagggagggttcctgctcatgtacgcccccgcaagggggaggccgggcatcccccgggatttttcctggggcacaaatgaagacccctctccaaacaaaaca

SEQ ID NO: 509168 - DNA, 369 bp, Homo sapiens
agatctttttagtgtgtggctcagcctggcactcacattccataaaggatcacatgaaactaactgaagccctttgttcaagcttcagggctcttagagcatggaaatgagaatgtgactagtggatagtcttacaggaaaattcttgtatgtccctgaatgagagcacagaggcattgaattcacagagctgcaaacttgcctgataaatgagggagtggcagtttatagataggtgatcttttttccttcctccaggtgtccttgcctttcttcccaaagtcattcatttctgatgagtatatgaatccccctcttgctagtaaggttctatttgggctcaaacaaggctgaatttttaaagagtat

SEQ ID NO: 509169 - DNA, 418 bp, Homo sapiens
aagtattccagaaggtgacagaccatgccaccattgccctgctccactatcagctgccccagatgccggatgtcgtggtccgatccttcatgacctggttaagaagttacataaagctgttccaggccccgtgccagcgctgcgggaagtttctgcaggacggccttcccccgacatggattgatttccgaacccatagaagccttccatcagacctagcggcactagtctgagacaggaaccagagttagtcctcagacagtatctggccagacacgcaggaagccacagaaggctcactggttcctcactgcccagatgtgtaagctgtctcctttcataaagcacgcatgtgtgcagaggcactcttgaagagcagactccctctgtggctgatgggactaattattcccactag

SEQ ID NO: 509170 - DNA, 543 bp, Homo sapiens
  misc_feature (78)..(78): n is a, c, g, or t
  misc_feature (93)..(93): n is a, c, g, or t
  misc_feature (122)..(122): n is a, c, g, or t
  misc_feature (133)..(133): n is a, c, g, or t
  misc_feature (143)..(143): n is a, c, g, or t
  misc_feature (171)..(171): n is a, c, g, or t
  misc_feature (192)..(192): n is a, c, g, or t
  misc_feature (259)..(259): n is a, c, g, or t
  misc_feature (267)..(267): n is a, c, g, or t
  misc_feature (269)..(269): n is a, c, g, or t
  misc_feature (295)..(295): n is a, c, g, or t
  misc_feature (307)..(307): n is a, c, g, or t
  misc_feature (332)..(332): n is a, c, g, or t
  misc_feature (345)..(345): n is a, c, g, or t
  misc_feature (351)..(351): n is a, c, g, or t
  misc_feature (405)..(405): n is a, c, g, or t
  misc_feature (411)..(411): n is a, c, g, or t
  misc_feature (423)..(423): n is a, c, g, or t
  misc_feature (426)..(426): n is a, c, g, or t
  misc_feature (450)..(450): n is a, c, g, or t
  misc_feature (455)..(455): n is a, c, g, or t
  misc_feature (487)..(487): n is a, c, g, or t
  misc_feature (501)..(501): n is a, c, g, or t
  misc_feature (511)..(511): n is a, c, g, or t
  misc_feature (516)..(516): n is a, c, g, or t
  misc_feature (519)..(519): n is a, c, g, or t
ttttggagattcatttttttttgaccttttcaggatggggttagtgtccagacccttgcgggagggtggtgggggctntccttttgcaggcantgtgttttcttcaggggtgtcttcagaanacccttcttgntccgtggggntcttcagggagccatttcaggtggagtntcaggtctcaaaaacaaattntccaggaggccaaaaaaagactgggttggcttttggtcctcatgacggcttttatcctcctgggacnctttgggnanattcatgggcattgtttccatctgtnttttctacctgngccacccctgccctgattccacggntgcctcaggcagncaggcnaggagttaggccggtgcccggccctggcagcaaggggtttttgtgcagttgganatgctnccgttgtggcanagngtcctgcagccccgcttccatcancaggntttggggtgggggctttgcaggggatgctttntgatgtttgttccnttgtttaaanaaaangcncttatttttgtttttttttttgca

SEQ ID NO: 509171 - DNA, 780 bp, Homo sapiens
agcggcttgccgcctgttcctggtgtgcgcccatgacactgaaccatggcttctagattggttgggaaagaataatcaacagattatttcctgacatctgacaattacatgaaatccacattttacgtgtctatcagtttatgggcaatgcagccacactaatttacatattatctatggatacttcttgtgctcataatcgggaaaggttccgagtagctgtctacgatgaacctgtagtatgtgtgtcttgtttcactatcgccgcttgtctagctcccgagatcatgcctgactgcacaatcattacctgacaagcatttgtgaactgcccgtgatggtattgctagattcattactttctctgctaccaattcatgccctgtatctcaaaaccaagaaaatgtaccttttgaagtgtttaacccttttcaaggctacactgtgaactatacgacctattatctgatctatattgctaggtgaccttgtgttgctaatgctgtgtcgcctttaaactggtaagacagcaagtagacctgaacaagtagtcaggaacttactcgagtccgacaatttattccccatagcatgggtgggcggaataagccacacaaggatccgaaggaaacttcattaatatcttggactagaaaacgatcagcagggtagaaaatttcgcagaaaggtaaattagatacatcgagcgcttgcaaccccagaacttgttgacccacatgtagccctatttagataggcccaaaacctgagagaatccag

SEQ ID NO: 509172 - DNA, 905 bp, Homo sapiens
agcggctggaagtggctgatgcttggggcattcgctggaacatcttgacagagtgaaactgaagcttcagaaaggcgaagcgacttacccacagaccaagtggctattccgttcttgagagtatgtaccgttttgcccagtacacggggctacaggaatgtgccaccatgccctgctaatttttatatatctacttttgcctattttggtagagatagacgctcacatcatgttgcccaggctggtctcagtaatctcgggctcaacgtgatccacccatctaggcctcccaaaatgaaagacttgtggatatagtttgaacgaattagtccgggcgacaagtgggtcacacctgcaatcccagcgactttatgcagaggtgggtgcatcagttgagtgccatgacgttcaagaccagcctggccaagatggtgaaagcccatatctcctagatatacgagaattagtcagtcatggtggtgcacccctgtgatcccagctactcagaaggctgaggcaggagagtcgcttgaacctgggaggcaaaggttgccgtgagctgagattgtgccactgtactccaggctgggcaacagagtgaagactgtgaaaccgacacgaaggatcgacggaatgacgcaccagaccgacccagacggagagagcggaggaagcgcgggacgttgccgtatatcctcaaagtagatagcatagatatcaacccccatattcctgaaactcacgatgaccactgatggatgtcctatgtgagaggtgcctccatatcctggaggaaacgacatctttctcttctgacacacagggcacaggacaaaacctgaaaaaaggcccaaataatcccccagtattaccctggaatcattgtccggaaaacttattcctcc

SEQ ID NO: 509173 - DNA, 200 bp, Homo sapiens
agaggcgaacacgacgacactagccatccctttaactgcatgatgctattttatccctccagcataatgccaggcaccgacaaccataaagctcgccagcgttattaagtaatgcagtgtttcactgtttctcatctcttttctctttttaaagatggagaagatttccagtcatgtctgatttgtattgcacggcgatt

SEQ ID NO: 509174 - DNA, 121 bp, Homo sapiens
gatatgagtagaatggacgcaaagtagcgtagtgactaaaatgactgtagctgccctggaagttgtaataggcctgattccaaaactatgtggccttgacaggatatgcctaagtctcctc

SEQ ID NO: 509175 - DNA, 918 bp, Homo sapiens
  misc_feature (440)..(440): n is a, c, g, or t
  misc_feature (844)..(844): n is a, c, g, or t
ggaccagtgctgagactacaaggttcggagatccgcggctcacgcagagattatgaggttggtccttgtcccctcgcccgtgagttcaatgctctagctatctatgtcgtctgtttagttctactcgtgctatccagaatcagtcggtaggtcaagtcatttatgttgcattacctacgtagaactaatctggcataggcgatctttaaggactgaatggatgacgagtgagattcatatgtccagatcggtacctgatgtgtagtgcgcgagatttgtccctggttctactatgatcatggacactataacgatactatcaccagggatcgttaccaagtgcgtttgtaggcaaaggatcattcgtgtaaaccatggcaggctttgtaagatagcaaggtaaccattcaggaactggttgcaatacatgttatgataanggactgcaaattgcctagaggttacatcgttatgaggtaatatttcgtaagtactcgtatattccattgcggagagaaaacacaatatttaatcgaatcataggattcaagcatcgacttatctttattagaaaaggttccacatgtgtataagactcgttttaaagtataagaaaaacttgatttgtattcattaatagagaaggcaaatgcgtaatattttaatgcaatatgtgtatcttcacacgtaattttcgtacatatcatttggccacgtgttaacctaaatatctcacactcatccatataagttataattccagagaaggagactgtgggttttaactctctggtgattacgacggacagcgtaatggggcacgatgtgctatggtagaggcagntcagatgaactcacgtgaagtgctttgctggaaaggaaacatttgagtgtttacacatgtggcgatggaatatc

SEQ ID NO: 509176 - DNA, 108 bp, Homo sapiens
gctgacctagaggatcccgccagccaacaggatcaaccattaactttccctctacacttatcatcttcacaattctaattctactgactatcctagaaatcgctgtcg

SEQ ID NO: 509177 - DNA, 104 bp, Homo sapiens
  misc_feature (93)..(93): n is a, c, g, or t
gtcctagccgcgcagtggctcggactacaggcgcccgccagcgcacccagctaatttttttgtaattttacgtagagacagggtttcactggncgaggctagga

SEQ ID NO: 509178 - DNA, 204 bp, Homo sapiens
tgattagaggatctgtacagaatcctaacagtaacactgtgattctgaggtgccacagaggaggggctttactggcccctgggtgattactaccaaactggcccagaggccagagagagagggcaggaatttgccccactaacctgctcagtcattagccaagctgcttgccttcatgcttgtgccatgtggtgtgcctaccag

SEQ ID NO: 509179 - DNA, 296 bp, Homo sapiens
  misc_feature (47)..(47): n is a, c, g, or t
cccgttttaaaaccccttttttttttgggttttccccaaaaaagganttaaaaaccgggcccgggccccctggggggggtttaaaccaggcaaaaacgtttttccattgggccgggggcccaaaaaaatggccttttccccgccccttaaaccccggggggcctttaaaaaaaccccctccttggttatttggggcctttttcctggtaacccccagggggctttttggggggccctataaaaaaaccccctttttcgggggggggggggccaaaaaccccttttgggccgggtta

SEQ ID NO: 509180 - DNA, 596 bp, Homo sapiens
  misc_feature (220)..(220): n is a, c, g, or t
  misc_feature (311)..(311): n is a, c, g, or t
  misc_feature (316)..(317): n is a, c, g, or t
  misc_feature (401)..(401): n is a, c, g, or t
  misc_feature (481)..(481): n is a, c, g, or t
  misc_feature (511)..(512): n is a, c, g, or t
  misc_feature (525)..(525): n is a, c, g, or t
  misc_feature (532)..(532): n is a, c, g, or t
  misc_feature (538)..(538): n is a, c, g, or t
gaaaagaaggacaggtgctcttcatttattgtgaaagcaatctcatgtgagagtgcatatatggttttttctatttaataatacaccactctgaaattatgtgccattgaatcccaaagatttggtacaaatagcacaattggtatgcgctttcctctttcctttcttcagacaaacccaatataaaatgcagtgtgaaagaatgacccgcgtctagagnctgacttagaaatttatgctgactcgttctaaaaaaaattatgttggttaatgttaacctatctaaaatagagcattttgggaatgctttncaaannaggtcaagtccatgtcatacagctagaaaagtccttgaaaaaaagaattgttaagaagtataatacccttttcaaaacccacantgcagcttagttttcctttatttattggtggtcatgaagcctatccccatttctccataaaatcctccttccatactgtngcattatggcacaaaagcctctaagtgccnncagacaagaggcncagagtntctgantatacacaatgatgctgggtaatgtttatatgagcacagtgtatatgtatggtcagct

SEQ ID NO: 509181 - DNA, 177 bp, Homo sapiens
tgcctacacgttaccgtgtctccccgtcccacatactccggaccctcctgctctatccacggcgcccgcggctccatcctctggctcgcggcgtcgctgtcgaaccttcactttccgtgtctccccgtcccaatactcaggaccctcctgctctatccaccgcgcacacaacccgta

SEQ ID NO: 509182 - DNA, 188 bp, Homo sapiens
tggaccgaaagcttatagtgaagttgtagagatgatggtgtttcacctacatggtggggattttggacagcaatgagtggatttaatgatttaggtttgacattaactccaaattcaatgatgtcgtttaacaaactgtatacccattaatcgttatgatttgttttatcattatcggaaatacaggg

SEQ ID NO: 509183 - DNA, 542 bp, Homo sapiens
  misc_feature (220)..(220): n is a, c, g, or t
  misc_feature (257)..(257): n is a, c, g, or t
  misc_feature (262)..(263): n is a, c, g, or t
  misc_feature (347)..(347): n is a, c, g, or t
  misc_feature (427)..(427): n is a, c, g, or t
  misc_feature (457)..(458): n is a, c, g, or t
  misc_feature (471)..(471): n is a, c, g, or t
  misc_feature (478)..(478): n is a, c, g, or t
  misc_feature (484)..(484): n is a, c, g, or t
gaaaagaaggacaggtgctcttcatttattgtgaaagcaatctcatgtgagagtgcatatatggttttttctatttaataatacaccactctgaaattatgtgccattgaatcccaaagatttggtacaaatagcacaattggtatgcgctttcctctttcctttcttcagacaaacccaatataaaatgcagtgtgaaagaatgacccgcgtctagagnctgacttagaaatttatgctgactcgggaatgctttncaaannaggtcaagtccatgtcatacagctagaaaagtccttgaaaaaaagaattgttaagaagtataatacccttttcaaaacccacantgcagcttagttttcctttatttattggtggtcatgaagcctatccccatttctccataaaatcctccttccatactgtngcattatggcacaaaagcctctaagtgccnncagacaagaggcncagagtntctgantatacacaatgatgctgggtaatgtttatatgagcacagtgtatatgtatggtcagct

SEQ ID NO: 509184 - DNA, 465 bp, Homo sapiens
  misc_feature (123)..(123): n is a, c, g, or t
  misc_feature (131)..(131): n is a, c, g, or t
  misc_feature (140)..(140): n is a, c, g, or t
  misc_feature (306)..(306): n is a, c, g, or t
cagcacacaggcagccacccgtggccaaaggcttaaggggttcaggggttcaggcacccgtccccacacaagggccccgtgggtgggcctggccctgctttttacgccaatgttatgccagcnccatgttntcccaaaanccgttgatgtgaattattttaaaggcaaacccgtgctctttattttaaaaaaccctgataatccccctgcggtaggtcattcttttgccccatccctatagacccctgggtttggcaaaactcaggcaaaagtggagccctttttagacatcactgtcagccttgntatttgaaggtaccccccatagggtgggaggtgctgtcccccctgccccccgttgtccctgaaatttacccccccccctgctgggggtgagctgtacttttttgactgcccccccctgtgtaacgactccaaaataaaacttggttttgaatattttta

SEQ ID NO: 509185 - DNA, 146 bp, Homo sapiens
ccggcttaaatgaggtcgggttctctcgcttgacttcgagagcgattcctgagtcaggtagtgcagtggtgtaaagtgcagcatattcatttccaagctagagggtttcgtgtccggattcaaaggggcccaggcttgagctgggt

SEQ ID NO: 509186 - DNA, 407 bp, Homo sapiens
ttttatatttatattaattttttaaagatggggtcttgctgtgtggcccggactggtttcgagctcctggccttaagctaccctcccacgtcggcttcccagtgactgggattacaggtgcgatccactgcgcccagcccaacaacaattcttttctaattaaacaataaaaaatatctcacagtgacagttcagtcagccctgcactgtggtaaaggtaaaggtaaaggagagagtagtacatctccattttttaacttgaaaaacttagggttaaaaggaaaaagtcggtcttttaaggttggcccggcagttcagcagcaacaaagcaaggactttcaccccaggcttaggggagatcccattcccgcctctctcaacaaggtgttcccgggggctttagaggt

SEQ ID NO: 509187 - DNA, 971 bp, Homo sapiens
  misc_feature (143)..(143): n is a, c, g, or t
tttcttttttagttgagttatgagagaggaaaaggaagagtctgagagtaggacagaagacgagaaaacaatggtctcagccttattggcctcttttacatatatggctgccgccaatcgtgtccctacgccgtttttccctnggggatatttactttgggccccaaaagagaactctcccagctaatttggcgccgcccacttcaaacaaagtttgccagggtcccttcaagttatcccgctgcctggcacacaggaaaaattttgcctgtgtgctgaccccggacctaccccttggttccccccggaaacttctttctcccgttagccaacgagattgtcacgaaagcaacccccaccatcagtgagtctcacggggcatgaaaccagatggccttcaacaggcgggtcacagacacccatagatcaatcaacgcagtgtggcggctccccgggtgcagactcccttgggaatgaaacacggtggcgcaacccctgccttcaagatgattagggggtacttaaacagcatgtctaagatgaacatgtcactcgagagaggcccctcgatagccaccttatcaaaaaaggcagatttctttgtgcgagaacctccttgtggacgacaactcccctcgataggcacactgactcctctggtgggggcacctcgagagatgaatgtgcgacgagttgctactagacagaaccaacaacagtagggagagcgtgtcgctacctccatgacatgggaatgactactccgctctggagatctgcacccactgtgcgccagtgtacacccacaaaggcaccagacagaattgttttgttcacacagcagaacacaagtggcgagcggggtctctgttatagcatccctacgcctatcgggcgggtcacccaactgcgaccccaacctttttccaattttctttcccccaagacaaaaccaaacgcccaacataaca

SEQ ID NO: 509188 - DNA, 933 bp, Homo sapiens
  misc_feature (355)..(355): n is a, c, g, or t
ggacttgccatggtcgtcttgtctgccggcctgcttccttgtatatccacaggagctgcaaaatcctcttagagttctaagggcgctccctgaatgtgggatgctgcttagttgcccaagcataacatccaagtccaggtgtcatttcttgcgtgctcacgaggtttacagtcagtcacttttgcggaagagcatagatcatgattgagaagatgagatgtagagagaggttctcttggtggtgatgtaagcaaagatgcgtgacagaagccctgggaaggttgtatcaacagagtagagacgcagaccattgaaagacgttgtaagatttagaggtcgtcatcgtttctcttgntgagaaagacagactgagggaaacatttaggaaacagaaagtgatttcctctgaacagtctattgattcttcaagactacccttcgtgtgtaatggacactcacctttatgcagaatttgaaagcttaaatttactatacaagtctatacctatgtatgggagaagcgtataataagaacacattaagaatataagagaatgttacatttatccctttttgtaatcatctcatctcagggtacatcaagtgacgaaaagtcttccatcatacatttaaatttcattagataccgtgaggaaattactatttggagagtacagcatatgaatttaggggactgtggcgaacgctttcatccttatacctctgattgatactagggagaacccctgataaattcatgctgataggctgttgaaagtctgacgatgaatcaattcttcagatgcccttcttctgggagcacctctagtgttgatgtaaactttgcggcaactgtcgatgaatcttggggaaaccaagcgatgggaagggcacctctatcccagcccaaggatgtatggccgagacgaacgg

SEQ ID NO: 509189 - DNA, 174 bp, Homo sapiens
gtgacacaaatcagtgtcaggctgaccagagagagctcttccctcccccagtccagtcagtctcgcagtcccctctattctctccccatcatctttcttaaatctgtcccctcatactaatagcagtgatgaggataatagcagctcttgccaattaagcactgtgctctgccg

SEQ ID NO: 509190 - DNA, 177 bp, Homo sapiens
ccttaactgtgaaagcagagttgataaatgaactcgttgctcaaacaaggtaattcacatattgtatttctgttgaattaactgaaactgttaaatctacctgtttatgtaatgtaaacagagtgtcatatgtagttaacatgtgtttttttgtaaagtaaagccaagttgcaagca

SEQ ID NO: 509191 - DNA, 512 bp, Homo sapiens
agcggggatgaggagtgagaaagctactctaggtgcctgacgaattagggccgtaggaatgaatcctgatggcccgtgcagctcttatctcactgtgcgacatggactgccgggtccacattgcgacccgatcgtgccgtgactgttgggtgctatcgaacgtgactcttggcgatgtatcctgcgtagacagactgtgtggagcggagccgtccacatccaggccatggtcccagtctaactacctatagggggctggcacgactgactcctggcgcgtagaggcatagacttgcaagccatggagagcgaccgtggtttggtcccacgttcagagaaatgggtagtaccataagaggatgtactagttcggggcgcactgtgagaaagcgcactcccgagaatacgcgtgctgggaggtgcccgacgcccccgtgcaaattgcggaagtccctgtccttgtgaccacccttcgcaacgatggccccttcggcaggtcgccttccgaaact

SEQ ID NO: 509192 - DNA, 576 bp, Homo sapiens
ccaaggggtgacacacaccttttttgggagaggttttatgttaaaccaccccccaatgggggggggaaacaaaattttctttgggggaagggggaatttccctcccactaaacaaaaagggggtttccatagtgggtttaatttggggaaagtgggttcggaaaattttgggaaaggggggccccttttcccgggaacccccagggggggtaagccctgttttgtttttttaaaaaaatcctaaaaaaattacaaaaaaaaaacggggtgtttttaaaaaggcagttcccaaggagaatttttggggggaaggggcggcccccccccctaatttcctggctaaccacccaaaggttcaaaattgttttaaaggggaaaagggccccttgggcccaaataaaaaatcccccattaaaaaggggggggcccccccccccccgaaaaattggtttgaagccccccctgttagggcccctaaagggggaggaaccccccccgatgggttttaaattttttttgaaaaggtttttaaaaaaaaagaaaaaagggttaagggaaaaaaaaaaccatttttta

SEQ ID NO: 509193 - DNA, 763 bp, Homo sapiens
ggcagacacctatattatgtttgttcggcaaaaccaagatattcttcgcagacaacaggtcaatgaggaaatgtcatcatcagcaaacagttcatttgatcgaatggtacagcgagttccatgaacagtccatttgcgtgtggttgcactgcatagcattcagcacctccgaactcctatcatttcacccagctgcacagacgctcatcaagattgtgaagaaaacctacagggacttatcgattgcagggtgtgatggaaggaacactgaacagtaagacttatgatactgtgcacagacagttataacagtagaggaggacacagactctgctatcagcacaggcaggcaggacttcagggcattcatcatgcaaagacagtgcacgaagcaagcaagaaggctgcatatccacgacagctcttgccagcaccggcacggcaagcaccttgaatcggacactccgttataataagtgataatttattacacgagtgtgatcacgtgtgatacagtatacgcatgaacgatatgctcatagatagatgcggtacaaaataaaacacattgcatatgggttaaatagtccattctaccaacaaaggctaaagcccatggacaatggtgaccaggataccaaacggtaggacaactgccgcacagaagttcaaggagcgtcttatatcaacagatcatacacatgagacaagagcgatactagaacaagacacggcaacagcaatagtaatggaggcaagcaca

SEQ ID NO: 509194 - DNA, 82 bp, Homo sapiens
gcacgagattccactgttttaaaagaaatctcagtttttattttggaatataaaatgtgtatttggtatatgtgaccaattt

SEQ ID NO: 509195 - DNA, 171 bp, Homo sapiens
tttaatacgtacacatggagtgtgactgacatcagggcactgaggagcaccagaaagtcaccccgtaacacaggcacacacacacacacacacacacacacacaacacacacacacaacacacagatatactgttaagtgtatatatatgtgtcccctctgaaactcatgt

SEQ ID NO: 509196 - DNA, 126 bp, Homo sapiens
agcttccgtggtggtggggccgggtagcgggtgctgtgctgtgtctgagcttcgtggtgatggggccgtgtagcgggtgctgttctgtgtctgagcttcgtggtggtggggccgtgtagcgtgtgc

SEQ ID NO: 509197 - DNA, 872 bp, Homo sapiens
  misc_feature (25)..(25): n is a, c, g, or t
  misc_feature (183)..(183): n is a, c, g, or t
actgctcaattattggaaattatancttccatgacatacatcaaggtcactagtgactacaactacaatggggcctacatcgaccacacatgtgatgctgaatcactacaccacatgtgtccatctaatggccgtctcatagctgtctcggattgcccctcacgcggatattcctcagttacntcaaggtccaagagtgtgtgtccacgagcttagtccctacaggcgttactagaggtacgcccttcgcaatggtccttatggggaccatcaagatgaagaaacatgtgcgctaggaactaaagagtagcttattgtgtttaggcgccgagaccataattcgtcatatgtcgggtctcagtgaagcagaaatcactactttcagcatgtgggctgaaccaatgaatatatgagcttttattgctttcatgccctcgacccagcagaattttatcagattacaaaatgatatcgaattctacttagtaaataattttcgtggttatctgttttccactgttagtatggccatgagtctagatcgatctttatttctcttctggattactgaaatcatcttctaccttatttgctcctttgttttcttttcaaagttcgtctttcgagatccattatccatttcgatagcataacagggtgtgtccttaactcgccgggtggtccacaagcgttcatggaaattcctatgtggcctcgagttcgtgtagcaccatcaattcccatgtgatctgatgttggctccttcttaaacttctccattatatttccttccttcggacatttggcgggccacaaggtaggcgaaaagctggggggccaggcctggcacttaagttgcaaaaaccctgggt

SEQ ID NO: 509198 - DNA, 274 bp, Homo sapiens
cgtttactggcatttacatccaaaagagaggaaattaagacccctagtgtggctgtgagaccactcactacacctttcagggactggggagagatgagcggtctgcccgtcacaagcatgctgcggtacatggttaacgcagtatgattctgccagatggtaggagcagattgctcctgcctcgcatgcataggccactacgccatttgataagtgcaaagcagctgctgaaggcctctcacatacttgacactcacaggaaaactctccagtg

SEQ ID NO: 509199 - DNA, 115 bp, Homo sapiens
gatctagaggatccctcgaatcgacggtttctcaagcgtgggtggtcacagactatcagtgggttgtaaatcatcaagtcagacaagagctacattttttacccacaaggcatag

SEQ ID NO: 509200 - DNA, 578 bp, Homo sapiens
cggcgctcggggttaccccttgcaagcgacgccccctggtcccacagataccactgctgctcccggccctttcgctcctcgagcgcgcaatgggcacccgagacgaccgagtacgactacctctttaaagttgtccttatgggagatcctgggtgtaggcaagagtaaatctcctgtctcgatatactcgaacatgagtttaatctgggaaagcaagagcaccaatgggagtagagttggcaacaagaagcatccaggtggatggaaaaacaataaaggcacagatatgggacacagcagggcaagagcgatatcgagctataacatcagcatattatcgtggagctagtaggtgcctaactggtcaatgacatggctaaaccatctcacattatgaaacatgtagagcgatggctgacagaactggagagatcatgctgatcgtaacatggtaatcatgcttgagggcaataagagtgatctacgtcatctcagggcagttcctacagatgaagcaagagcttttgcagacaagaatggtggtcattcattgaaacttcggccctagactctacaaa

SEQ ID NO: 509201 - DNA, 158 bp, Homo sapiens
tgtcagacgtgaactatgtgggccacgctgccgctgctctgcgccggggcctggctccttgggagtccccgtctgcggtgccgccgagctgtccgtgaactccttagagaagttcacttcaagtcatggatttctaagcaccgtaagacctacagtac

SEQ ID NO: 509202 - DNA, 337 bp, Homo sapiens
agctcggtaccatccacactggcacgaactcctggcctcagcaatcctcctgctcccaaagtgctgggactacaggtgtgagccaccatgcctggtctccctctctcttttgaatggagatatgtttacttttagaagtagtatgtacttaccacaaaaaatgttaaatgatatggaactgtatgggccagaaattgaaaagcttccatgtctccacccctaagagtaattgacacccctttagcatggtcagattttgtacatacatactgtccccactttttctttattcttgcttgtttgtgtcgttaccttcaggtctccagtgtggagagag

SEQ ID NO: 509203 - DNA, 579 bp, Homo sapiens
  misc_feature (359)..(359): n is a, c, g, or t
  misc_feature (489)..(489): n is a, c, g, or t
  misc_feature (552)..(552): n is a, c, g, or t
acaccctaggtcatgtgatgacaggggcttttatagcagctgtcttaagtaggtgccacctatttttccaccaagctgggagggtcaagattctcttgcctcaattccgcatctggacacataactccacatcttctcttctcctttgagattcataacacgtttgcagtttcatcctttacggctttcttgctgtcataaactttctagtcactacatctcatttattatatatttcggcaccgaatgtgtctttcttttttatccctattcctgtcattaactaggataacttcagtggtcattgcactttctagtgaacagcttagtttcttgttggcttggctttttctaagccnatgatcttcaaattcattccattttagatagccacttccatacctccaacccagaccatgttttcttcagaaagtgctccttttctgaaatatttacaacctgcttttggatcacaaactcttatccttntagtttttacaaccactattcctcaacctcatcaggatctacaatttttttgctcccttgttnatccacaccccctctgggtggctttct

SEQ ID NO: 509204 - DNA, 122 bp, Homo sapiens
accactcactttattactaggatgatttgtgacaatggttaccggtatgtttgcaacattgatagctgtatgtctaattggcaatgttgtattccagtctggtttacccttatttagattga

SEQ ID NO: 509205 - DNA, 150 bp, Homo sapiens
atcactctaatgagaggacccggccatccacgtactcactaagccctcctggtgacttctgatgttcactaccttcacctgttttacaagggaaagtcctttataatattggagtatcccacactgagcaggctttggggcccaaaataa

SEQ ID NO: 509206 - DNA, 648 bp, Homo sapiens
  misc_feature (539)..(539): n is a, c, g, or t
tagtatagcactgatgcatactatatgctcagtaaggatctgcagaattaattaatgctattaatatatttcttttaaatgaagatgttcattaataagttagatgtgtcatattttaaaaataccttaaattgtgttttgcttaacaagttagctgtcgcatactttcaaaataccttaaatacctttatttattttagacttcacactagttgtatactatgtgtttccaggaaataaaacattttcaaacaagagaaatctgaatggtaagagaactgtatcatcgactcagggactgcattccctttcttcacctccagaggaggcatgcccatgtgccagatgcctcaaggaaggggttcaggtggtaatggtgacgtggtccttggaggacagagtagttggctcacacagaatgtgaacaagagcacagaataccctatctactaaatgtttgagtttacaaccttagaatcattaaccgtatctgtgctaaaatataaccactttgctttgaatgagtcagtcttgtcttncttaattagactgtgtacttctttaggaccatgaccatgaattctttttctagctaaatatgaggctggctgcaagtaacaggtatacgagaaaactgtatggctggta

SEQ ID NO: 509207 - DNA, 721 bp, Homo sapiens
tggagacagagctctcgcgttggtcgccaggctgggagttccgggggcggtgactcctcgggctccattgaaccttcgtgccttcgggggtcaagcgattctcctgttggcctcagcctcccaagtagcggggcctcacagagtgcttgccaccacgccaggctaattttggtttttcagcagcagagggggtcccactcagtgtgggccaggagttggctggatctctggacctggtgatctacctgcttgggcctcccaaaggtgcggggtttaccgggcgtgacgccatgggcccagccattttggatttttcgacgagacgggcggtctcatggtgttcgcccacggctgataaaagttcctatacaggtatgtaatcctaagggtatctactctaaccccctgtaattgtgggtgactccctcaggtaacttaactaactgcggcatccattacatcaattctgcttcgaactggcaacaaaaaacaaacacaaaaaaaaaaaaatggtgcgggggccgcgaccgagaaaagtttttacaacccaaccggtggggggcgggcgcccagtggtgatgtaacagctgccaggggtcccgagaaaatcgcctcgaaatcgggttgggtttccccaaaaaaagcgcggcgacgagtcttggcacaccacgggctggggaccagggtacaacggacaggactatcgccgcgcagggagtgt

SEQ ID NO: 509208 - DNA, 721 bp, Homo sapiens
  misc_feature (49)..(49): n is a, c, g, or t
  misc_feature (65)..(65): n is a, c, g, or t
  misc_feature (87)..(87): n is a, c, g, or t
  misc_feature (90)..(90): n is a, c, g, or t
  misc_feature (92)..(92): n is a, c, g, or t
  misc_feature (112)..(112): n is a, c, g, or t
  misc_feature (125)..(125): n is a, c, g, or t
  misc_feature (130)..(130): n is a, c, g, or t
  misc_feature (138)..(138): n is a, c, g, or t
  misc_feature (143)..(143): n is a, c, g, or t
  misc_feature (161)..(161): n is a, c, g, or t
  misc_feature (168)..(168): n is a, c, g, or t
  misc_feature (305)..(305): n is a, c, g, or t
  misc_feature (389)..(389): n is a, c, g, or t
  misc_feature (393)..(393): n is a, c, g, or t
  misc_feature (435)..(435): n is a, c, g, or t
  misc_feature (465)..(465): n is a, c, g, or t
  misc_feature (542)..(542): n is a, c, g, or t
  misc_feature (550)..(550): n is a, c, g, or t
  misc_feature (554)..(554): n is a, c, g, or t
  misc_feature (624)..(624): n is a, c, g, or t
  misc_feature (697)..(697): n is a, c, g, or t
tggggggggcgggcgggccgccaaggccgcaggggcaagcgcgccacanggcgtggagcgccganggcgcgagggcgcgcgacgcgnggngngaggtcgctctttacttgcntgaaaaccttcangccantcttcacnttcantgtacattaatccttgcntggtcangccaggatttttggcggggggacttggcttcatagaaaagttcactgatctcttcgacatgctctttctcaatgctgtccttcccgttgattttagcaagcaagttggccggggtcagctgctgctctgagtacctnagtgtggtcttggtgccaatctcccccaggtggttcagtgcctcctcactgatgttgattccttccgtctgggcacggtttttnttgntctgtttcatttcctgtggggtatacagcatggtccggtttntcatcactcggtccagaaggtcaagagggntgccgtgaggggatgtgatgtcctcagtgcctctgatgacacagttgcctcggttggttgctaagatgacgttgggngcgtttgnagantccagggcgcggtgcaggtaggtgaagcactcaatgtccagcatgtggacctcatcaacaaacagcacanccgggaccagctcagcaatgccctggtcgatgtacttgttcaccaccttattaatctcccctcgaagtttgtntgtgatttctgtcttctttggctt

SEQ ID NO: 509209 - DNA, 816 bp, Homo sapiens
ctttgtgacttgaagaaccctgactttgtttctgcaaaggcacctgcatgtgtctgtggtcatggtggacatgggggtggggtaggaaaaaccaaaaacgaaacagtgacagccaagatgaccagcgcagcgcactataagaagagagaagaaacgaaaacagacaacaagcgacacacaaaagaacgcgagccacatccgctacacaaaaggcgaaggagcattttttcaacatcaacagaaacacgcggacaaagaaaggcgacgaaagaggaaaagagagagaaataggaaacaaaaagagcagacaaacaaaaagcaacacgtacagaaacaaaaaaagaaaacagaagacatcgcaaccaagcaggcacacaacgaaacacacagcgcaacaagacaccacacaaccgataaagataaccaaaggcagtgcacacaacactacaataatatcatcatcaaaaacacaaaaaacacaaaaaaaacaaaaacaaaacacaaaaaaaagaaaacaaaaaaataaacaacaaaacaaccacaataaaacaaacacaatataaaaaaaaaaacacacaaaacaaaaaaacaaacacaggcaaagacaacagcgcagacaaaatctcaacaaaacactataagtaccaacgacaaaagaaatcacgccagccccaccccacaaaactaaacaaatctaaccaactaaatacaaaattactaaaaacaaaaaacaaattcagaccaacttctactactcccataactacaaaatctcacaaacaatcaacacaaataatcaaacaacagcaaatacac

SEQ ID NO: 509210 - DNA, 197 bp, Homo sapiens
tgtttactcttagaatgtctgaaaacgcctggacctctttaaactgtgagagttaccaaaccatgacatgactagccgagaagagatgtcttcaagcatcctgccccaagcattacctaccttggactggcatataacccgagacggaccagagtaaggactctgagttcagactgccgaaggatggactggttgac

SEQ ID NO: 509211 - DNA, 211 bp, Homo sapiens
tgaaagcctgagttatcgtgctataagcttttcatggaccacttccttgccagaaactgatttataactcatttagagaatgtcctggcgtcggtttttagcatctgtcgtatttaaacagagctagaatctgatgtctgaagttaatgctgcatttctgggtctcttatgtggatcagaaagtaaagtgtgccttctgatgtgaaaccga

SEQ ID NO: 509212 - DNA, 801 bp, Homo sapiens
ggtttctctgtgatgcttttttcgtcctccttttgatgggttgcactgtttttcccgcttctttcccgtgtgttgtttcacggtgcgcgtttttcgcatgcttatggttagcatggtcttggggtgacgcttggggtttaattgtttgattgggtgggcttttgcctctacatgggcctttttgcttttgggcgccattgctttattagcccctcgtttgtgatcaattcctttgtcttcggctgataaccttttatggtactccgtttacaatggtaatcttccatcccctattactcaccacccctggatggacttttcaatggtcggtagcactaacagtgagttctggatgccactcaaggatctctgtttgtatcgtcttcaggggctcaactcttcattttcattatgtttgtgtttttatcggtgtatcttattttcctcttgagactgggtctcgctttgttgcccaggctggagtggagtggcgtgatcattggcatgtactgtcagcctttgcctaccccgagcatcgagcagtcctgacctcagcctccggagatagctcggcggaccacaggttgcatgccagacccatggcccagtccaacgctttgcatgatattttgtagagatggggtatcacagtgttgcccaggctggtcatcaaactcctgggctcaggcagagtccaccatgtctcagcctccacagagtgctgggacttacaaattgtgagccacacgtccagctgaaagggtcaacatctttaacattcagcaagacatctgcatttta

SEQ ID NO: 509213 - DNA, 264 bp, Homo sapiens
  misc_feature (59)..(59): n is a, c, g, or t
  misc_feature (69)..(69): n is a, c, g, or t
  misc_feature (102)..(102): n is a, c, g, or t
  misc_feature (105)..(105): n is a, c, g, or t
  misc_feature (110)..(110): n is a, c, g, or t
  misc_feature (244)..(244): n is a, c, g, or t
atgagcgctcttcccacgctgagctgtgcgtccctccccaatcatctttcgtgttccanagaggtgggnctgaggtgtctccatctctgcctcaagttcgtngtncagtnagctgtaagttcttccttcccgattaaaattagaaccggagtataaattggactttctcaaattctgtgccatgataggttgatgagttaattagaggagaagattcctaaaatttcagagacgggatgagtgnaacacatgacaacgttccag

SEQ ID NO: 509214 - DNA, 455 bp, Homo sapiens
ctgtagaccacgacatctgatgtaagctggcacgacggtacttacatatgaaattctaaggggagccaagttggcctgtcaacataaatttgtgagtcattcacatatggtagttgaaatcatggtcctaggaaattgctcatgaaaggaatatagtgcccaaagcaggtctactcttattccttaagaaatctgatcatttaatcagccaggtcagcagaaagatgcagcacagaacacagcaaaacagcaacatgagcagcctgagagcaggaggaaagcaaggggcagtgtggttccccagaagctggggtgagagtgtttcaacataggcatggcaatagtgcccaagtgctgccgcagcacatctgcaaaacaggaggcctggggaaacacccatagggatttagcaacaatgggggtcttggtgagcctactattaaaatatcctccaa

SEQ ID NO: 509215 - DNA, 674 bp, Homo sapiens
aaaaaatacaaaaattagccaggcatggtggcatgcacctgtagtccccagctactcgggaggctgaggtgggaggatcgcttaagcccagaaggttgagaggttgaagctgcagtgagctgtgatggcaccactgcactctagcctgggtgacagagtaagaccttgtctcaatcaatcaatcaatcaatgaaacaattagtgaaatgcctgacttcattgtaactctccctcactcaccttctggaatcttcaaagtcactaaattcaagtccaaattcttgaaattgaccttgccatctgtattagcattctctagaggggcagaactaatggaatatatatatatatatgagtttattaaatgttaactcacatgatcacaaggtccacaataggtcatctgcaggctgaggagtaaggagagccagtccgagtccccagactgaagaacttggagtctgatgttcagggacaggaagcatccagcagggagaaagatgtgggctgagaggctaggccagtctaaccttttcacgtttttctgcctgcattatattcgctggcagctgattagatggtgcccatccagattaagggtgggtctgccttccgcagcccattgactcaaatgttaatctcctttggcaacaccctcacagacatacccagga

SEQ ID NO: 509216 - DNA, 248 bp, Homo sapiens
atcacctgcaggcctgcactcttgagcactgcctctgtattgaaatcgtctggactaggtgaatgctcagtggaccttaaatcatgggacctaccagattgacctgccagaggcaagactgaccagcccttctgggccccaggacaagccagacactgagtgacaccaaaggctttgtaacaatgtcttgagggtctgctgccccagcctgacagcagagaaccgccctccccaaacacccacagcca

SEQ ID NO: 509217 - DNA, 397 bp, Homo sapiens
gtggatacggtgtcgatagccccttgaagcatcgtataattgtgtgtatttgattcttctctcttttctcctttattagtcttgctagtggtctatcaatttggctgatcttttcaaaaacccagctcctggattcattgattatttttgagacttttttaaattgaagatggattttttgttggagactcttttggattgacgaccattgttttccgttgtaattcttgggggagagagagatttgaggaacagtttcaattccatgtgttcaacaggaacatttctggggccagctcacagaatgcctgtgtaacagagcctcctctggtgtgggaggcccagaacggagcccactgtgggctctgtgtcagctcatgcacaatttgtcgagatt

SEQ ID NO: 509218 - DNA, 535 bp, Homo sapiens
aaataagcaaatcaaagaagatataagaaaactgataaaatagttcaaaaattataaaaagtggagataggagaaaaattgcacacagaaattgatatcacagagcaaaaggaaaaagaaattggatgtaagagtggtggctgaatgtagcctatctggatgttcgtataccatcacaattgaatgtcaactttgcgggtcctgcagctcattttgaacactactggactccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtcatacatgaaggatgtttggtcaccccgccagagct

SEQ ID NO: 509219 - DNA, 912 bp, Homo sapiens
acatgatgtatttctgccagatgctggtagttgtgaaaactatcaatgcagccattggagtctctacgtcaccggtgctgccttctctgatccagctttcttgagaagcaaattttattttggttttatccatctttgagcatccatggcacagaacctgcgtgaacaagagctgtgcgtccctgtttgtgttatatttcgtgggagtagcaggttgaaatttagcagtcgtactctttctacaatgctgacggtgcaattgacatggattggcaaggtgctcactatggctatcgttggactctgtggcattcccttatatcccactggcgtatgtattggtggaagcttgtctcatgtagagttctagtccatataccaatattacaatgaggaccgggaagattcaattttcacattgccagtatccagtgaaagagtccaagttggacttttccctcttgtttgcttggagactttagtcgtaataagtgactaattctctttaggtttatacactaaaattttcgttcatcctttattaaaccagtcgcagtacggccgctattggacaaacatgacagaaaaagatccactaagaagaaagattcaagatggctttcttgccagtttgagcgctaatctgattcttacagtattaccttcttgaaccgaattgtgaaaaagttcagtacaagtgttacaagtgattaaatgctcagtgaggctatcttcctttttccccagtaacaattccttgaattactgtgatcttatagtaggtacttgcatgacatggattcctggatatctgaattgagaaggtcgatctggggtacttccgtaatgaacaccaaaaggttcggcccacccaaccctatctcaaggttcagggttggtctacagagctgc

SEQ ID NO: 509220 - DNA, 261 bp, Homo sapiens
gccacctctgaccgagtaatcacacactctgagcgagtacccaccatactgaccgagttcccaactactgaccgagttctcacctctgaacgagttacccacactctgaccgagtactcacctctgaactgagttccccccgaatccggagtgacggagatgggcgcctgagatggagtacagagcggtaacgcgacctgatcccggaaaagccagtgagacgcacggggaagaagtactctttccttagtgaagggcagg

SEQ ID NO: 509221 - DNA, 172 bp, Homo sapiens
agcactgtgagcacacagcaaaccttgagagccataaactgttaagcaggtcttactctagtactctcagaatggaagaattatatggactgaaaaatcacaaattgctcagcaaggtcctactccagtgccccctagtcatccaaaaactgagcttttcaaggagggcaca

SEQ ID NO: 509222 - DNA, 148 bp, Homo sapiens
agttgacccagagacactttgcagaaggctacagactgatgaattccagcttcacactaatgtgaatgacgggacagagttcggcggctccatttaccagagagtgaacaagaagttaggagaccgctagtcaatctatgcctggcac

SEQ ID NO: 509223 - DNA, 726 bp, Homo sapiens
  misc_feature (26)..(26): n is a, c, g, or t
  misc_feature (74)..(74): n is a, c, g, or t
  misc_feature (123)..(123): n is a, c, g, or t
  misc_feature (245)..(245): n is a, c, g, or t
  misc_feature (322)..(322): n is a, c, g, or t
  misc_feature (340)..(340): n is a, c, g, or t
  misc_feature (380)..(380): n is a, c, g, or t
  misc_feature (399)..(399): n is a, c, g, or t
  misc_feature (404)..(404): n is a, c, g, or t
  misc_feature (406)..(406): n is a, c, g, or t
  misc_feature (414)..(414): n is a, c, g, or t
  misc_feature (426)..(426): n is a, c, g, or t
  misc_feature (442)..(442): n is a, c, g, or t
  misc_feature (447)..(447): n is a, c, g, or t
  misc_feature (449)..(449): n is a, c, g, or t
  misc_feature (470)..(470): n is a, c, g, or t
  misc_feature (481)..(481): n is a, c, g, or t
  misc_feature (496)..(497): n is a, c, g, or t
  misc_feature (503)..(503): n is a, c, g, or t
  misc_feature (507)..(509): n is a, c, g, or t
  misc_feature (513)..(513): n is a, c, g, or t
  misc_feature (525)..(525): n is a, c, g, or t
  misc_feature (532)..(532): n is a, c, g, or t
  misc_feature (547)..(547): n is a, c, g, or t
  misc_feature (550)..(550): n is a, c, g, or t
  misc_feature (556)..(556): n is a, c, g, or t
  misc_feature (565)..(565): n is a, c, g, or t
  misc_feature (579)..(579): n is a, c, g, or t
  misc_feature (583)..(584): n is a, c, g, or t
  misc_feature (586)..(588): n is a, c, g, or t
  misc_feature (594)..(594): n is a, c, g, or t
  misc_feature (598)..(598): n is a, c, g, or t
  misc_feature (611)..(611): n is a, c, g, or t
  misc_feature (614)..(614): n is a, c, g, or t
  misc_feature (622)..(622): n is a, c, g, or t
  misc_feature (625)..(625): n is a, c, g, or t
  misc_feature (633)..(634): n is a, c, g, or t
  misc_feature (696)..(696): n is a, c, g, or t
cctgaaacagaatcgcagattgccancccttttcccgacccctacggaaagacgaatccaggggccgtcctggngaggtcaaaacatttagtctggtcttttcagcgtggaccctgccagcanccaggccatggagctctctgatgtcaccctcattgagggtgtgggtaatgaggtgatggtggtggcaagtgtggtggtgctgattctagccttggtcctagcttagctctctacctacgtancagacagcggtacaaccagctcctgggcgctattgtgtcagcaggcgacaacatccgtcctccacctggggcatgtngaccacctggtggcaggncaaggcaaccccgagccaactgaactcccccatccatcanagggtaatgatgagaaggntgaanangcgaggtnaaggtcgggganactccacattgggtangcttnanctgggggctggtgttgagccnagccgttgagnagtgtcgttgacatnnaaaggngtgnnnaaanacaaagaaggtngaaggangaagaagtacaaaangcncccctnaaaatcttnaggataagacctgnctanntnnnaagccntggnctcatcactgtgnggntcaaattngtnaatgatanngaggagctggctgtggctaggccagaagataccgtgggtgccctgaagagcaaatacttccntggacaagaaagcgagatgaaactgatcta

SEQ ID NO: 509224 - DNA, 1482 bp, Homo sapiens
  misc_feature (1131)..(1131): n is a, c, g, or t
  misc_feature (1482)..(1482): n is a, c, g, or t
tcggatcccgggcaacatgatggtcgctggagcagaagtgcgcatgagcatatgtggaccactggctgtgcgctgtggtacgtgctgacgccagctagcagggctgaaacgtagacggccagaaccaaggtctcagcggcggcactaaacggcggtcggagcgctaatcccacacatccgactgtcctccctggcacacgtcatggcctggccggtgatgcgtcccggtactccaaggcacggtgttggttctgctctcatgggccctggacaggggaactccatagatgatcatcggggagacccatccccaggcgtagacctgccgacgcctgcacactccccacctgtctcgcaacccaacctagtgcacactgggcgaaagctacccgggcggattcccgcaaacacgccatatgcacacccctgggccaggcggcacccctaccgctggccacaacactagcctcctcgtacgacaacagctacccacccttcccacactcgcacccccatattgccgcccccggctccccggctcccatactcagccccgcgcgccagccgctcgcacagtcgcaacaaaccctacgcaaccatacgcctcccacccccagccacggcgctacaacaccaccgggagacggagaagacaggacactccaccattataacccggcacaccgcctacgcccccagccgccgccatcacaccacgcccttgggctacgcccgcaatgaccacccgacgccacactggaggacctggcggcccgcccttgcacccccctgcacctcgtccattatcgctcggagcgcacagcccgctgcgcgcaacactcgtaaccgcctgtacccgcagacgccccgccgttcccccccgtaacgctgccacccgtgtgcggcacccccctctcgggcctaacaacgacggccccggcaccctttgcaaccgctcggtaggttgcccccctggcatggcccacacctctgtgcgcatggaaagtagtccccgcccgatagcgccgtggtcacctaccacccctattggcaataggcgtatccccgctattggtgcaacacacactaaagcctcccaccaccggggcgcgatattggcatgactacaanaaacctcatcgtctcctcccaaccacaccagtctccaacaccaccctgagtcactacacgtccggcagctgctatcctgggatcacccatctggacaacgtcacaacctcctactcacccaccccttatagtcgcccgcccttatggtagcccctccctactactctagatggtcaccactactatcctcctacacatatgtgacacacgtcgactgcgacatcatagtcgccacactatacacttatccacaacaactcactacacactcacagactgcaactcttcctccacgacaacatgatgctgtacttcccccaccactgtactaacctccatcaccaacatatn

SEQ ID NO: 509225 - DNA, 385 bp, Homo sapiens
ttctcggcgtgatcgtcgttcaaggcatcacccgtccgctcgcacatctcgtctccgttcttcaacgcatggcgcagggcgaaatcgattcggagatcaaagaggccgttcgcggtgacgaaatcggctcggtcggccgggcggtcgaaggtatcaaggccatggtggcacgcaaggccgccgaagaggcagaggtcaagcgtcgggccgatgccgctgctgcggcggagcgtcggcgcacgatggtcgaactcgcggatggcttcgagcgtgccgtgggtggcatcgtcgggaccgtttcgtcatcggccactgagctgcaagccaccgccagcacaatgaccgttaccgcgaccgagacggccagccaatccacgacggtggc

SEQ ID NO: 509226 - DNA, 334 bp, Homo sapiens
  misc_feature (22)..(22): n is a, c, g, or t
  misc_feature (47)..(47): n is a, c, g, or t
  misc_feature (179)..(179): n is a, c, g, or t
ttaaagatcaattcaaaatccngatgaaagaaacggttgaagaacangcaagcactacagaaagagtatttcaaggacagacagtacccaaattgatgctgcgatcgttcgaattatgaagatgagaaaaacacttagccacaatcttcttgtttcagaagtctacaatcagcttaaantttccagttaaacctgctgatcttaagaagagaatagaatccctcattgaccgggactacatggaaagagataaagaaaatccaaatcagtacaactatattgcatagaatgttggccttggaacttgtcataatgctgtagccattggataaac

SEQ ID NO: 509227 - DNA, 896 bp, Homo sapiens
caattgaagttctgccttatgtcgatgaaaaatgtgtttgcccctcaaatggggcatgtttgttttatgccctgagccgatctggagagataatggcgcggctcccccgctataaagcggcctggagaagtttgccccccgagcggtggagtgtcataaccgcaagcgccccacatgaaattcgtggttgcacactacagtcccccatggagagcttcactgctatctgtggggtattgaacattctctgccccgcgttaagtcggcaaaactgtgcacccgtcctcgggctagcgcaagcaatttgtctcctcacaacgaaatgtttttttagatatacggcggccgcacctttgccggacacaagggccgccccactctcctcattggcgcgacatttgttcagcacacaagtaccgggctgtgcgccccctctactgagaaccccgatgctgattactaggagaaaacaagaatactccaccttctgtgaccgtctcccgtttgtgtgagcttgtctcgcacgagtattcgtgcgaaagtaagttctgttgcttctccaaaccagaactctcgttcttgcgagcctactctgagcgcgttctatgagtttttctggggaccaattggccacattgtcattggtgtttcgcatactgtcttaatgtcgctttaaagagcccgtgatgctctaaaatacgcttattgataacatgtaccccctcttctgtcgtagggagaggatcctctcgttggagaacaaaaattaaggaaaactgggtagtttcttccgagggtcaccaactgtcgtcaacagtagactgcccggggggatcactaccctgggccctcggggaaggacacaaaaaatacaatccaaggcttttaacatacaa

SEQ ID NO: 509228 - DNA, 188 bp, Homo sapiens
  misc_feature (167)..(167): n is a, c, g, or t
aggtcatttatgcaatattcgccattttcttcgggctagtcccagttagatggcatccagtcctccatcaagattcgttgtctataattacctctctgtggtttagggcagaagggaattgctcaaagtaaacaatggccgagggactaacttgtttagcagttagnagttagctaaagcctgtttat

SEQ ID NO: 509229 - DNA, 319 bp, Homo sapiens
cgcttggtttatcagctgatttactgatatcgaagtcctttgttgtcatttcaacgatgtcacagcatctttgccagcagtagatttcatctcaagaaaccactttctgtatccacccatatgaagcaaatcctcatctgttcaagtttaatcatgagactgcagcaattcagtcagatcttcaggctccaccacttctagttatctagctatttctaccacatttgtagttacttcctccactgaagtcttgaagtcaaatcaagactcagttatctgtgaaggttggaatcaatttcttccaaactcctaggatgtc

SEQ ID NO: 509230 - DNA, 766 bp, Homo sapiens
  misc_feature (16)..(16): n is a, c, g, or t
aatgatacatgagaangacactaccattattacgccaagcttggcactaagcattgatcataggagaacagacaaacaggaactgcactctcgggaagccgccgttctacaactatcggatcccacgggctgcatgaatgacgtacaacgttgcaaggacatcatggacttgaagcaagagctacacaactcggtcgccatcccagaaaaggaaaataccaaactgcagaagcagagagaggatgagctaatccagaagatccacaaactggtgcagaagagagacttcctggtggacgatgcggaggtcaagcggataacggagcaagatgaagacaaggaaatggctgatttcctgagaatcaagttaaaacctctagacaaagtaaccaaatcttcagccagcttcctggcagaaaataaagcagagcccccacctagcaagcccactgaggccaatacagggctggcactgatcaatgattgttgctgggccacccactgcaacatcatgtagcccccacgtggggtgccctgggccattggggaatccccccaccctatcggcttattagtccccatttcacctggccccaaaaatcttttcagggtcaaacggggtataatgcttatccttttacatgttacacataagccttgtgcaaccttaggaagacccctggtcctccttttaaacattattatcactatggagacttcttcacccctttcatttgtcactccccctaactttgtctaactccaa

SEQ ID NO: 509231 - DNA, 584 bp, Homo sapiens
taaccccctctttagtttattgcgctcaaaaaccaatttaaaccccccccccatgtaacgggggggtggtgccaaaaccagaaaactgccgtgatggccagcctggtagtccacctgatggttcctgtgcccccggccagttttgtccgcccgtgtgtgggatgttgggtgttttttaatgtctgtgctccctagtagtgtggcgtggcgttgaggcatgcgacgggggtgagacgacttcctgtggggggcgcattgtgggccagctgtgaccccctcgtggtgatgagcttcacgagggggattgtggaataagcggccgctgtgacccggccggagtgttccggggaaaccgtcgggctggttcccaccaaagaagtcatgggaagggcaagagggaggagggtgatgaggcgaaggggaactacccaaagggttgctcaggagagggctgctcccaatgggcacaacagaaacaggggcgcgaccggggctgagcacatgacggaatgacacagaaacgtcgcaaggcggcaccgcagcggtttgctaccacggaggttcgcacaaagatgggacagagg

SEQ ID NO: 509232 - DNA, 508 bp, Homo sapiens
  misc_feature (278)..(278): n is a, c, g, or t
  misc_feature (296)..(296): n is a, c, g, or t
  misc_feature (399)..(399): n is a, c, g, or t
  misc_feature (422)..(422): n is a, c, g, or t
  misc_feature (425)..(425): n is a, c, g, or t
  misc_feature (446)..(446): n is a, c, g, or t
  misc_feature (456)..(456): n is a, c, g, or t
  misc_feature (459)..(460): n is a, c, g, or t
  misc_feature (470)..(470): n is a, c, g, or t
  misc_feature (490)..(490): n is a, c, g, or t
agcgcatgcccagagccctccgaaggccgggccgcgccgcttgggagcctgtccgacatgaatccgtccgttccgaagttcgccgtcgtcgtgcagccaagtcccatcgacgggatgggcgtgttcgcagcggagccgatccccgcgtacaagaagatcggagagttgcgtggcgagtcgatcagcgtgcgggaggcgcgtcggcgagccaagcggcagcagcgcatcatgatcgtcgaggtgtccgacaagcgggcgatcgatgcgtcgcaatcccnagacgccatgcgctacancaaccactcatgctcgccaacaccgtgctgcgcatccgcaggggccggttcgagtttacgccttgcgcccgatcgctgcggaaggaactgacggcaactacgntagaccacacgaaagcactttgnctngccgtgcggtcgccaatgcangaccttaggntgnntgatttggantggtaaccttacgggtacanttgaatctatatggatag

SEQ ID NO: 509233 - DNA, 152 bp, Homo sapiens
agttacaacagttcaacgagagcggagataaggaggctctcatgtcaagacgtccagatgtgatggttacggagaacctctggctaagcatagcgtacggcttggatgaatgaccccgagcgattcatgagacggcaagtagtctgactaat

SEQ ID NO: 509234 - DNA, 411 bp, Homo sapiens
ggatcccccgctctcagctataccagatactctgcaaggtgactactttaaccagaacatctcaaaacagacagcatgaaggaggactctgtggtccgggcgcgtgggccctggggttggaagtggctcagacgcactttacattttccccgaattcaaccttcggaagtcccattaacccctcttcagtgggataaatggccaactcattagctctggacacattaacctcccgaactgacttcctggtgactatgcctgccttatttcttttctctcctcccttacattttccgctggcacaaagccaaacacagcaccgtggggggctttcacgcttctgtgccctaggacacgctgttcctgcagcttggaaggcctctgtcctccatcggggtgggtggagagcgg

SEQ ID NO: 509235 - DNA, 381 bp, Homo sapiens
agacgtttgcagccatgacagaggtattataactaaatttcactactagattgactgactcaaatacacataggctactgaggtacgacttctgatggatttgattgggatgaatgccatctatctagttctaacagtgaagttctactgtctattaatattcagggtaaataggaatcattcagaaatgttgagtctgtactaaacagtaagatatctcaatgaaccataaattcaactttgtaaaaatcttttgaagcatagataatattgtgtggtacatgtttctttcgttgggtaaatgtttcttttaaagaccctcctattctataaaactctgcatgtagaggcttgtttacccttctctctctaaggtttaca

SEQ ID NO: 509236 - DNA, 130 bp, Homo sapiens
atactgcatttatacggatgaacacctagcaaaacgaatataaatatgctagaaaaacaaaattacaaacagaatgaaagaacttaacagaacacacagacattaagaaggactaggcagagcaatggtc

SEQ ID NO: 509237 - DNA, 80 bp, Homo sapiens
ccgcggtctaacggcagagtagacgcagtgagatccggtgacgagcgaacagtagcagttcgcagtactgtgatgtgact

SEQ ID NO: 509238 - DNA, 142 bp, Homo sapiens
cgatctagaggatccctgagagaccgtgttgcatgatccaagacgaggaaggcattctccatgaccagcagaggttgatcttatgcctggaaagcggggggaaagatgggctgcaccctgtcgtgactacaacatccagaaa

SEQ ID NO: 509239 - DNA, 169 bp, Homo sapiens
gctgaagatcctggtgtcgccatgggccgccgccccgcccgttgttaccggtattgtaagaacaagccgtacccaaaggtctcggcttctgccgagggtgttccttgatgccaaggattcggcaattttggaacttgggcgggaaaaggcaaaagttgatgaggttccc

SEQ ID NO: 509240 - DNA, 1006 bp, Homo sapiens
  misc_feature (41)..(41): n is a, c, g, or t
  misc_feature (66)..(66): n is a, c, g, or t
  misc_feature (69)..(69): n is a, c, g, or t
  misc_feature (88)..(88): n is a, c, g, or t
  misc_feature (144)..(144): n is a, c, g, or t
  misc_feature (176)..(176): n is a, c, g, or t
  misc_feature (245)..(245): n is a, c, g, or t
  misc_feature (250)..(250): n is a, c, g, or t
  misc_feature (256)..(257): n is a, c, g, or t
  misc_feature (264)..(264): n is a, c, g, or t
  misc_feature (277)..(277): n is a, c, g, or t
  misc_feature (279)..(279): n is a, c, g, or t
  misc_feature (305)..(305): n is a, c, g, or t
  misc_feature (327)..(327): n is a, c, g, or t
  misc_feature (356)..(356): n is a, c, g, or t
  misc_feature (359)..(359): n is a, c, g, or t
  misc_feature (363)..(364): n is a, c, g, or t
  misc_feature (393)..(393): n is a, c, g, or t
  misc_feature (407)..(407): n is a, c, g, or t
  misc_feature (411)..(411): n is a, c, g, or t
  misc_feature (453)..(453): n is a, c, g, or t
  misc_feature (493)..(493): n is a, c, g, or t
  misc_feature (545)..(545): n is a, c, g, or t
  misc_feature (872)..(872): n is a, c, g, or t
  misc_feature (883)..(883): n is a, c, g, or t
  misc_feature (909)..(909): n is a, c, g, or t
  misc_feature (942)..(942): n is a, c, g, or t
  misc_feature (973)..(973): n is a, c, g, or t
atgattggaagaggggagaaatatgaagaatagttgaaganggggtttttatgttagattagagtnggngtaagtggtttgtattggngggaaaatgggaggtagtggttttagtagtgtgatttgttgggaggatttataagnggggagtaagggtaaatttgagtttgattggngaaaataaagatgtaagattttgttggatgaagttgatggttaggggtgggttgtatggaggttaagantgggngggttnngggaaanggggggagataangnggggagtggggaggaggtttaaagangagggaagaggtgagtgaaganttgggagtggagtagagagagagtttganggnttgnntggttgtggtgttgagggttgtgggagangggtggtgaggggntgtntgtggaggggtggttgatgagatgatattttgaaaagaagtngatgaagaagttggggttttggtgagattgaggagtttgngagttgtatgagtttgggagggtaatgggttaaggtgaagaagtgatttgantgtgttggatgtgaggggggaggagggtgtgggagtgagggggggggagggggtggggaaaggtgtggagtgtggtgatgggggagtggtggggggggatgtggttggggaggtgggggttggtgttgaaggtggaggggtggtggtatggtggggagaggggggggtgtgtgggtggagtgtagttgtagtgtgaggggggctgtaggtggagtgggtaagtggggtgggaatgataggaggtgaggtggggagaggtgagaaaagggagaatgatgggggtgggagatggaggtggttgaaatgtgggtggtaagaatggtgagnaggggtttgtnaggtggggatgaagggtggggaggtnatagggtgagagagaggaagggttgatgtagantggggtgttgtgggttggaaaagaggtgganaaaaagtggagtggtgtagagaggtaaatgggg

SEQ ID NO: 509241 - DNA, 6083 bp, Homo sapiens
cataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggcccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattatcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctatgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagt

SEQ ID NO: 509242 - DNA, 210 bp, Homo sapiens
  misc_feature (28)..(28): n is a, c, g, or t
  misc_feature (59)..(59): n is a, c, g, or t
  misc_feature (95)..(95): n is a, c, g, or t
ggacatcattcacactactccccatatntaacaacgtaaaatacaatgaagaggcaagnccatcccaaaatactgcttttactaaagcagaatanaagcgaaagagaaatgaaaatgttacactacattaatccgtggaataaagagaagccgaatataaatgacgagatgagatggggatcaaggtggatggagtgtggctgcgcgtgc

SEQ ID NO: 509243 - DNA, 972 bp, Homo sapiens
caacaatgctgcgtgaccatccgtgggtgcactcataggctcgtctggtgctagcctgtcatacatcatgtgtgtggcaatgaatcgcatccctggcggtatgtgtgatacttggaggctatggcaccacttcaacagctggtggaaaacccatggaaattactggcacacatacggaaatcaatctatggataatgcaattgatcatgattcgagaagctaatagggattattatgtacagccaggctatggtctctgtgcagacaaagctcaataccccatgctgattaggtaaatgatgctcacttgaagtcaaggctaaaaaagtcaggttggaaattcaccctagttgtcgggccgtaatgcctggtcagcttagtgtgtcgtgctggctgaggctggggtgccagtatgacatctgtgtatgggcaatggatgagatcatccatgattttccagatacggattatggtcctctggtacttgggagctcaggtgactctgtataattcagcagctcaagaagatcccaactctattatagcaggcatgccagtccttgaggtctggaaatcaaagctggtgattgtttatgaagaggtcttgggtgtggggtatgctgcggtgtgcaatgcaatcttctagagaacctagcacggcatgcttctaggtgatgccgagaaaacatgtgacgcgctcaggcgaaagttagagaatctatcagaagtaaatattaggattcagcgtggtagttaataatgcacctctggcggtcgggaccggggatccaggatccgtacccgggggggccccggggcaagctcggggaaacggcacttggaagcccgcgcaccggtagcgagtttcaagggggccccctttgaaaggggaaccacagggccggggatggggagcacaactttcagggaggccctcatgggcgcttccccccacaagcgagagggtggtgc

SEQ ID NO: 509244 - DNA, 399 bp, Homo sapiens
  misc_feature (65)..(66): n is a, c, g, or t
  misc_feature (290)..(290): n is a, c, g, or t
gaggggacgtatcgttggcaggttggagccgctgccgtcgccatgacccgcgttaaccagtgtgnnctggcccgccagaggatttgagcacgcagcgcgtctcttttaagggacagcgcctttataacacactttctgttgccggccgcaagcagatctacacgcttattttgcagtaccagcataatacgccaacggatttatcggggttcccaagttttctccttgtttggcgttctatccccttgccctccgccttcgcacctggtcccaaaatgatcaatggttgnggtcaaatctccagtaccccccccctttaacggtcttccatttcacttcattccactcttcacatccgccccccgcctctcctccgggctccttcccttttttcccccg

SEQ ID NO: 509245 - DNA, 489 bp, Homo sapiens
  misc_feature (355)..(355): n is a, c, g, or t
ttacttgctcgagcgccatggtgtacgggatcggctagccgggggaagtccgaagtagggaaatttatttccaacaacccagttaggggtttctttttcccacaggggggaatcttccccctggggttttaaagctttaaaaaaataaaaatttgtttaggggttggcccccaggggggtaaaattgggggttttttaataattttcccccggggaggggggaaaaaaaaaagggggcttttttttttttttcccactgtttgaaaaaaaaaaaaaaaccccgcggaataaaaaattttttttttttttgggaagggaaaaagaaaaatttttttttgttgggggggcaaacaantattttattaattattccgccgccgggtggggggtattccccccccccccccccgcgcgggggggtttttttaatttaaaaaaaaaaattttttttttttcttttcctttattttttttttggggggggggaaa

SEQ ID NO: 509246 - DNA, 105 bp, Homo sapiens
tagtaatgaaggaactggtagtgccgatgcaattgatggttatgaagctgatgatgctgagggtggtgatgggactgatccaggtacagaaccagaagacagtat

SEQ ID NO: 509247 - DNA, 199 bp, Homo sapiens
cagtatcaactgctttcaattcatcagcattctgcagtagtcatccattgtccagtgtatctggacatattcatataggatcctgaatgtacctgtgccacaccgtgggagttagaccaaaaaatgtatctaagcaacttacacaatacagtaataacaaacaatatgtttgattctgcaactttataaggaaagtatg

SEQ ID NO: 509248 - DNA, 208 bp, Homo sapiens
gccccaaaatggggttggggggggcccctttaggggtttcccttcccccttagggggggaagggggggcttccctttcccccaaaatgggggggctttcccccccccccctcccgccccccgggggggggggggggggtattttttggggggcggggggggccctttgggggggggggaaaaaaaagacaaaggggggggccccccca

SEQ ID NO: 509249 - DNA, 480 bp, Homo sapiens
  misc_feature (395)..(395): n is a, c, g, or t
acctctggtagaattcggctgtgaatgcatctggtcctcgacttgttttggttggtaagctattaattattgcctcaatttcagagcctgctattggtctattcagagattcaacttcttcctggtttggtcttgggagggtgtatgtgtcgaggaatttgtccgtttcttctagattttctagtttatttgcgtagaggtgtttatagtattctctgatggcagtttgtatttctgtgggattggtggtgatgtcccctttatcattttttattgtgtctatttgattcttctctcttttcttcattagtcttgctagcggtctatcaattttgttgatcttttcaaaacaccagctcctggattcacagattttttgaagggtttttttgtgntctctatctccttcagttctggctctgatcttaaataactaagatcagataaatggtatcttaacacaggggtccccaacccctg

SEQ ID NO: 509250 - DNA, 127 bp, Homo sapiens
atcattgtgttactttcatgtatgtaaaccactgtaggatgactaacacgttaccaatatgtagttttggccagtgcgccaatggctcgatgcctagtgatcccccgcactttgggaatactgaagt

SEQ ID NO: 509251 - DNA, 120 bp, Homo sapiens
gggcagtgaagctcatcctacacagtcgctgcctcctcatttgggctcctcggggcctgcagtggaggttctcgcacctcttccaggcccctagattcctggcaacctcccttcccttgc

SEQ ID NO: 509252 - DNA, 1269 bp, Homo sapiens
gtgcgtgctgcagtgcggccgagctgggactggctgggtcgtgctggtgctgctggtgcgaggagcctgctggtggcttgtgctctgtgctgtgccaatggtggacatgctgctgtggtgtgtgcctgatgtgattgctttgctgtgtggctgtgtatgcttcctggctgcccgctcgctgtgtgacttgctgctgcctgttgcctcacacatgcctgatggctgggctctggctgcacatgtctgctgctcctgctgctctgctgccctggtgtgcagctccagtgttgctgagcagctgcgaggatgagctgctggcccttcaggaggcaagggcgaaatgtattgacagagattgtccgacaagtggtgtagcatacaagggacagacaacgttggacgaagcgttacacagtgatgagcggtctatttcgtacagacaacaggcaagtacattcagcgcggctggacaggctttgaatgcaatgacgcacagattccagttttacacaagtattgcgtggagaaccactgaacgttgtactgcaggaaacgatgattgagacgtgtaagtttggggtggacggatgagacatcaaacgcgttcgactccaagcgacaggttcaccatgagacgaactggtatcgggcaggcatccgcgcccttgacggtcgaccgtcccgacgccgttcagctgcactgcgccccataggtcgaaacctcgaccgtagaaactgctttgctgggcagacacccaggaagcaaagggccacgagccagcatagcggcgtcaggccccacaggagcccccgcgcccacacccccacggtcgccccaggagcaacaacgactcacccgccggggcataaccccgagcgcgcatcgcgaccccatgcgccccagagccgcgcgccgagagcagcacagcacacacatggagcacacgaacaggaccgactcggccgacgccggacctcggacgagagagcaccgacaccccgggcgcgagaaccacacgcacgccgaagcggaagcagcccactcgctgcgaccggggaacgaggcgacgacacccggaggccaaaacgagcgacacaacaccaacgccgactcgcacacggaccaaaattagtccccacacgacccacggacgcgcgacaccacacgccacacaccacgaagacaaccgacccccactcgagccgccgaccccagacggcgaagagacagacgccgcgaccgagctacacacgcgaccacgaggcgct

SEQ ID NO: 509253 - DNA, 401 bp, Homo sapiens
gggagtattcacatcaccctgaggctcacccacatagttctaaatatggaaacccacccggaaccccaatatattcacagccctgcttattaccacattttaactgggtctctattttaccctcctaccagcctcacgaggtacttcgaggtctcccttccccactttccgacggcattttcggctccacacttttttgtagccccacggcttccccgggcttcacgtccattattggctcaacatttcctcactatctgcttcatccccccaactaataatttccactttacaaacccaaacatccactttggcttcgaagcccccccctgatactgcgccattttgtaaatgtggtttgactatttctgtatgtctccatctattgatgagggtcttta

SEQ ID NO: 509254 - DNA, 129 bp, Homo sapiens
gcgtcgacttggaaagcatctagtccagtgggaagcacaggggttggagaaggtgctacatccctcttcccatcaatatgcctaaatgtgggggagggccagagagtggcacccaagagcctgcgggga

SEQ ID NO: 509255 - DNA, 781 bp, Homo sapiens
  misc_feature (702)..(702): n is a, c, g, or t
atggtactgcttatgaaacacagaataaaattcttcacgctgtgtaaaactctttctggagtctgtgaccacatcatatccctgtcgacagatcctctcggtttcacagtctgctcacctgaaagagatccaactggtatacattaaactaagcgaagggctggtaagagataccatgtttatcaaaaccaccatctttcagtttagagctaatgatgaggacaaagcagtctatgaatgtgggaatctatgaatgtcaacaaacactgaacattttggtattttcttgctggaggatttatgctagtggaatttagtgatgcatgataagaaattttatcaatatcattgaaagtgaaggaaaattgaatacggcgacttttgatttaatctacttggggactcatttagctttaatgacatttatttcacctaacctcctataaaaagtcgcttagatttataaggaagtttatagattttaataactaaacacccatagcgtccgcttccctttagggaggcgtaaattttcatcctacttaactgactccctagacttcgacacctccgcttcacaatagcagaattattcttttacatctgccgattcccagcctctcgaagattttagagataactcccgaaacaccttgaaacaaaaaggcctccttaacgtacatatcctttacacgcaccttntacctgccagttcacataccctcccccacctaacattttgtcaaaataatactcgaacatacaccgtgcatacataaat

SEQ ID NO: 509256 - DNA, 1015 bp, Homo sapiens
cccgcgtgcgtgcctcctgccgtcgcgtggaggtccatgggggcttcctagtttctcccccgcgtggctctccccaggtctgcttgggtggtcgaggctggaggagtgttgtgtcagccgatggtgcttcctgcgcgagagagatatgagccgccccgggatgattagtagtgcgcgcccgcgtggagcgacttcatctcgggtgtgggtgagtcggccgcgcattgtcttcgtcgctgcgtgagggcgggctggtctcttgcggagcggggggacctttgctgtcccacccccagggccgggccttctttccaggaactaccttaagcgggtgcgctcccccccgcctggttcatcatttcgggctcttgccttccttccgtgggcagccgcacctaagcttcttgtccatcgtaaagagtggctcttgctcgctgagccaccacctgcgagcggtttattaatcacatcatgttgctgctagggtgcaaagtctcctctacggggaaaacccgttgcgcctgtacacgatcatgtaatcagaagcttggccacgtgattatcttcttacttgcgaccgccacttaagtaagttcagtgcgcctctgactttcaagcagtgggcggagcgtcactcccccgcacccatgccacgagaataaactgttccccctcgctgtttacttactcacctcggtgcaatcttgtgtcgtccactcacgccacccccatcgccttggatatgttgatgaatggtgtccgctccgccccctctaccgtttctatcttctcgaaaatattatagtttctggtgttcctaagaggagaactcatgtgccactggcgcggtgcgaatcaatacgcaatcgggggggcggcacgcaacttaagactacggagaggaagacgcgcacccggacgtatttttttatgtaacaactaacatacacaagaagaacaaccgccaagaacaggaaatccaacaaacaagaaaaacaacaccacatgttcgcaa

SEQ ID NO: 509257 - DNA, 135 bp, Homo sapiens
ctcgcttggtgatgctggtcctgttgtccccccggcctcctgtacctcctggtccccctgtcctcccagcactggtttcgacttcagcttcctgcccctagccacctcaagagaaggctcacgtatggtggccgc

SEQ ID NO: 509258 - DNA, 626 bp, Homo sapiens
gatctgcttcaagaattaacgaaatgcaggtgtcaagacagtaaggattcaaaccatgttgccaaaacatgagtctaagtgcatgtactctcttcctggcattgattgcgtggttaccagtggtccagtactatgattattgattttaccggctgatcaatttatggggcagatcgatcatccaaactgatgcaaccagaatgttactgccctgaaaggctacccaagtgccatgtactgtgatgagctgaaagttgaagaaagtgtagccaagtggtggtcctccatggagatctagagtatcttgacgcgttagtgaataaccaggattgacctatattgatgagaaggcctttgacgaagtgtaaactgatactgcagttggcatcatgtctaagatcgagcaatcgcttctagaagagactccaaagataccaccgggagagttttctctacacttgaatgcaactgagagaaggctgtcatataaaccagcaatcagactctgacaggagctctgtgtggtcccgacgttccccaaatctctggcaggatcttgcagcttactcataaccatggatctacaaaggctggggcgtccttttcgaagggattgtgtaaaacct

SEQ ID NO: 509259 - DNA, 134 bp, Homo sapiens
aaaggaccagttctttagaagacattaaagcaaaaattcaagcaagtatagaaaaggttgttctcttccaaagtgtagccaaatcactaatttataagatttcttcggactacttaccaagaggcgattcaaga

SEQ ID NO: 509260 - DNA, 144 bp, Homo sapiens
ataatactatctggtatacatcttccttaataggggtataccgagatgtctcctttatactaaacttggttcaattccacaccaagacaatgactacctccgttgttctcagatccagcaacggtcaagccggttccacacggt

SEQ ID NO: 509261 - DNA, 107 bp, Homo sapiens
ccgcctgtgaatagcactgcactccagcctggacaacacatgtagaccccatctcttaaacaaaatgaaagaaaaaatgaaataagtgtgacagctgaccattgggt

SEQ ID NO: 509262 - DNA, 197 bp, Homo sapiens
tacgactctgagcttagtaccctcgataaggcaactaggagtgtatttgccagtcataggaggcgtcattcactgagtttcccgctattcttcagtgctacaccctagagcaaaactacgccaaaatccatttcactatcatattcatcggcgtaaatctaacgttcttcccacgacactttcttggccttatcgag

SEQ ID NO: 509263 - DNA, 325 bp, Homo sapiens
cgtcgacttttttttttgtatttttagtagagacagggtttcactgcattagccaggatggtcttgatctcctgacctggtgatccacccgcctcggcctcccaaagtgctgggattaaaggcgtgagcaccgcggcctggcctggccactaattattaatgcatttggcataattagaaagttggaagttaacttttttttcttcttttaacagacatggaagaatgaagggtttttttgctctctataaaggcttttggccaaattggttgagacttggtccttggaatatcattgtatccttttctgttgcaatgtcgacgc

SEQ ID NO: 509264 - DNA, 333 bp, Homo sapiens
tcagccatattgtatccccgctacactgctaccttcccagcttttgttaccatcattctactaatctatcgtccctgagttaattttctaatattttgcacccatatgagtgagaacacatggtatttgtctttctgtgcctggcttatttcacttaacatggtatttgccagttccattcatgttgctgtgaatgacaggatttcattcttgtttatggctgaatagtattccattgcgtatatgtactatattttctttatccattcatccaatgatgaacacttaggttgattaaacatctcggctattcgtgaatggtgctgaaactat

SEQ ID NO: 509265 - DNA, 378 bp, Homo sapiens
aaaatactgggctcaagcaacactcccacctcagcatttcaaattgatggaattatggatgcgtgccacccatgcccagctaattttttttaagagatggggtctttctgtgttgccccatctggtctttttttttcccttctttttctttctcttttgaggcacagtgttgctctgtcacagagtagtggtgcgatatcggctcactgcaacctccgcctcccaggttcaagtgattcgcatgcctgtaatcccagctactcgggagactgaggtaggataattgcttgaacctgggagctggaggttgtggtgagccgagattgcgccattgcactccagcctgggcaacaggagtgaaactctgcctcagaaaaa

SEQ ID NO: 509266 - DNA, 182 bp, Homo sapiens
ttttcccttcccccccccccccccaaacccaaagaaatttttggggcctgcttttgggttttgaatttttgcccctttttttttttggtcctttgaaaaagggaaatggctatttggggccttaaattttggggccttttcgtttttaaaatgttttttaaataaaggtccttttaatccca

SEQ ID NO: 509267 - DNA, 1195 bp, Homo sapiens
  misc_feature (246)..(246): n is a, c, g, or t
  misc_feature (1195)..(1195): n is a, c, g, or t
gattacccccgttaggtgactatatgattgcacactcaaactccatgctagatagtgcagggggtggcggggccgagagcctgcgcgtggcaagctctctggaagacaactgtgcgacaattcatggcatcgtcggtgcagcgtagagtctcgcggtgaaacgagcgtgtgttgacagctagagactctatagatttagcgcttctgttcctttattaggcctggagaacgcgagcgtaaatgagntctctagggtcgccgaagatttcagagtgtccagctgtgatatattaattgtctacctttgaatgtggcgaatctttgtgtagggagtatgcctgtgaaaggttgcttgcgttttagcacaaagagaccaggggatggggcccgcgagtccttgcacgggcatagcttggtcgccaggccacggggtcaggtggcatagcagtcaccaggggcaatgctgaggagcgcagtgtgagagctgcgcgtcagagccaggctaggaggtccggtggacttgggcttctaggcgaagctaatggggccctcaggaaggcgttagggcctttggaggcccaggcatccctacaggagcagctccctgaggatgaggtcggggggcgcggggcaagtccagggcaagttcccaggtcacgagatgatggaaggcgctgaaagtggcatggcttcctcctggcgcagagcagggggtccttccagaaagactggcaggccaatgaaacctctgagcgagcagatgtactccggccggttggctgggcgtctgctttctggtgcaggagcctggccaagtctgtagctctctggtggggtgagcggggggtgaaccggggtcttaagggggttggggggtcctccggcatggggggaatccctcgccaaacgtcttaggggtctgggagccccccaggggtatgaatcggcaagagcgcgggaatagagggaacaaacccgggggggtctgtagcgggcacccacagcggcgcagggccacagcgaagcgccctgtttccgcggcacgacaagaagcccccgcgggggatgcattggcgtggctcgaccaggcgacccccgcatcggtgggaggaacatgcctcacggacgagtcatagggcccgcggtgtagatagcgtaggggtgggagccgacaaggcaactgagacagaccgtn

SEQ ID NO: 509268 - DNA, 422 bp, Homo sapiens
  misc_feature (311)..(311): n is a, c, g, or t
actctagaggatacccagttcgaccgagactctcgatatgccagctggagaggcccgagataggtctccaggtccatagttcccatcttgacttcgcatcatgacataatctcgtattatgtaagctcccccgactaccacacagagacagttggtccagaagtcaggatctagacctcacgtttcaagactggagatcttcagcgctgaagtacatttcaaccgcatgttccaatatctgggctgctttagacagtgatgtggggttctatggctacagaaagaaagacaggttgctgtgaatctccacntccagcgcaataaatagtctctctgacttcatatgtcttagttctgtgacttctgtttctaccctgcccgtgtcgtgctctagcgaggctgtcagcataattgcagctgga

SEQ ID NO: 509269 - DNA, 893 bp, Homo sapiens
gcagacaggtcttataacatatctatatgtgtatatgtgtatatagagatccatgcaaacacacatgcatatgtatgcattcatatgtcagaaacaaaaggaataaacaaagggttatttccttcatatgacttttttttttttaaatttgccagccaacagtcaccattctgaaataaataatacagggtactgaacatctctctcagcaaatcaatgcctacagttcctaagaacattgcacagtttgactctacaatagtactgtacctcagaatatgagatgttaactagtgtctgcattgcttgtcaaatatccatttgttcttttaaaggacacagataacactatccattggtgatttaaaattgaaaaaaaaattaggaaaatggggaaaaatcctcttgagaggaggaaaaaaaaaaaaaaaaactaccctttaccatgatggccggggaatttcacaacttgttgcaatcagtgccatttggctagtgtacagaatctgttatgtaagcaaccattaatttccactgagagtgtctcacttttaaccagatttcttaaattttttaaccttctaatggtattctagggagggcaatgtccaactcctgttaagggcttacactccgcggtgcctttgtgttttgtacatacttgagatttgcgtgcacagtcacagatgtcccattggaataccaattaatgctcaggggttgggcccaaacttatacccaatgcagttttactacgctttgttctggccgggcccggcgcaggtattttacccccttttcttcaatcttgggaatcccgacacttagttccccgggttctccaacggttggtttgccacctcctcccaagagtctttctgttactcctcccg

SEQ ID NO: 509270 - DNA, 282 bp, Homo sapiens
  misc_feature (2)..(2): n is a, c, g, or t
  misc_feature (78)..(78): n is a, c, g, or t
  misc_feature (81)..(81): n is a, c, g, or t
  misc_feature (114)..(114): n is a, c, g, or t
  misc_feature (138)..(138): n is a, c, g, or t
  misc_feature (144)..(144): n is a, c, g, or t
  misc_feature (148)..(148): n is a, c, g, or t
  misc_feature (150)..(150): n is a, c, g, or t
  misc_feature (163)..(163): n is a, c, g, or t
  misc_feature (165)..(165): n is a, c, g, or t
  misc_feature (170)..(170): n is a, c, g, or t
  misc_feature (174)..(174): n is a, c, g, or t
  misc_feature (176)..(176): n is a, c, g, or t
  misc_feature (194)..(194): n is a, c, g, or t
  misc_feature (206)..(206): n is a, c, g, or t
  misc_feature (276)..(276): n is a, c, g, or t
ancgacgaccgacgacgacgcggggagcgagaagaagaagggccgcaacaggagcaaggaggagcggaagcagcaccnganccgggcccgggagcagcggaagcgacgcgagtncaagaagcagagccggcaggaggnccagcnggancngcagaaaggcgananaagcncgancncaacaacaaagcccaganccaccgcaaaancaagaagaagcggaacaagaagaaccaggacaacaggaacaccaaccaggagaagcaggcccacggcgcncacacc

SEQ ID NO: 509271 - DNA, 405 bp, Homo sapiens
cattctcgtactacataggcagaacacccaagattgagcagctttctactatgattgttcagtcttgcccatgccgctcatattctagtaaaagtgtcaagaccaaggatgacagtgatgatgataatgatgatgacgacaacaaggatgatgcttgtaacaggaaaacgtaacagagccatggtccatcactgttaagaaatatgagaaagatggcgctactaggtcagacactttggaagtgtgtgtcctgttggttttacctggcagtctgactacatagaaagttgactggcctctatactacatgtcacctactttgtgggtgagagtgacaagaatctatattagtcgatagaacaaaatgggcactggatccatgtctgagtgtgtcttatgtggtct

SEQ ID NO: 509272 - DNA, 983 bp, Homo sapiens
tgcgggggggctgagaagaaagagattatatgctgtatataaatatatatgtaaattgtatagttctttgtacaggcattggcattgctgttggttaattgtatctccctctgcctgctgttgggtggtgggcactctggagacatagtccagcttctaaaatccaggactctatcctgggcctactaaacttctgtttggagactgaccctaagtgtataatagactgggagtccgtgcaattgtactgcggactccactgagttcttttctggtgggaggactatatggccccgatgccattagttgtcaaaatctgattaagtcactctgggtctcggccttgtccagggaggttgggctaaggagcagatggaaactgccctgggagaggaagggagtccatgatcccatgaatagccccacacgaggtaccggctctcagagggtccgtgcattcctgatctccggagcccgcaaagggcccagcatggtgggtgcacgcagtatcttagtgagcctcggagcaaattatccacttaagaggatttgcatttacgtccgctcgaaacgtaatccatccatgcttagcgatctactctgtataacgcatgagaggggaggcaaggaagaaaaagacccgcagtaagggctttaaaagactggatatttaatatctaccgcagggggggggacaggacagaaagcctgggctgagggctgcggcgcgacaggaaagctcttcactccgggagacctaccagagttccaaagagcagggccaggccggcgagggggtgagcctcccctctcactccgcggggccaggtaacagacgggggggtgagagagagcgcacctgagacaaaagttggggataaccacagggctgaccacaaagggcgcacacacacaaaagggatccccagcgggaaaagacacccaacaaggagaaaacacaaagagacagacggaaaggaccc

SEQ ID NO: 509273 - DNA, 207 bp, Homo sapiens
tggccaaagtagtacccaaatgctgaaatactagtgaggggtcgggtgtggtgacgcttgcctgaaatcccagcactttggaggccaaggcggacggatcacttaaggccagcatggtgaaagccatccctactaaaaatataaaaattagcagggcgtggaggtgcatgcctgtagtcccagttacttgggtactacgctttggca

SEQ ID NO: 509274 - DNA, 228 bp, Homo sapiens
  misc_feature (15)..(15): n is a, c, g, or t
  misc_feature (25)..(25): n is a, c, g, or t
  misc_feature (59)..(59): n is a, c, g, or t
  misc_feature (114)..(114): n is a, c, g, or t
  misc_feature (117)..(118): n is a, c, g, or t
  misc_feature (122)..(122): n is a, c, g, or t
  misc_feature (132)..(132): n is a, c, g, or t
  misc_feature (176)..(176): n is a, c, g, or t
  misc_feature (227)..(227): n is a, c, g, or t
ttaggtggtcccggncccttgagancaacctagtccccggcggcccttattcgtccganaagatgaagaaacaatcatgaaccaggaaaaactcgccaaactgcaggcacaagngcnnatangtgggaaagnaactgctcgcagaaagaagaaggtggttcatagaacagcacagnagatgacaaaaaacttcagatctccttaaagaagttaggggtaaacaatana

SEQ ID NO: 509275 - DNA, 886 bp, Homo sapiens
  misc_feature (496)..(496): n is a, c, g, or t
caatgctggtgtcaacccttcgtgggactcctcagcccacacaatgccggacctgtgacggtgccgcctcgattatagatgcccagttcatttctactgggtgcgtggtgaagaaattattcctcggtggtcatcgaagaggtcgaattgatgacttgcgatgaccagatagatgataaacgcgaaactaacgcgagattcgaatatccaagcaactcgcagacggtttgtagccagtcgcgattacttctggtccctataggaaatcccactactatataagatgtaacacccatgacaaatcttccattagttgcaagacggcagctatgaagaaccacagtatctgttggctcatataaactgcagatccttgctgttacggtcacacccagttgcatcgtgcttgaccctgcacgaagattaacggagaggcgaacaggcctctttgcaggactatgagacttgctgcctgcagtctagcattcagcatagntgtggtcctttggtaagagcgttagagtgccttcatgtgcgaatgccctgtgttcgctgtctgggacgtgcggagcccacccaagccttatggttcatcaagggatcccgtggaaggtgagaagccaggactgtgtacgtcgaagcgtctgtctgattcctcccctaggcctgctgaattcacccagtgagtgtgccacacatactaacgttttattccctattattctcctgacctaccgcagacttaaaactactttttgggccaacgttgaaacttaaccagccaaaagtctgaagtccacaaaaagtacagccgccttcgtgaaaaaaaaattactaatgctcggggggctaccagccaaaaggtaaaggccccttcctatgtaat

SEQ ID NO: 509276 - DNA, 380 bp, Homo sapiens
  misc_feature (153)..(153): n is a, c, g, or t
  misc_feature (308)..(308): n is a, c, g, or t
gcattgagagatcacacgatgcttaccgtgtagttccagctactgggaaggctgacatggtaggattgcttgagcctgggagtttgaggctataatgagccatgatatggaccactagaactcctatcctgtagtgacagtggcaaggtcctngtttctgtaataacatgtgtgcccagtcaggtttcgtcttcctgggattcagaaagtctttcattggtaggtcctagttgtccagtccattttctcatattccaagcactggagaatactagtgacagtacgttgttctcaagtggaatcttcangcttagggtgggctacttttaataacatataaaaatctctttccttctaaaggtaacatccttctcaaggcc

SEQ ID NO: 509277 - DNA, 393 bp, Homo sapiens
  misc_feature (153)..(153): n is a, c, g, or t
gacactgggaccagaatgagcgttacctggtggtgctcaacttccgagattcgggccggtcagccaggctaggggctccaacctccctgctggcataagctgccagccagcgctaaacttttgcttagtaccgacagtgcccggcaaagcgtngaggaggacacctccctgaagctggaaaacctgagcctgaatccttatgagggcttgctgttacagttcccctttgtggcctgatccttcctatgcagaacctaccaccctcctttgttctccccaggccttttggattctagtcttcctctccttgtttttaaacttttgcagattacatacgaattcttatactgggtgtttttgtcttcaaataaaaacatcacccctgcctcatga

SEQ ID NO: 509278 - DNA, 315 bp, Homo sapiens
agctctctcagcagacgcagctcaccaccacctccgcctccctggttcaagctattctcgtgcctaagcctcccgagtagctgggattacaggtgtgcgccaccatgcccggctaaattctgttatttttttttagtagagacaggatttctccatgttggtcaagctggtctcgaactcccgacctcaggtgatccaccagcctcggcctctcaaagtggtgggattacaggcatgggccactgtgcctggccatcaagtgaggactgaaaatcagagtggtaaattgactctggagctgcgtctgctgaggag

SEQ ID NO: 509279 - DNA, 184 bp, Homo sapiens
actactagatttctatatggggatgtctcacaggcatataaacatagcatgctcaatatggtgatcatctcttcccaagtaaagctgtactactgccagaatttaccctccagaaaatgccagaatgccaatcctgaaagcacagaaaatcttgggaacatctttaacctggtcccttttccct

SEQ ID NO: 509280 - DNA, 137 bp, Homo sapiens
ctccattagccaccgcaatgaagctgcaagggcggtacaagttttttgaggcaagcttccagcaggacatggagcagtacctgtcactggctacctgcagattgcagagcggcgagagcccataggcagcatgtcat

SEQ ID NO: 509281 - DNA, 207 bp, Homo sapiens
gcccggcaggccacgctccttggctgcctgttcctgtggctgggagctggaggaggcgccgctgtcagctggccagagggctggcagttcttcctgtgcagcgcttgcccagtgttgtgcttggagcactcacatctacgtgtgccctgcttcttcccagctgctgtcccgtgggcgctcatacccccatctggtgaggtgctagga

SEQ ID NO: 509282 - DNA, 124 bp, Homo sapiens
tggatgacgtgtcttgacacatctgtaccttcgggaacggagttcacatgtagcggtggaagccaaacaggtggctcagcaggaagcagagagtggccagatttgtggtgtgtcagaacattag

SEQ ID NO: 509283 - DNA, 518 bp, Homo sapiens
cggcacgagggagggcagggaagagaagttgaagggagcagtcagcttggaatattgattactgttagttgctgtgacagtttggctgtagtcagtctttgcctctcattcaaacctaactctttcaaaagccaaacaaaatggacagaccctacaagatggaacttgtgaatttgaaaacttaaacaaaatagaaatatttttgaagacgattaccagattgatccaaaaataaattaagaacttcaatagaccagcgttagagaaattgaagcagtagtccaaagtcactctcccaaaagattgaggtccaggattttcaggaaagcttttatcttcttgttgagggacatatatgtattccgttttaaaacaagtttctcggctgggcatggtggatcacgcctataaccctagcactttaggaggctgaggcaggagcatcacttgatctcaggagtttgagaccatcctgggaaacaaggtgagatcttgtctcaatgaaaaagtaaatatta

SEQ ID NO: 509284 - DNA, 421 bp, Homo sapiens
ctgtagttgcacttcacagcttcggcaagctcccgtgcgtacttctcatacctgccggtcatcttagagttccacacctcattcacctgctgccaaaggtttagctcaagcttagcacctaccagtccttcccggttacgggacagcccagaagtccgcctcctgtcagggcttgccacatagctcaagccttaaaagtagccaaagtcctgtgtaacctttctttccctctcccaaggtaacctcgttcggaaagtgctcgtgtgcccatctcgattatatggcccaggtgaaccagtgattgccaatgtctgcgtttctgccctcatatggcccacaggcactcttagagtgctcctatcgtgcccgaggggttaaatatgatctcagccgcgtttattctgtacatgagctcgtgcca

SEQ ID NO: 509285 - DNA, 810 bp, Homo sapiens
  misc_feature (9)..(9): n is a, c, g, or t
  misc_feature (167)..(167): n is a, c, g, or t
  misc_feature (181)..(181): n is a, c, g, or t
  misc_feature (194)..(194): n is a, c, g, or t
  misc_feature (231)..(231): n is a, c, g, or t
  misc_feature (233)..(233): n is a, c, g, or t
  misc_feature (247)..(247): n is a, c, g, or t
  misc_feature (254)..(254): n is a, c, g, or t
  misc_feature (260)..(260): n is a, c, g, or t
  misc_feature (262)..(262): n is a, c, g, or t
  misc_feature (269)..(269): n is a, c, g, or t
  misc_feature (287)..(288): n is a, c, g, or t
  misc_feature (290)..(290): n is a, c, g, or t
  misc_feature (304)..(304): n is a, c, g, or t
  misc_feature (376)..(376): n is a, c, g, or t
  misc_feature (407)..(407): n is a, c, g, or t
  misc_feature (412)..(412): n is a, c, g, or t
  misc_feature (421)..(421): n is a, c, g, or t
  misc_feature (491)..(491): n is a, c, g, or t
  misc_feature (494)..(494): n is a, c, g, or t
  misc_feature (577)..(577): n is a, c, g, or t
  misc_feature (596)..(596): n is a, c, g, or t
  misc_feature (598)..(598): n is a, c, g, or t
  misc_feature (608)..(608): n is a, c, g, or t
  misc_feature (635)..(635): n is a, c, g, or t
  misc_feature (642)..(642): n is a, c, g, or t
  misc_feature (652)..(652): n is a, c, g, or t
  misc_feature (655)..(655): n is a, c, g, or t
  misc_feature (705)..(705): n is a, c, g, or t
  misc_feature (789)..(789): n is a, c, g, or t
ataaaaaanaaaaaaaaaaaaaaaaaaaaaaaaaaaaaaaaaaaaaagaaaaaaaaaaaaaaaaaataaaaaaaaacaaaaaaaaaaaaaaaaaaaaaaaaaagagaaaaaaaagaaaaaagcagaagaaaaaaaaaaggaatgaaaaaagactggaaaaaaaaaanaaaggaatgaaaanaaaacgaaatatnaaaaagtgtagaatcaggtcccctgtaatgtgattgnanagtgtggaaaaggnccgaaangacgananatgagcngtggaagggaatgggggnngnagaagggcaaaaanagaagtattggagggagaggccgggctctcaggaagcagcaggaacgtgccaggtggaagccagctgcaggnaggggaggaaggaggcccttactcttccttnttgtncatgggacnatctaatgcagcctgcagctttgcgtgctcctccagcaagcggtcgtattccttggtgaggccctcagantgnttccgcatggccagaacctggttttcagctttctctagtttttgcttagtgctggccagctcgtcctttagcttctgcaggtnagccttcaggctcctgttntnttcctccaanttcacctcagcattcccgaaatccaanttgactncgtaaaaagnagntccctttttgagctggtaattctcctccatgtacttcttggccgcctcantagcactctccgcctgctttttaaaggcttcattggaggccagcagcgtggcctgctgcgaaatgagagtaacaggcgtctaanaggaaggacagcaccaggaaa

SEQ ID NO: 509286 - DNA, 3185 bp, Homo sapiens
acaaccctgccaatctcaagcacctgcctctacagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaagaacagtgtccgggacatcacgggtgccctgttcaagcacagcaagaaggggcctagagccagcggcaacctcatcccacaggagaagattgtcaaccttgtcaatgacatctttggagcaggatttgacacagtcaccacagccatctcctggagcctcatgtaccttgtgaccaagcctgagatacagaggaagatccagaaggagctggacactgtgattggcagggagcggcggccccggctctctgacagaccccagctgccctacttggaggccttcatcctggagaccttccgacactcctccttcttgcccttcaccatcccccacagcacaacaagggacacaacgctgaatggcttctacatccccaagaaatgctgtgtcttcgtaaaccagtggcaggtcaaccatgacccagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggcgcttctccatcaattgaagaagacaccaccattctgaggccagggagcgagtgggggccagccacggggactcagcccttgtttctcttcctttctttttttaaaaaatagcagctttagccaagtgcagggcctgtaatcccagcattttgggaggccggggttggaggatcatttgagcccaggaattggaaagcagcctggccaacatagtgggaccctgtctctacaaaaaaaaaatttgccaagagcctgagtgacagagcaagaccccatctcaaaaaaaaaacaaacaaacaaaaaaaaaaccatatatatacatatatatatagcagctttatggagatataattcttatgccatataattcaccttcttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcaggtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactatagatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgtttttttttttttgagacagagtcttcctctgtctcctaagctggagtgcagtggcatcatctcagctcactgcaacctctgcctcccaggttcaagtgcttctccagcctcggcctcccaagtagctgagactacaggcacacaccaccacgcctggctaatttttgtatttttggtagagacgggtttcaccatgttggtcagactagtctcaaactcctgacctcaagtgatctgcccgcctcgacctctctcaaaatgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacac

SEQ ID NO: 509287 - DNA, 373 bp, Homo sapiens
ccggcaagcgcctgccggcctgtacgctgaaccattggtccatgaccagcggtttgtccttgaagttttcggcaaacaccgcgagggcctgggctttctctgcttcgaacggcgagttcaccaacaccgccaacgccgccaggcgtacggtcatgttatcgctggtgtcgaactgatccagggtggccgccaatacttcaggcttgccgctgagcatcaagtaagacagcgcgacgttctgcagcgcacggcgggcgaagcgctcggcctctgccacgtaaggcgtttgcttggacagctagcggttgttctggtagcccatgcacaagcctttgaacaggttgtcggccagctgcttgcgggctaactcgcg

SEQ ID NO: 509288 - DNA, 775 bp, Homo sapiens
ccacgcgtcgaacgaggagaacgattcgtgtggacattttggagaaccagaccatggcacaagcatatgcatgttgggcatgatctgctacgatccagaatttggcttggacaagatctctgcctacatgaagtccagcccgattcctcccaagcacctgtgttctcactaggatggctgtctggggccaaccaagatagggccgtatgaaggcacaggaaggtgggagttgacggagcctcgatactcagcgctgcttgcccaggctgtgcaagcgtcagacttggactcatgctgtcccagtcactcttgtcttccttcgtgtccttttctccatgctttattcccatctattactcccgaagatttctattgtccctccttcaactcctcgcctaaagcccgtgctcctctatgcaagggccccttttgaacacgcctcaatgctaccgctagcatatctcctctccgttgaaacatctctcacttctctatcattaccccatctcgcctgcacttgaacgttcaggctcctggtcttatctcgtttccgtggtcagtggggttgtggtcttgcttgtctataggggggccttgccctggtcgcccgtctgcccgtgtgggagctcgatgccccggggtctggtccgccagtgttcgcatgaaaggaagcatgcatatgacctcgtgtttacatggccctgtgtcctgctggcattggtgcccctggcctgtatggccctatcctggatggaaagtaaaggcctcaaaccac

SEQ ID NO: 509289 - DNA, 797 bp, Homo sapiens
tcgacccacgcgtcgcccacgcgatcgcccacgcgtacgcgtgacgcgtggtgtccgctgtccagcgcatcagcgagttagagaggaatgtggcaagaacttaacgcggaaagctgcccaaaactccggggcaggcagacatatattgaacacacgtagtatatactgtgaagcaaagtgcagaagatgttccgaagactttagcatggtgaacttgatgaacagtctaacacacacgtagacaactcctcacttgccacacaaactgcaagagtcagctgatgccagacaggcacagccgaactgctacacaacatgaagccaaaaacctcttctagcgtcaagcaacattagccaagcctgcacaactggctcccaagcgcacttcagcacaccgacccatatgcacgcacaactcacgagataccttcgcacagatacaagcctcacagaacattcagccaacgcacctgccacagcgcagcaaacgtcccggtgcaacctaccctaacacacgggcctatcacgccagcaaacgcttgcctgtcgtatacggcaccacttgcttggtacaccagaggacgacctcccacactgggctgacgcgaacccacgggtaaaacccaacctaaccctttcacacacaaccctggacgctccactggcctccatcctccagccttacaccaatctagccctcactctcaagctggtgccgacactcacgcactccaggccaatgggacccctaaacttacacgctacccggccaccccggccgttactacacacaaaca

SEQ ID NO: 509290 - DNA, 278 bp, Homo sapiens
aatgcagcggactcggcaggtgcggggcggggccgtgaagactcctcctaccgagctcccaggcgctcggtgtttgcataaacaagagagctggagaggctgcctcaacagtgcgctggggcaaggggagggaacgtgacaggcaggtgtgggctagggacttctcttccggtcagagcaagggtcgtccgaaagcaaaaaaagcctctttcccttcatctcggcccgggatccaaatgtcttgggggctagggctgggggcgggaagtggcacggga

SEQ ID NO: 509291 - DNA, 204 bp, Homo sapiens
tcaaaaaatcataagttgaacatccatgaattcgggatcacatgtattcagtacatgcaatagagtaatctgactaaaaagtctaaccaactatttgcagacaccatacaagaagtaacaggagcttgttcaacataacccacagggcatgcaatccagcacaaacccttgcacatgtggcgaaattcccaaagcaaccaaata

SEQ ID NO: 509292 - DNA, 397 bp, Homo sapiens
  misc_feature (196)..(196): n is a, c, g, or t
tggtgtttgttgagggtggaggatacgaggatagagaatgggtaacttctagggagggtttagatgtagtacgactggggtgtatctgggatactttgtttagggatactccccaccatggttgggtgcctgttcagcaggaagagctttagggcagtaggaagggggagtggttccaggtgaaaaggaaagaagnttggtggcagggtggcaggagggatgggaggtcaggctgacgtccactggcgagaacacttcagatgaagatagtgtggacccctgcccagtcccaacacaggccccagacgccctgaaaccccaggggctcagcccaagcaagggcaggaagcattgctttactgagaaaccataaaaatgtagaattccacctcaaaaa

SEQ ID NO: 509293 - DNA, 388 bp, Homo sapiens
ggtcagagctatggtatggagccaacttgcaaatgtctcttccattagatgtagatcttagaagcataaggaaggcacataaagatgagtaagacccagtcctaaccctcaaagttaataaacaagtacgaagtaagacaaactgtagatacaacgatggaggcattacaactttataaaagtattatggaggactcaacaagaggaatacaccaatatgcagtcagacaaaggttgcttacttctcagacagttaacacagtagaactgtacatactcaaatacttaaactacattaattgcttttgcgctcaacaaatttggtgaattagtaataaagacgaagtcccattcatttcaaaatccaagcaaacttcaaactcattca

SEQ ID NO: 509294 - DNA, 821 bp, Homo sapiens
  misc_feature (60)..(60): n is a, c, g, or t
  misc_feature (102)..(102): n is a, c, g, or t
  misc_feature (149)..(149): n is a, c, g, or t
  misc_feature (320)..(320): n is a, c, g, or t
  misc_feature (665)..(665): n is a, c, g, or t
gagctggaactaatccccccatataccaagggacaaattgtatctgtttttacaattatncagtaggagacattatgttccatgacaatggtaatttttaangacagtttttaattgagtgaaattaccataaaaataataatagtagnagctaatatttactgagctgttactaggtgcctataaatagcatagatttttaaattctccataattcttccttatttcacttaaccactctatcttaaattactcatgcttgcctcagtagcacacatacttaagttggaacaatagagagattggcacggcctctgtgnaagaatgacatgcaaatttgtgaagcattccatatttttttaaaaaaagagaaaaaaattactcccagattttcactgtgtttgtgcatatgaccttttgtttaggttgaattatatccaaaggtgaaatttccagaagtgagattactgtgagtcacagggcatgagcattcttattaccctcgatgtaaattgcaaagctttcaggcatggtggctgtcagcctgtaattccagcactttgggaggctgaagtgggaggattgcttgaggccaggagttggaggaggcagtataatgagtcactgtctgtatgatttaaaaaaaatttccaagctttatgctngaaggcttatatacattttaaacaccactaatactacaagtattttctgtgtgataaatgaaagacctcctattagctgggattgcaggcatatgccaccatgcctggtaatttttgcatttttagtggagacatggtgacactttgtctctacta

SEQ ID NO: 509295 - DNA, 875 bp, Homo sapiens
  misc_feature (60)..(60): n is a, c, g, or t
  misc_feature (102)..(102): n is a, c, g, or t
  misc_feature (149)..(149): n is a, c, g, or t
  misc_feature (320)..(320): n is a, c, g, or t
  misc_feature (665)..(665): n is a, c, g, or t
  misc_feature (842)..(842): n is a, c, g, or t
gagctggaactaatccccccatataccaagggacaaattgtatctgtttttacaattatncagtaggagacattatgttccatgacaatggtaatttttaangacagtttttaattgagtgaaattaccataaaaataataatagtagnagctaatatttactgagctgttactaggtgcctataaatagcatagatttttaaattctccataattcttccttatttcacttaaccactctatcttaaattactcatgcttgcctcagtagcacacatacttaagttggaacaatagagagattggcacggcctctgtgnaagaatgacatgcaaatttgtgaagcattccatatttttttaaaaaaagagaaaaaaattactcccagattttcactgtgtttgtgcatatgaccttttgtttaggttgaattatatccaaaggtgaaatttccagaagtgagattactgtgagtcacagggcatgagcattcttattaccctcgatgtaaattgcaaagctttcaggcatggtggctgtcagcctgtaattccagcactttgggaggctgaagtgggaggattgcttgaggccaggagttggaggaggcagtataatgagtcactgtctgtatgatttaaaaaaaatttccaagctttatgctngaaggcttatatacattttaaacaccactaatactacaagaaaatggccatttcactgcacctttgcccacacaggtattaaaatttaacaagttattttctgtgtgataaatgaaagacctcatattattactttgtcacccattcttttttcttttttgagacgcagctcacctnccggcctgggcaacaacagcaaaactccgtctc

SEQ ID NO: 509296 - DNA, 918 bp, Homo sapiens
  misc_feature (324)..(324): n is a, c, g, or t
  misc_feature (493)..(494): n is a, c, g, or t
  misc_feature (662)..(662): n is a, c, g, or t
  misc_feature (815)..(815): n is a, c, g, or t
catagcttcctgaatgtgacgcagtatgtggtaagcccaagaatccggcaaacccagtgcatcgtatcctgggtgaacagctggatgccacaagggtttccctgcgggtaagatggtgtcccagcataattctcaccagaggtgccgcgctgatcactgaatcattggactgcggaccacgggtaagatatctcttcctgtaaccatccagaaaagtgcaacaggaaagacattgcccctactttaacactctatgtggggaaaaagcagcttgtagagattgagaaggttgtttctacaccctaatactcccaggtagatatngggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtgnntgaccaagaccaatgcataaggcattatgaaggcagcacagtccccgaaaaagaagacaccgaagagccctgtaggggtgcagcccatactgaattgaacacaccttcttgtgctggcattgtctaagtaccaagaagacacctgctatggcgatgcgggacagtgcntttgccgttcaagacctggaggaggacacctggtatgcgactgggatcttaagcttgataagagctgtgctgtggctgagtatggtgtgtatgtgaaggtgattccatccaggactgggttcagaagaccatagctgagaactaatgcaaggntggcggaagcccttgcctgaaagcaagatttcagctggaagagggcaagtggacgggagtggacaggagtggatgcgataagatgtggttgaaagctgatggg

SEQ ID NO: 509297 - DNA, 327 bp, Homo sapiens
ctagtaccgaatttagtgcacgagcgagtactcactagaacgaccctcagtacctatgccagttttatgccatcccatctattagcctcagccacgtcaagtcgtaagcccaattcttcgccaattagagagcccccttcacctttttaaattcctttaattaccacatattaaccacaaggaaaggtatccccctttttccagtacaaaggacacccgcaggatcttgaacggagtgggtaagacgtgaagactccaacacgacgagattaggagtacgaccacccgacgttcgtagagactaaattctcacgagacgagcaaaaa

SEQ ID NO: 509298 - DNA, 418 bp, Homo sapiens
  misc_feature (8)..(8): n is a, c, g, or t
  misc_feature (92)..(92): n is a, c, g, or t
  misc_feature (187)..(187): n is a, c, g, or t
  misc_feature (239)..(239): n is a, c, g, or t
ccaaagcntggagtatgccaagaatacgggcctccctccgaagggctcagtcatgttcataggtccctggtcccgcatggagagcataatgncaaaatcgtgtaagaagttaaaactgctttggaaacttgagacatgacccagaagcatcagtgtgcattacgcagcccaggtccaggaccacatntggccactgtgcagaactctgggtgccgcacgggaactcatgggtgtgttantcaaccccacccaccgctgagccccaactgtaaacctgcccacttcccacagcggcgctcctggatcatgcaggcactgggctctgaagatgtccttgaagaagtggcgtccgtgaaccccaaaccctcctagggtggttgagttccaaccatgctccctataaatgtcatgtggctta

SEQ ID NO: 509299 - DNA, 951 bp, Homo sapiens
  misc_feature (936)..(936): n is a, c, g, or t
acaaactgattaaaacgcgacagattaaaatgcaacagacctgaagcaatgcactcggtgcccatgggattcacggatcttcccataggtcctaccagccagaagcagcatgcctgattgatagaacagtggaatggcccaatgaaggttatgcaactgagcctgttgagatctcatgacatgtgaggatggagtgctcttttacaaagtactgtgtctattatgaagcacattcaataggagctgattcttgtatggccagaatacttgggtttgggaaccaagggataagagtgggactggcttcatttactattgcacgtagtatccacacccaataaagttctgcttcttaccactgcaactttgagctctggaagtttagagaccttagttcccaagggaagaatgtctctaccagggaatacgatggtttattgcatggagagttgagactgccacctggacatttggagttcattacaccactaagccaataggcaaaggggaaggttagtgtcctggctgagaagactgacccctaatatcaaagaacagagatttgctccacacatggggacaaggaggaatatgtctgaaatccattacatcctttgaagatgctctttctatttcattgtccaaagggagaaatcagtggaaaactatagcaacgccatacaggaaaaaccatcaagcgctcagaaatgaatggtcaccccaacaaataaagaacaacgatcagctgaggttcaaattggaagaaggccaactgtggcctcaggatcagttgcagacttgagaacaattgcagcggcctggattttcatgatgttttatgtatttgtatataccaatttctgttttttccttcttttccccaagtgttcacattggttacatttattactgatctttaggatataagattgtggnggcatggaggtgtac

SEQ ID NO: 509300 - DNA, 300 bp, Homo sapiens
agggacaactagtaagccactgtaacttcttttacttcaagagaaatatcaagcaaggatctagtatatgtatatcttggcaggagtaaaatggtgcatccttctttcatattataaattactcgatggctgtacttaacctatacattaaaccaaaattcattatttttgtttatgaaaagtaaactctttgggagttccacaatattgataatgggtttttctgaagctatggcatttagttatcatgctcctaactgtttaaattcctgctttaaaactcaaatgtaggcaccgggg

SEQ ID NO: 509301 - DNA, 1175 bp, Homo sapiens
  misc_feature (12)..(12): n is a, c, g, or t
  misc_feature (14)..(14): n is a, c, g, or t
  misc_feature (314)..(314): n is a, c, g, or t
  misc_feature (1175)..(1175): n is a, c, g, or t
tcgagagagctncntctgaggaggagggcggccccggggcaagaggttcttctttaggggggggaatccagtcttggggacggccacccactctttttgatggcgctgctgcgaatagggaacacgtccgtggtgaaaccatggatgtgttgacatgttgcacagaattgcgactggggggacagaagggctgacttgaacacaaggtagggacgctggagtagtgactgcatgggaagcaaggcagtgtcgccttgggatttgttcggcaagaatgcaagaaagcacgcctgctcggccttgtcgggactganaatgaatgtaaaggcacgctggggtaccagctgtcagcagcatgggcacaagctgggcccttcacagaagactgtctatttgcgcctgaatgtggcggagcgctgcacacatgtgacatgacagatggaactatgttgtgtcagtgacgacgatgtaagacagcagaggggaaagcaagctagggcaggaaatgcaggcagtgtcgcgtcctgccctgaatgaagagttgtcccacaaagggatcgatataagggaatgctgcgccgcacagagtgtccgcccatgagtaaggtatgttggatgcagcgagcatcgaggcacgactgtaggcgaaatgtggagaaatgaagaatgctaacttctgcatgtgtggcagagcggggagaaaggaaaagcgtagaatacgcagcatgaggctttgtggattggttgggattgtggtgcatcacggcttggacctggaatcagatcgaagtgggttgtgttcagtgcccccaggcggtacaagaaaaaatggccctcgggtggagctgcaacgaaggaaaagtaatgaaaagacgaattatcctttcaatggaggcgtcacatagccgtgatcgctgcgctggggtatactcggagtatttctggctttttacaggccctaccgcgaagacagaacattaacagacgcttcaaacgcaggcaccgacacgcatcgctccaggctggcagagggtgcaatatgctccggttaccaaactttgttaattgttatatgtccgcagcgccgaagcgagcaatccagacccaatgggttcctgtcatgccagttagtctcaggcgcgaggttaataatataacgcgttctagagagctgn

SEQ ID NO: 509302 - DNA, 943 bp, Homo sapiens
  misc_feature (389)..(389): n is a, c, g, or t
ccgggcgtggtggcaggcgcctgtaattccaggaggctgaggcacaagaatcgcttgaacccgggcagcagaggttgcagtgacctgaggtcacaccattgcactcctgcctgggcaacagaatgagactctgtctcaaaaaaaaaaaaaaaaaaaaaaattatttctaataagctcaatattaaatattttaacaaggtgggggtggggtaacagtatatcttgggcccagggctgggcaaatcctggtttggggcagcattttccataaactctgggccaaggtggtcaccggatggtgggcaacgtttaacagtctggctatgggttctggagtccttaaatctataagatggtattttaaaaatatataacatataaatttgggntccggtaaatacgcctcctttaaaaaacaaaaaacaaaaaccctctggagggccacccactagtgccgggggcgcgggaaaacggagcgttactggaacgggcgccggggcgtcattacgctggctttccgggacccagttctcttggtcccaagcggcgaaacctgcgccggcgcccccaaataagggggaggccgaataaaattcgagaaaacgccagggtaccgggattaggaggccgccgcaaaatcgccgaccaacaaccggcacgagcgccaggggacgtaccggggggggttaccaactcttgggaacacacagagggcgggcgcgaaacccgcctacgcaacgtgggccacacgacgcacggaccgcgcaaccgaagcagagaccaccacagcaccacagagacaacaacagacgcacgaccggaacggcgcagcaacagtgcgcgaagaagggagcaacgaacggcagacaagcaaaaaagcacagagcacacgcgcatcaaaaggcacgagcaaccgcgacgactgcagccgggcacgcagagg

SEQ ID NO: 509303 - DNA, 707 bp, Homo sapiens
  misc_feature (23)..(23): n is a, c, g, or t
  misc_feature (31)..(31): n is a, c, g, or t
  misc_feature (35)..(35): n is a, c, g, or t
  misc_feature (102)..(102): n is a, c, g, or t
  misc_feature (110)..(110): n is a, c, g, or t
ttttaaatcgtacaggtctttgnactccaantaancctacccatccattagcaagtgtacagagatatcgtcctggcaattgtgcatctttctcctttgacntagcagtnttgcatggcagattgtgccaagatgaggcctgtccagggacccatgcaataaaaggttagattcttttaaagctttttgataattattattatttccagaaagatatttttgtttgccccatttaaaaaaggttaaattgagtcactgtcttcattttcatgagtaccttgtagaaaactattaataatgataaataactaaacttctctagattaccttaatttttttgttgttgttctcagtacatctaagagagtagcatataggccatgtgtatgtggtgataaatgaaaatgcaggggtcttacttggttatttaggacttaagattttatctagtcattttcaactgtgattgaacacttccctttaactcccttcagaaactccaagatcatattgtatcccaggtactagaatttctgttcagctgtttataggcctccaccacaagaaattggctccaaacctattcccattacatcatcacccactaatgtcattacaccagaatgaaatctgctttgaggcttgtattgttgttttccttccatttctttcccctcatcatttcctttagaaggaaaagggaagga

SEQ ID NO: 509304 - DNA, 128 bp, Homo sapiens
tgtgtcgtgtgtggtgtttgtggtgggtgtggtgcatttgtggtgtgtgtggtgtgtgtgtgtaggcgtatgagtggaggtgtggtgttggtgtcgggaggtgttggtgtcgggaggtgggggtgtcg

SEQ ID NO: 509305 - DNA, 957 bp, Homo sapiens
  misc_feature (4)..(4): n is a, c, g, or t
actnttatcgacaagaaaaagacggaccgcgaccgggcgaaggcaacaggaaacacacaagtttgcgttgctcggacagttaactgcacgacgtccacaacatggagaaatctcttggggagacgtactatattgcaagtagtagagtgtccgcacagtgttgtgtacttcgaaacctaggagtgaacatccagggcctctgtccatcatatgtgggcgcgtggtacccaccaagacccggggatgtacccagcgaccaggggacgcaacatgccggtacccggccaatatcgcccctgggcgcccaagtgttcacgcgacgcagcgcaactaggatttgttcgccctataagcttgacaaaacagctttggctgtgttagccgggcccacccgcgtggtgcgcaatcatctcccccggtaaaggaagaaaccttccgcccgagtcctggccccacgtttccacatgaggcacatcaaatttttggcaagtgcgtctgacggattctcttgcaggtggcccgccccccgttggtggaaccaacacggggtggagacacgacacggcgagtctgcctgtcaacactgtaggcccaccacccgcggccccggcccatggggtcccccccgaaagcccctgcaactccctgggggcgagacacacacacagacgcaagccccccacgagatgggaggcaccaccagacccacgccccgaccacgaactgcggtgcggtaacccccgccctctggggttgacaaaagccgcaatttcaacccgggcgccgcgggcgacgcaaacaggcaggcaagacccgctgcacatcgtggtggagcgagtcggtcggaggcaaggcacccgtaagaccccgaaggcaggggggctcgtagggcagcccggcagccccgtgtccgagaccccggggccccaacaaggcaacccccttccacaaaagaca

SEQ ID NO: 509306 - DNA, 361 bp, Homo sapiens
acctgagcacagctggagacatcacactacctcacttcgacatttcaaggctacagtaaccaaaacagcatggtaactggtagaaaaacagacatatagaccaatggaacagaatagagagcccagaaatcacgccacatacctactatcatctgatcttctacaaagtcaacaaaaacaagcagtgggaaaaggactccctatttaatacatggtgctgggataactggctagccatatgcaaaagaccgacactgcaccccttccttacaccatatacaaaaatcaactcaacatggtgaaatctcatctctactaaacataaaaaaattagctggacgtgctggagggcacggaggct

SEQ ID NO: 509307 - DNA, 690 bp, Homo sapiens
ggcggggcgcggtggctcacgcctgtaatcccagctctcagggaggctaagaggcgggaggatagcttgagcccaggagttcgagacctgcctgggcaatatagcgagaccccgttcctccagaaaagggacacaaaaaaaaaaaaacacaaaggcacaaaaaaaacaaacaaaacaaacaaaaaaaacaaaacgtgtgtggggcgggcgcctggggacccgggagaaaaggttttaaaaccctattccggtggaggggggcaggggaggccccaatggatggtgacataggaaaccttgcgcacaataacgggtggacccagaagagagaacatcacggggccaacagcaaagaggggcgcgggcgtttctcacccaattaacaaaagcggcggcgcgggggagaacaaccgagagagtgtcttgtgcggaacaccacttccagagagtggaggcggtacgaggagagagcacaaacaacggagggggcacctcataaccagaaagggggcggtcccaaaggagaaagaggcggcaaaatacaaaagatagaggcccgaggcggcgggggggcagaagagataaagaacgaaacagccgacaaaaagatcgaacacacgaaaagagaagatcaaagacgaaaagaaaacacaagaaggagacaatagaacaaaagagacaaacgagtat

SEQ ID NO: 509308 - DNA, 1053 bp, Homo sapiens
  misc_feature (29)..(29): n is a, c, g, or t
  misc_feature (227)..(227): n is a, c, g, or t
  misc_feature (285)..(285): n is a, c, g, or t
  misc_feature (410)..(410): n is a, c, g, or t
  misc_feature (463)..(463): n is a, c, g, or t
  misc_feature (481)..(481): n is a, c, g, or t
  misc_feature (502)..(502): n is a, c, g, or t
  misc_feature (525)..(525): n is a, c, g, or t
  misc_feature (569)..(569): n is a, c, g, or t
  misc_feature (589)..(589): n is a, c, g, or t
  misc_feature (663)..(663): n is a, c, g, or t
  misc_feature (677)..(678): n is a, c, g, or t
  misc_feature (686)..(686): n is a, c, g, or t
  misc_feature (688)..(688): n is a, c, g, or t
  misc_feature (695)..(695): n is a, c, g, or t
  misc_feature (721)..(721): n is a, c, g, or t
  misc_feature (745)..(745): n is a, c, g, or t
  misc_feature (759)..(759): n is a, c, g, or t
  misc_feature (773)..(773): n is a, c, g, or t
  misc_feature (782)..(782): n is a, c, g, or t
  misc_feature (807)..(807): n is a, c, g, or t
  misc_feature (828)..(828): n is a, c, g, or t
  misc_feature (838)..(838): n is a, c, g, or t
  misc_feature (852)..(852): n is a, c, g, or t
  misc_feature (855)..(855): n is a, c, g, or t
  misc_feature (868)..(868): n is a, c, g, or t
  misc_feature (875)..(875): n is a, c, g, or t
  misc_feature (884)..(884): n is a, c, g, or t
  misc_feature (896)..(896): n is a, c, g, or t
  misc_feature (902)..(902): n is a, c, g, or t
  misc_feature (904)..(904): n is a, c, g, or t
  misc_feature (919)..(919): n is a, c, g, or t
  misc_feature (941)..(941): n is a, c, g, or t
  misc_feature (964)..(964): n is a, c, g, or t
  misc_feature (969)..(969): n is a, c, g, or t
  misc_feature (980)..(980): n is a, c, g, or t
  misc_feature (1019)..(1019): n is a, c, g, or t
actgggtcccgaggctaaggctccaaccntggctggggcggcagggagggatccagagagccctggccccagatgacccccagggcaggaggtccatgctctaagccctagggcaggggccgcagtagcaggacttggtcaaaagtgctggtgacagctgaggccggcccctcttccctgcacctcccctcctccctgcttcaccccagcaggcaattccctgaganaggctctggtcctcccaaccagctgggtacagtgttgggccccagttgggcaggtganttggggggacctacaggtttcagatgtgggggcgcaggtcccccttccagtgtgaaggcttcctgtgcagtgtagtgttcctgacccccaaagggggtggggtccctggggaaactgaggcagcngcagaggctgacccagctcctgtaccagtgtatgctgtgactcctcctaaggnagctggagctcggggggngtggcctggcccactcaaggncccgcttccggcacccacggggnctgggcacccatgtctttggtctgtgccctgcagttctgggggnccccctggaaggggtgtggnagggtggggagtcccagaagggggtctgaggtacgggaacaagggtccaggggtgctcggcgggggtgcaggcntgtggtgatggcanngtgagaangnccgtggnccagcgtgacacaaagcctccagggngtcaatgcggcgtgcgaagggggngagggtccgagggncggctgagagaggnccagggggnggtgaacgtgggggggcctgggggngcaggaggcagagcgtgtaangtccccgggnggggggtgagaaanatncctccgcgggggntcctccntcacgctcngggggggcatangcgtancngcgtggccacacggnagacccacgggtcagccaacanggggtcagagaggtggcgggggngggtngggcgctcttnagcgagaaacagaaaaaacggggaaggggggcggcgcgngtcgggcagggcgcgggctgtcgccgtggggggg

SEQ ID NO: 509309 - DNA, 623 bp, Homo sapiens
  misc_feature (475)..(475): n is a, c, g, or t
ggtaatatttattatattattcaggtttcaactctgtagcaaaaatgggctctcatttccctaccctatgttatctcaagttagggaaatgagagcccatttccctaacttgagataacatagggtaggtccatatattttcattcttacagtggtcttttcatgggagtgaatgagttactctccactggtgattaggtaatactgtagaatgaagagttgtataatatattcatttacagctgtggattgtggtaaggactatgtccacagtgatattccaaagaattgggtttatatttgtgcttcatctgttaatcccaggtgtcctcatgttgctgaaatatttagatagctaaaatatcccttaatttcacagatgaccaggaagaaattaaccaaggttttattgactgccatgtatgtcccatgatgcagtttctgaagccaacatggcttatttcctagagaatanactctgtatgacataaaattgcttaattgcagtctcttactaaataagtaactagtgccatgcttttgtgagctcttggtatggcccatattactttgtttgagtaatggttatcgttgtttggtgatagtcttgctctgtcgcccag

SEQ ID NO: 509310 - DNA, 837 bp, Homo sapiens
tcctcaggtgcttgcaaggtgatcagaaggcaaaaatgtcggagcgaaaagttttaaacaaatatctacccgccggatttgtgacccattcaaagatccccaaattcaagctccccaaagaccggcagtacgttggtgcggcttgatgtggccccctttcaacattgagggtgtaagacgttgcggagaaatacttctacagggggacagaaatttcaagtgctcggaaggagacgggtgcaaaaggaggtcataccgtgggccgtgcccattctttccgcttttacattcaagtgtgcacgcgcgtgcctgtggcagagattcacctttcaagacagacccttgaaaaccacagattacaccatgtggagcattggagcccacgcggaattcccaggctgaaaagctccgggaggaggaggacaaagagggtcgcaaaaggagcgggaggacgcaggaagtgacagaacccatgaaggtgctaggagaaccggaccagggactccaagctggaacatggaggtgctggaaaaacctcacagggagctgaaagacctgaaccaggggaaggcgcacgtggaccttcgagggctaatgcctgaggacggcaaccggcgtgtcggaggaaggaccgagggaggcaagcaagcgcggaaggaaggaagacgcaggaacacgcgggggacgcctgatagagagagaaaggccaggaaaacggagcaggacgggggggacaggagaccccgaactcaaaaggactggagggtggacaccctcggccctggggccagacgccttcgggcacaaccccaaggagaactcgggatgaggggccct

SEQ ID NO: 509311 - DNA, 327 bp, Homo sapiens
gatggcgtctgtgccgcgttcctcccagagttcctgaccagctgtgatggtgtggatgccaaccagaaaagtgtgctggggcggaatttcaagatggatcgggacctgcgcctcattcacccagaatgtgcacaggctggtcgacgacctgcgctactacagagtctgcaacgacagcctgccccctggcactgtgagctctagcctgctatgcctggggacacggacttcgctgctgcaccgtcgcaggctacctgccacggcagatgtctcccagatgggccttggtcacactcgttgggttctcccaccgcaagcaacgctgcc

SEQ ID NO: 509312 - DNA, 191 bp, Homo sapiens
acttttcacaggggggaaactgcacgtttaaagagaaaatatcacgggccgctttccacaatgcagctgctgtagtcatctacaataataaatccaaagaggagccagttaccatgactcatccaggcactggagatattattgctgtcatgataacagaattgaggggtaaggatattttgagttatctg

SEQ ID NO: 509313 - DNA, 193 bp, Homo sapiens
gaaggtggttggatatcccctgaggcattttattactgacatcatattttacggatataaaagtcatccattcacttgatatttgtggcgcccttacccacataaatatatggcaaataacaatgcagcctcttatttcaaggggttgataagatgcaagaagctaaaattggggacagggattgcatgatag

SEQ ID NO: 509314 - DNA, 306 bp, Homo sapiens
caagctgctcacatatatagaaacagaatccaagtcgtatacccctttatctttattatcctacgaccaacaatacaacttgcaaagcactatcacaataaatttatcaagcagaaatcactatcttctaatttacagaggaaaaagctgaggcactaagaagttgattgatctgcccaattcacatgggtctctaaaagcagggccgggactcacaaccagggcccctgacctcacatgccctgtttgttcatattttttttcttcacttgcttatgccccctctgaatttgtgagcagcgttgg

SEQ ID NO: 509315 - DNA, 261 bp, Homo sapiens
acctcctgcggactcgcattaattgacagctgacccaggtgctacacagaagtggattcagtgaatctaggaagacagcagcagaccggattccaggaaccagtgtttgctgaagctacggacctgacggacgcaacgcgacgcaagcagacagttcgtggtgaacgactacgacaacgacgtccacggcgccacgtgcgactttggtgccggaacgctaggactgtcggaggggacgggggactcctctacgacgtcgac

SEQ ID NO: 509316 - DNA, 217 bp, Homo sapiens
tgtgcgaggtcgatctagaggtcccagcggggaacaatcactgggaattcactctattttaataggttggtaaattccaaggtgatgcttacttaaatttcttttggctttaattggccagatgtatatacaaatgaaaactttggagagaagagccttcagggaagagacggttttatgagctctcttaactatgacttaagtgatggttcccgct

SEQ ID NO: 509317 - DNA, 887 bp, Homo sapiens
  misc_feature (198)..(198): n is a, c, g, or t
ggcggcccggaaaggtcagcgtgtgaagtaggcgctggcaaacgcggggttacccgctgtatcgaggagtaacggcccagcgaccaccccaggcttgaggagcgggggaaaccaactcggttggctgggatacccatggaaggagcgcgggcgaagcggcaaacaaaaagaccacaggggggaatgggcgacttatcnggagccgtggaccaggtttactcgcacggcggattgtggtgggcgtcccgatataactgttatgaaacccttcgtgttctccctatatctaaaaattgtggatccacggaataccttcgtgccggactacacggatggcagttaatttaacccataccgggagcttaaataaaacccggggcagaatttcgagccgtgcccttcttttacgatttgacgcatgtcgtgcatgaacagcggcgctggcgttggggtgcactggacttggctctccgcctagggattgaacgggacaacccagaacatggcttgtctcaaaccagtgaccttgtccagcatttgggaatatgggtgcttaggcaagggcacttttggctatactctaggggtctcgggtaagcatccatagtgcctgggtgtcctcattgacacaacacgaggtggcaaagatgacctttacaacagtagcagttgaaccatacagcatgtggactcattggaccgcggctccaggacaagcgaggtggctggacggacaaacactaccagcttttaggcatataatacgggacactgtaaggttcctgccaacgcctctacatgcgccctatgggacctcgggccacagcctaaaaaaggggtctccttccacaagtggacggcgtttcgggaccgtgcccggtccctgg

SEQ ID NO: 509318 - DNA, 377 bp, Homo sapiens
gtgagacctcgtccccaggtgcgggatccaataaagctcgacgggcaccgcctgtactccacgactccaggcctccacgatctgtgagactgtgaatgtgcacacacctctgggcacccacgtgtaatactttattttggcagcctgagctgacacatactctggatagcatccttcatctttctcactagcgtctccatacgcaagtcacatatgaccaagggacacgctgacaatggcttcttctcgatgagactattccgtctagaggcatttgccctaagaagccatgatgtcaaagcacacagactcaaatggtcactcggaggccgcaattctacttctgggatccctggcttgtcttggctgagcctttc

SEQ ID NO: 509319 - DNA, 156 bp, Homo sapiens
ggtgctggagctgttatcatagctagtgaagatgctgttaagaaaacataaacttcacaccacttggcaagaatttgttgggctaacttttgtattcttggattgttatcccctctatcattgggtatttgttccgtgttccttctattcaagttg

SEQ ID NO: 509320 - DNA, 404 bp, Homo sapiens
  misc_feature (92)..(92): n is a, c, g, or t
attaacataatgttctccaggttcctccatgttattgcaaatgataggatttctttccttgtaaaaaataacatgccgacattttcttaccnaatccgtccaccaatagacacttaggtcgttttcatagtttggcagttgtggaaatgctgcagtaaacatgggagtatagctatcttttgaagataatgatttcatctcttttttatatgtatacccagaagtgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggt

SEQ ID NO: 509321 - DNA, 130 bp, Homo sapiens
atcgccaaccccggagagtctcaagcttgaagccggagatcagaagcctgatgccaagtagctccaggtgacgtccgctgggaaatatgatttctgtctctatcacaatatattttaacgtgactttccg

SEQ ID NO: 509322 - DNA, 355 bp, Homo sapiens
aaccgtatctcgtcatcatacaaatctagtaatcggcatgagagtcaggaaacgaactcttttaccgatgcgagagaagcgtatactaagctctatagctgtgctcgaatacggtgtctcgcgcctgtcttcccactgcttggggaggccgaggagggtggatcacctgaggtcaggagttcgagaccagcctggccaacgtggtgaaacactgtctctactaaaaatgtaaaaattgaaccggatagcttgcccgtctccactaaaaatacaaaacttagccaggtgtggtggcagacgcgtgtaatcccagctgcttggaaggctgaggcacaagaatcgatggaaccggata

SEQ ID NO: 509323 - DNA, 317 bp, Homo sapiens
gtgtatgcacaactagggtcagttttgcaggtggtaagccatttaccaagatagttgtaggtaaagaagggcagatttatttgagaaattgtgaaaatatgttgcagagggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 509324 - DNA, 935 bp, Homo sapiens
tttcccctcgctgcgcgccggcccctttcgcgtccgcaaccagaagcccagtgcggcgccaggagccggaccgcgcccgcaccgttcccgggaccgcgacccggcgcccagagatgaccgcgaccgaagtccctcctgcgcgtctcttgctcctgtctggcgtttcagtggccacgagctacctatggggtctgaatgcttcccgtgcctgcgaacccccaagaatgtgattctgcgaggatgacaatgtttgcaggtgccagcctggctggctgggtcccctttgtgaccagtgcgtgacctctcccggctgccttcacggactctgtggagaacccgggcagtgcatttgcacccgaccggctgggactggggagctctgtgatagagatgttcggtgcctgctcctcgtggccccctgtgccaacaacgggactgcgtgagcctggacgatggctctatgaatgctcctgtgcccccggggtactcgggagaggactgccagaaaaaggagggggcccttgtgtgatcgacggttcccccttgccaagcacggaggcccctgcgtggatgattgagggcccgggcctcccattgcttcctgctggtggcccccccctgggcttgctcaaggcaaattttcggggagatcgtggccaacaggtggaaccccaaacccatggcgagaaacgaagggggtctgcagtgggactcggagcgattccgctggcggttgcccagcagggttcaatcgaacaagaactggaggcgcccgggaacccatggcagaagccgtggcaaacggggcacctgctggcacacaccagggagctacgagtgttgggccgccgattcaggtctcaccggtcagaacccgctgaccccaaaggacccgctggccgggtaaggtgacacagaccggggacaagcggaaa

SEQ ID NO: 509325 - DNA, 789 bp, Homo sapiens
  misc_feature (595)..(595): n is a, c, g, or t
acccaaagcaatctatagattctatacaatctttatcaaaataccaatgacatccatcacagaaatagaaaaagaaatcctaaaatgtatatagaaccacaaaagacccaaactagccaaagccatcctaagcaaaaaacaatactggaggaatcacattacctgacttcaaattatactatagagctatagtaaccaaaagaacattctactggtataaaaacagacacgtagaccaatggaacacaacagagaacccagaaacaaatccacactcctacaatgaactcattttgacaaaggtgctaagaacatacactggggaaaagatagtaacttcaataaatggtgctgggaaaactggacacccacatacagaagaatgaaactatacctttatgtcttgccatatacaaaaatccaatccaaatggattaaagacttaaatctaagccctgaaattatgaaactactacaagaaagcatcagagaaactatctagggcattggtctgggcaaaagtttcttgagcaataccccacaagtacaggcaaccaaaggaaacaaaaggaccaaatgggatcacatcaagttnaaaaacctccttcacaccaacggaaaaaaatcaacaaagtgaggagacaacccacagatcaggagaaatatttgccacgtatccctctggacaaggattataccaggattttatggacccaacatctatgggaaagaatctaatttggttcaatggcaaagatctcatgacttctcaagatgtcatggcacggc

SEQ ID NO: 509326 - DNA, 1361 bp, Homo sapiens
tcagggggcataaacacaaactttatggaggccctcagcactagttctctataacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagacgaggggcggggccacaagataccctccaagggcgcgcccaaaagaaaagacaaacaaccaagtagtaaggaaaaaaagagggggcccaccaaagaggagggaaatttataaataaaacaaagagagcgaggggggacaaacaaaaaaagagagaagaagagaaaaacaaagcaaaaaagaaggaggctacaaaggaagaagagcacaacccctacaggggagggggggaagacaaaaaggcgggaaccacaacgccacccaaaaaaaacaacagcgcgcgaggagagaaaacaaacaacaacacacacggggagcgagaaaaagaggaagaaacaaacaaagaagaaacaacagagcaggcaacaagagaacaaaaacaaaacacgacagaaaaggagacagtagagagagaggaaaaaaaagaaaaaacagaggggaggcagaccccccaaaccaccgacagagaagaagagaaggaagagaaggagaagaggagaaaggagaaagagaagaggggaagagaagagagggagagaagagggaagaaagaaaggaagagagagaagaggaacacaaaaagagagaagagagaagagcaaagaggaaaagaggggggagagaaaaaagaaggagagaaaaaagaaaacaagacaaggacagagaacgggagaaaagaacaaccaggaggaagcgagagaaaagagacgaaacaaaggcagagagagaggaagcaagaaacgaagagaagacgagaagggcagaagacagcgagcacgaaacgacaagaacaaccagaacagagacagaaagagagcaaaaggagaagaagagacgaagaaggaagaacagagaagaggaaagccgagggacgcacaagcgagagagcggggacacgcaggagggaggcggaggaaaggagagacgacaaggacgagggacgggagagaagagcaaggaaggaggggagaagaggaaagaagaagagaagagagcaagagcaagacacgaaagagaaagagacagagaacgcacaaagccagaccagaaaagaagagacgaacaaagagacagaagagcaagaaaagaaagaggaggacaacaggagaagcgaggacgagcacggagagaagacgagaaggaagaggagtgaagcgcaagcgcggagggagagaggaagaagaaaggagagagaggggaagagagc

SEQ ID NO: 509327 - DNA, 146 bp, Homo sapiens
atccaccatcagatcataggccagttctgcaatgacaactgatgataagcacctttcacaacctcgggaacgttcattccccgcgtgaagcttctcaccagcatggccatctctggtggtgtgcttcttcttccgtggtgcactgg

SEQ ID NO: 509328 - DNA, 249 bp, Homo sapiens
cccgatagcccgacagttgccacgtcttgtaagcaagagtgagcgggattactgcctggctgccccttctttccagctctagctcatggcccatcgtccccagcttgatgtcgccctgtcgggctagtcgtggactgtcgggctagtcggggactgtcgggctagtcggggactgtcgggctacgtcggggactgtcgggctagtcggggactgtcgggctagtcggggactgtcgggctagtcgtggt

SEQ ID NO: 509329 - DNA, 290 bp, Homo sapiens
ggtggaggacatgatggtgttttgtttcctctagcttaggacttagatccatttggaagtgttgatcctctgacatgtttgaaaataatgctaaaatgggacttacattgatgcagtctagggtttcgtcggaggttggatgtgtttccatagctttaataatcctataattaatagtcaaatagtaaatgtctgtagggtgtccttctaggcccattagccctccaccaactgtacaaaacgctttagactccaaccacttgttcaaaccggtcctcccaccacaaacg

SEQ ID NO: 509330 - DNA, 340 bp, Homo sapiens
tgactctacaggatctgatctcccacttggttgcatggcggcgtctatggggcaggtgttgactctggtgctggatggcgctctgtggggtggcacgcagccgtgctgaagcgggctccgccggctgcagcgggttcatgagccgaccggggcccagcagttgctacaggagatgaagaccctccttcttgaatacctgagtaccctgatgccgctttctcgctcaaccaagtgtggatcccattctcgtatttacctcacctttggcatcgaccaggatctgacccctggcttgtgccccaatctgtaaactcttctgggctaatcaatcttcaacact

SEQ ID NO: 509331 - DNA, 852 bp, Homo sapiens
ttgggtcgggcggctgggaggaggccccgcgcgcagctgcttcgctctgcaccctgtagcacgaggccggactgcggctgcgccgcctgcaggacctgctctgctgcccgggacgccctcttcgatcgcctccgcgcgcgtctggccgcgctggagggggacgcctcgccgtccctagtggacgcgctgctggatcaggattgctgcgcttcctgtggatgcgagctgcgaagtgcatggatgggctggcgcctgtcgatggcccacgatgcgcacattgaaattgaggagtgcatgatcttgagcgaccgtagaacgaaaacagatgagggacgatgcatcatctgctgagccagtcccaaacacgaggcgagtacgaaggaacgtctgcctctctgcctacggggaagtgaggcatggcctgaagggtggtgcagtcgcgcccggtgccgaccagtgaccgtcctgtgccgctccttggccaacgagacccatcagctgcggagtgactgcttgactcggccaccgtaccacattgtgtcagccgtctggtcgcaagtgtcgtggactgaagcgacgagcagtgcactaaagggacatgtgaggaggagatgaagtcctgaccatttcggagagcacacaggactgggcacaacctctgttccatcagctgctagagtaggcgagacgttgcaggaggagaaatcggacatgttcaaaacatcaaggctgactccacggtttgaaggagctcaagtggcaaaggtggcagacgctaacaagcgcgccagcaggggacgaggtacgtgagggggctccatgccgcagtcaggggggctgaaggatccccca

SEQ ID NO: 509332 - DNA, 703 bp, Homo sapiens
cccgccaaggtgcaaactcttcctgcaccgctgtgggccgtgtggctcgggctggcctgaagtggcacatgcctactccttgtgtggcccctgatgaaatcccctacctgctggatcttgcacctgttcctgggccgctccctcaccctcgccctgacccctcaatggagccctcagtgtgtgtgcctggtgtggatgtgcatgcttggtgtctgtgtgtgccagcatgatgtgtgtgttggactgatggagtgacatgtgtgtcttgcatgagcaccctggatgtgcatcgctggatgctactgtgtggcctgtgcccgcgttgctgataactgcccatgcagcagtatgtgcgctcacgccctgtgcgccctcgcctgagtccatcaagagtgtgccaaggagatggaccttgttggggctgggcctgcaccccctcttcagctcgcgtttatgagtgatggagtgagctagcatgctgtgctgagtgcttggtaggacagcataaagaactaccgctcccgggcggacattttctcagagcgtcgttgggcctggaaagcggcagcggtcaggacccaacaggggatgccaagaaggctggagtggacggaggcccggcagcgggaacaggaattctacatcccctaccggccaaggacttagaaagcgaagcggggctgagcatccagcggggacaggg

SEQ ID NO: 509333 - DNA, 286 bp, Homo sapiens
gaaaatgggactattgagatcataaagaaatacacacctacatggcaaatgtatcaacgtgcgcaagcgatagcaggcgagaggagcaagaggactactacatatgcaagaatcacccctatctgcgatagagcctctttgcaaccggtgcacattacaatttggtattacctgagagtgaacagaaatataacagccatgcctaactgacttcttgaggtcagaatggcggcagtggagcatcgtcattcttcaggattgccctactggccctacctcacagctg

SEQ ID NO: 509334 - DNA, 974 bp, Homo sapiens
tcctggccccctcccctgggaaggttgggccttggcccccgccacagggtacccccacatcagtgtggcccacatcgggaggaaacgcccacatggggggccaccaccagtggcgtgtccacaaatgcggcgcccaatttctacccacgcacggggacacaacaacttgtgggtcaacacacacgtggtccgccaaggagcatgtgcaccccaaatgggtgggggccacaaaaagaagagacgctcttggggggtcatcaaaacagaaacacggggtgggcccccgtctctcgggtgcgcccctatgggagagtcgcaacacagcaacaggtgggtgccacaaaagataggttcacactctctttgaaaaagtgtgggtggggagacggacccacccccgagaggccctcgtttgagggccgccctggtggtcacagccacgtgcttccctgtgaatttattgagagccgctaatatgttctcgggtgggagagcacctgcccctcttggggacacacccctctatagacacagcccacattctaactctacgggcctctctcttttcggagagggcttccacagcgtccgaaaggggcttgtcctgcgcccctctgtcccctggagacttgaacatgttgtgggtaaatttcgttgttgttggaaggccactcacaacacttcacaccacgcccgcagagaagtctttgacacaggcttgttgaaaaacccacacctgggccacggtttgaaggggtctccacatcctggcccccaagagcccctgaagaaggcccacatggacacatcctgttgttttgtgaatgaaggaggaactcacagtgctggcacagaatggcacatggaaactgccctgggcaactgtgctggctgcctcctgaaggaaaccctcctggactgctttttttggctttcccgacaaatccggcccaataaacacttttctgaattga

SEQ ID NO: 509335 - DNA, 337 bp, Homo sapiens
tcactgcaacctccacctcccaggttcaagcaattctcctgcctcagcctctcgagtagctgggattataggcatgtgccaccaccccagctaattttgtatttttaatacagacaagttttctactagaaaaaataaaaataaaaaaattactgggtgtggtggcacccagtaatctcagtctgtaatcccagctactagggaggctgaggcatgagagtcactggagccagaagggcaaggctgcaatgagcctgggcaacagaacaagactctgtctcaaaaaaacaaggtattaatatccaggatatccaaagaactcaaacaactcaacagc

SEQ ID NO: 509336 - DNA, 341 bp, Homo sapiens
gcctcgtgagaattcaaagcgattcgtagagggtcaaaatgcccgtggacaaggctatgtgaacgagacagtcaagccagagccccgtaagaatcggccccccattgctatcgtgtcacctcagttccaggagatctctttgcaaaccacttctacagtcattgatggcatgccactgatgatgataaaatcgttcagtaccattgggaagatcttaaggagcctctaagagaagagatgatttctgaagatacagccatatcaaaactaagtaaactcgtccctgagaactacactttcagcgtgactgcagtagactctgatggagctaccaactctac

SEQ ID NO: 509337 - DNA, 495 bp, Homo sapiens
gtcgatctctagaggtatcccccacatctgcggggctttaaatcgcttgaaccccggaggcggaggttgcagtcagctgagattgtgccactgcactccagcctgggtgacagagcaagactgtctaaaaaaaaaaatttacctggggcaagaaaagtatgaagacatgctgcagagcaaagtggaggcagcgtgtggcccagtgcttagtactgtaatccccaaccttgttttcactaaccctgtttttagactctccctctttcctttaatcacctagccttggttccacctgaattgactctcccttagctaagagccagacagactccatctcggctctttcactggcagccccttcctcaaggatttaacttgtgcaagctgactcccagcacatccaagaatgcaattcattgataagatactgtggcgagcaatatccgcagttcccaagaatttgtcccattgataacgcccaacgacccgcgtcta

SEQ ID NO: 509338 - DNA, 757 bp, Homo sapiens
ggctaacaaactgaaaggggctaccaaggctgggaaaaaaagcaattgttgctgtgagttgactttgaaagactctggtcccttgtgggccccttctgagattccaaccgtgatgcacaagtgtctggccttagaatttacggggtcctaaaattcagagtttttaaaagagcttgcctcacagatgggttcacacaccgtgaaattggtgccctgcgagttgccatagctggaagttccatgctccagtcctaccttggctccccattaaacctttggtgctctgtggattgagttgaacgtgttgaggctttgccaatttcacttgtgttaaaggctctggccatttttccccattctatagccagaatttctttgaaaggccagaattgcttgcatatttcttctctgccgtcaccagaaagccgagtttctttccaaacttcactgaggcatcagttgctctttggccatgtcccttaacccatgattattaactaagtttgtggcttgagtttcaccaaattctacttgttgccattgatgttccccatgtagtaagtcccatttttagtttggttgtgaaaaaaccctgggctgaagttggccatttcagttaaaaggaaaaaaggaactagtccccgatttgaaacttgtaataaattgaaactcactggttttctatgtctttttgaactcttgtaatcgagttttgatcatattttctattaaagtggctaacccctggctactctta

SEQ ID NO: 509339 - DNA, 183 bp, Homo sapiens
ttctggctccttccttcctcagaacatctctattctgcaagagccctctgccatgccagggcacgcccacttccagctggagtcgtggggcttgggcacaggggaatttttccagcagcctgcagcctgacggtctgctctgcaagaatgcttagaaggttcccagcacacccagcagcccag

SEQ ID NO: 509340 - DNA, 198 bp, Homo sapiens
tcgcttatgttattcccccagatgccgcatgagtacaggccacctttccttactggagaatattcgtgaatttgatttagaaagtcagtgaccatgcgtgaagcagtttgagacccagagaggctggcgttacaggcttcttgtattacaaggaaacactgacttgagatagatgcaacaagagacaaacgggaaacg

SEQ ID NO: 509341 - DNA, 168 bp, Homo sapiens
ctccattattttcctcgttagtcttggctttatcattggcataatcgaccaaagacgaatattttcgtcctttttgattcgctgattttgccgttacaaattgggctggtaagttaaccatagctgtttgctttcattgagtccaaaggctgcttttttacccagttt

SEQ ID NO: 509342 - DNA, 125 bp, Homo sapiens
atatcatgggctaggtgagggaggtaggtggtagttgtgtttaatatttttagttgggtgatgaggaatagggtaaggagtatgggggtaagttatggtgggccatccctgaagattgttggtgg

SEQ ID NO: 509343 - DNA, 199 bp, Homo sapiens
  misc_feature (137)..(139): n is a, c, g, or t
ttgagtgagtcttggaaggtgtgtgttatattagtaggaacttctgtatgattgtatgctggatgagtctgactgatcgtgatggtcatatctctgatagagcttttgaatgtaggaagatatactcataagctatnnntaggacaacagagcttgtagtcgagtgtcatgaagatcgtagcaatctgcttctgttcat

SEQ ID NO: 509344 - DNA, 282 bp, Homo sapiens
cagatgtctttctccaaaacatacacaattgttattttagtaaataccttttttttttttggggggggagtctggtgctgtctccccggtgggagcgcagggcacgatcggggtcagtgagcctccatcctcggggttcaagcaatttcctgtctcaggctctgagtagtgggattacggcgtgacaccaggccagtgattggtatcggccatggcttggtttggacacggagcctgggcgaagagcaagattccgtctcaaaaaaaacacagggttgggcc

SEQ ID NO: 509345 - DNA, 168 bp, Homo sapiens
  misc_feature (158)..(158): n is a, c, g, or t
gtcagggtgtgagagtcagcagtattaactacattcatgttaatgatgcgaccatcaccaacattcatttccagaacactctgtccccagtaaacaacatgtccccgttcctcccagccactggtacctaccattctactttctgtttgtataaactngacattctta

SEQ ID NO: 509346 - DNA, 238 bp, Homo sapiens
  misc_feature (185)..(186): n is a, c, g, or t
gctatggaccaggcaggacagctgagcaggccagctgtggggagaggaggatgggggtcgagcggaccagcatgggtcaccattacctgcttactggacagatggacaagtggaaaaatagacacatggacaagcagactgcaaggagaaatggagcagtgacgcagtgggtccctttcttttanncttcacaacatggaaattgtcacatgacacccatcaacaatggcgagggggt

SEQ ID NO: 509347 - DNA, 176 bp, Homo sapiens
actgtctactgctggagggcttgcaggctggtctcaagaaccagcccgagggaggctggcaggtggccagggatagaggcagggatgggctgagcagggacgcagcccccacctgcctgcaggcttccagacacaacagcccaggccccatctgagccctgtcgggctagtcgggg

SEQ ID NO: 509348 - DNA, 202 bp, Homo sapiens
cggcttgagaatactggagaacttgctttgtacagatcagctgctgaaggactcagacatacagagaatgaagaggacaagtcagctcctcagctttcgccagcgaatgttggggaacctgcttcgggctccatatgaaagggcagagctccccacatgtctctatttaattggacttggtgtgatcattggactctgagaa

SEQ ID NO: 509349 - DNA, 395 bp, Homo sapiens
catcagcaattttaaactatgcatgtagcctttcagtagagtcatataggatcattggaaattcgatgtcactgagctatcactggagatagctataacttactggtgaatttacctttttaatctttcttttcttctgaatgcagtgttaggcactggattttcccttatgtgctttacagaatcatttttcaaaatacccacataggctgcttttttggttgtttaatttcttaagattcagttggattacctacagaagaagaaaaaagttggaatctgggtgatataaaatttaacaccttatcatataaagattttcacacgtgctaaattttattttatttatttttttaactttctttttcttttattatactttaagttttagggta

SEQ ID NO: 509350 - DNA, 1324 bp, Homo sapiens
ggggggctcgtgggctgtggggcgctggactgtgccggactgacccaccctccttgcataaaacgcctggagcccgcggtggccgagcagctctcagcccgtcggttcccgagctgccttcccggtgacccctgcagtggcgtgttgtgatgtgggagtgactggacagagccagacgccgaccggaccagtgaggactgctgcacgagtgcaccatgcgtgagatcgtgcacatccagtgcggggccacgtgctggcaaccagatcggctgccaagtttttgggcaggtcatcagtgatgagcatgggattgacccccacatggcagttaccactggcagacagtgacttatgcacgcgtggaagagaatccaactcgtttacataccacatgcaagccacttggtatcaacgcacactatgattccggtcggggccgatccatcgctgggagtcttggcacgccacgtgtcagcggacgtggacttcgagcataagcgatccttggaccccactatctggacccaggagtcatatcagacacgcaggaccacacttatcgacatgttacgtgggcgccacaaaggctgggactgccgtgggacactaaccatagggggccaaagagagcccagcataagcaacacgcgacggggcgaaggaccccgcgaggccttggggcttaggcaccgtccgttgactacgcttgtaaattgctagggatgcaggggccaagcgacgcgcatcacgcacatatgccgtgctgtcacctctgacaatcacacggacgcaccaataccacagagcaaccgaggctctgaatacgtacatacgtgcgagagggacagcacaacctcgcagaggggacccagagcgcgcaaactgggccgggcacacccgaagagcggcaggacaagcagccggaacggcaagcaggaacggacccagggaggaggagccacacgcgcccctcgcgagagacaccatcgacctcgaccagtccatgacacgcgtaggtcgcacgacgaggccgagcccaaaaacaagccccgaaaccgagacggacaaacgggggaagagggtcacccagcgaacgagacaacaggaccgggaacgtcggagaccagcgagaccacaacgcagaacacgcgcgccagacccacactaaacacgcccgcggggacaccggccacacagagatgagcacgaggagacacacacccagaggggaaggtccagaacccactagccactggcagccgatgacggacagggcaacctgaagcagcgcggacccacgaagcaaactcacacacacaccgag

SEQ ID NO: 509351 - DNA, 149 bp, Homo sapiens
  misc_feature (65)..(65): n is a, c, g, or t
gccgtggataccggcgtccacaattaccggcgttgccgcgttcttctaacgcttctttacaagantgcaaagaggccaaggcagggtaagcaccaacctagaacccttcttcacccacccagcagagcagtgtctttgtatcaccaggc

SEQ ID NO: 509352 - DNA, 408 bp, Homo sapiens
  misc_feature (5)..(5): n is a, c, g, or t
  misc_feature (27)..(27): n is a, c, g, or t
  misc_feature (69)..(69): n is a, c, g, or t
  misc_feature (97)..(97): n is a, c, g, or t
  misc_feature (116)..(116): n is a, c, g, or t
  misc_feature (170)..(170): n is a, c, g, or t
  misc_feature (179)..(179): n is a, c, g, or t
  misc_feature (224)..(224): n is a, c, g, or t
  misc_feature (388)..(388): n is a, c, g, or t
  misc_feature (402)..(402): n is a, c, g, or t
ttcgnccttacactcaaaactaatttnacctgtgagacctagttcgggagcaaatatccccatttatantccttataatttgcctgttttaattttntcttttgaaaataatctgnccccataaataagtataaagtaaaattagttaaggcccaggcacggcgtctcanacctgtaanccctggcactttcggaggccgaggcaggcagatcatgagtcaggnaattgagaccatcctcgccaacatggtgaaaccccgtctctactaaaaatataaaaattagccaggcatgctggcacacgcctgtagtcccagctactcgggaggctgaggcaggagaatcgcttgaacccggaaggcagaggttgcagtgagctgagattgcnccactgcactccancctggt

SEQ ID NO: 509353 - DNA, 636 bp, Homo sapiens
ggccattctcctactcaggaggctgaggcaagagaatcgcttgaacctgggaggtagaagttgcagtgagccaaaatcacgccactgcactccagcctgggcaacagagtgagactccgtctcaaaaaaaaaaaaaaaacacgggttgtctaggccaaggataattattttgggaggcaggggggataagttctttgggtaaaccccaagtggtctgggggaatggataccaagctggggaaatcggagttttgggactggaaacatgggagccttcacgggcgttttttccggggtccctatgaagattggggaactatagaaaacacaaaattcacctttaaactttggaggcagggtcgttggatgggcacaaattaattttcacgggaacaaggggaatatcctaagtgggtaggtaattcctaaaaggttacaagggagcgtggttcgcccattaatatgggctaaagtttcctaagcggcggtcaaacgctacgttaccttggtctccacaggtacggtcgggagggcgtgtgtgccctagttgctacacagccatcgtgacatttcggatgcctaacacgcacgtggccccgggccattggtcatcccaactggcctggccctttatgg

SEQ ID NO: 509354 - DNA, 356 bp, Homo sapiens
agctatctcagcagcttagggtgcaggctcggaagcagtcctggacaggacatccactgcagaaagcaatcacacttacacacacagcttcacacagaagtaaagatcacgtacactgctgcgggatgtgggaggaaatcaagagtacccagagaacacccatgcaggtatagggagaacgtgtaaattccacagacagttcttcttctcaacattatcttgacacaacattattcaaggacctgctgtaatctgtatatacatggactttctggctgaaacataaaagagagcaacttattctcaagaaactatatctatggtaacaattctcaatgcttaaaagttttacgtta

SEQ ID NO: 509355 - DNA, 162 bp, Homo sapiens
caacaccttatataggcgagtcccaacattccctaaacaaacaatgaccaatgagggtacaaatataaacaatacgaggtctactcagtgctcacaaatcccaattgcattcttgatcatatttttcgcacgtgtgtgtgtgtgtgtgtgacggagaactct

SEQ ID NO: 509356 - DNA, 578 bp, Homo sapiens
acccacgcgtcgggaaaagtcatatggactggcaaagcaagctgtttaaaccctttgtaaccggggccttgcccccacctcctgtcttttctccttgccttccccagctcctgtgtcctcccatctatcctgtctttcctttcctcctctcagtgtcctcagcacccacaaggaattttcctatcactgtgaactttgctggtacagaggaataatatctgccattcaccttttctttttttgggaccatagctagccgagttccatttctttgcgttctaaaaaccgcttctcccttgtcacttataaaaatcgttggggaggctccgggtgggaacagacaaacaaaagagccttagagtggccgtggtttgttcaaaggataagaatagcttatatcctgcatctcagtacccgaactcacttcagtatgcttactgaggccatgagaacctgaggggcatctgcccaggacaggagccatggctttgtgacaaagaccattgagggaccggaaaaaaagtgatgtcccctttccctgccacctccagcctctgcccagcaattgagctgtcccc

SEQ ID NO: 509357 - DNA, 112 bp, Homo sapiens
tctactgaagaatgctccagatgatggatacaagctgagtgacttaggggagaagagaggctgaacaaaagagctggggccttccaagaggtgtatgagagggaggccaccg

SEQ ID NO: 509358 - DNA, 112 bp, Homo sapiens
tattctcaggctaacctagaccagacctacgccgcaatctcattcactatcatattcatcggcgtaaatctaaccttcttcccacaacactttctcggacctatccgtgcga

SEQ ID NO: 509359 - DNA, 973 bp, Homo sapiens
ggccgcccatcatcctctggctatggacagtaggcagggggagcagaatgggtggaggcctaacgattgtgaatgagcaggtgacctcctgccaggcgtgaaccccacagggttgataactgccaggctctctttgacccgtttggagactgtctggccccccctggttgccctccttcctgagtgagtctctcggggtctatagcgaagatgcgcattactccaaacacaggggcagcgcccatgaccaaaggggacctggaaagggaggtgggccgtggcccttgagtccccattgaggcttggttccttcccaatccagtggacttcgcagtccattctgacagcctcagtgaccctggctccttgtgccagagaaccccagcaaccggagagaaagatcatcccgtttgggggcccccagcacaatataatcatccacatggcagaaccggcgcacatgcgaggcatgactcaaaccgagaccaacacggggagcccatgcaaaccggacacaagcatacaccacggaacgcaggcagacagctgccccggggcagagatgcacacccctgaccactacaaacaaacaggacacatccccatgaggacaccgaccccgtaaccacaccgcaacaaaccacaacaacaacgacgacggaaccaagcccaatgcgtcgcaagcacaacgagtacgacgcaccatagaaacagacgagcgggagcaacagaaggccaggagcagaagtagaaagaggacacagaaacaggaaggccagaacatcaccaacccgaagcacaacaccgacgagagaacaacaaataacggtgcaaagcgcgctagcagcacccagaggcaccggcacgcgaccacccaccgaagagcgaatccaccaaacgacagcgagaagaagcagaccccaagcaacggcaaaacgacaacaaacgacaacaaagacgagccaatagaccc

SEQ ID NO: 509360 - DNA, 282 bp, Homo sapiens
ctaatttagttgcgagtgaatttacacaaagcagaacaatttacagaaggaatcgagggcacaggcccgcacttaactgtctttgtgacgcatcatcctgtgatgttgaaatgtcaattgcaggatgataatgttgtgcacgtcaatcaccgggcaattgcatactcctaagcaacagttcgagttcggttactgccttctcccattgaaatccttgctgcgtgcccacacagggattactctgtgagggaccgggaatgagcaaggaatggactgccacca

SEQ ID NO: 509361 - DNA, 226 bp, Homo sapiens
  misc_feature (36)..(36): n is a, c, g, or t
accctggggcatccacaatgaggtcctgggaagagntagggagctagcatttatttatggggacacattattccactgcctcctggtaagaaatctctttttttctacactcccctccacttggcacctccgttagtgatcaacttgtattcctccttgaatcagctatttctatgcatccttctgtctccccaggcagcacacatcactatggcacagggcccag

SEQ ID NO: 509362 - DNA, 106 bp, Homo sapiens
tgataatgtctagctgtcagtacaggacgcttgcttaatgtcaaatcttctatttaaaactgaattggcggccaggcacagcgggctcacacctgtcatcctacca

SEQ ID NO: 509363 - DNA, 743 bp, Homo sapiens
  misc_feature (513)..(513): n is a, c, g, or t
  misc_feature (526)..(526): n is a, c, g, or t
tcaaattttaacattatctttgagttgtaagattacagatcttacaaaggaactttctttttcagattctaaatttctacagtgtttcacttttatacaatgagtacctattacttctgaaagtagaattaaaaagattatttttatctttgaaagatattcatcagaacaaagcactgttacaatactgaaaaactggaagcaacttaagtgtccactgataagtgattgtttcaagaagttatgcatggacttttttttttttttttgagacggagtctcactgtgacacccaggctggagtgcaatagcgcaatctcggatcaccgcaacctccgctttgcttcctgggttcaagcgattctcctgcctcagcctcccaagtagcctacaggcacgcaacactacacctggctaatttcttatatttttagtagagatggggtttcaccatattggccaggctggtctcgaacttctgaccgcaagtgatccaaccacctgggccttccnagtgcttggattnccagggggtgaagcaaccggccctggccggatgggctattaaaaaagctattaaaattgggcttgggtgcaaaagctcaatgcctcaattccagcactttgggaggtgaaaggcaggtttcccggctgagccccagaagttgagggttgaatgagcttagagttcacccctggacttcaggcttggtgaaagtgggacccatttttaaaatccaaaa

SEQ ID NO: 509364 - DNA, 125 bp, Homo sapiens
agctagctggacagtagattttcatgtcaaatgtctttggagggatgacagctaatttaaattttgagaaaactagagaacaaacaagaggctaccagtcatgtagctccgggtcacagatccct

SEQ ID NO: 509365 - DNA, 1501 bp, Homo sapiens
gatatccatgaaaactggagggccttcaaggactctcatcgctgctcagatacagcggggctcaggtccgcgtgctctccgcaccagccccacttccattttggccaaaccaagccgcaccccatgaatttctccgacaaatttcctgccggcaaggtcccagacatttgcgggtgatgactggacttcttgtgctgttatgacgacgcaaccgccatatgcctacctactgtgactgcacactgacggacgcttgcggggacacgtacctccacgacggacagacacgcccacggtggttgcacgtgggtgacgctatgtgcattgacttcctgactatagttgccacccagaccacatacctgtggtagttacccacacacttgtggcaatcattgcacacacaaccaaacatggccacttgagaatgcaaaggcaggaagttgcagggctgcacaattcttgtgggcttgcttgtgcattgctatcacattttggcaagcacgcagggcactatattccttggatggtgctgcacaccgcaagttgcacattatgttcgcttgaacatccaccaagtagtgtctagccaccccatgtaagatggacatcatatacaacgcacgtgatatactacaggatgcacattacatttatcctgacccaagggccatatatcacacaatattagcgaacaaaacctggaatgggattccgtccacaacatgccattaacagcctaggaccacccaaggtatacactgtgggcctggttcatttgggagggacacaggtgcaacacaccagctggatgatcgcagacacagcaattgaggccccaacggaataaggcattggaccataacacgacaacggataaggcaaagacgacaaccccaacagacccttaagcacaaaagggtgcacaaccaaacgacccggaggccacaaggacgcaccggggcgcctaccacccgggagaacagcacgaagatgccacggcaacagcacacacatgagacatgcagcgagaaccacgcagcggaacgaccaaaaccgaggggacgagggatggcgccccccatgggcaccacatcagagagcaaacgacagacacaggagaattaacaacggtgcgcagcccaaggagaagcactagtacatggatggaggagccccacatgaggcacacaggggaacacccgagagcgggctcaaactggccacacaaccacacaacacgcatagagaggaagggacagaccatatacagaaagagaagaatcaccacaaaaataggagacaacaacaaccaagcgtagcaaccatgcgacccaacacctgggaggagacccacagcaaagaccgagctgagagcacgacaggaagaacagacaagacgagacaaacgactagacagacacaagaacatcatgaaagcaacgcacagcggacaacgaccaaaggcggaaagaagaggggcacacagagccagtgcacc

SEQ ID NO: 509366 - DNA, 131 bp, Homo sapiens
gagatcttctatactccagaaacagagagagattatcttggagcagcaattcgaaaagttatccagagtcatatgtgtgaagaggaagagggagatcttcttcttttcttaactggtcaagaggaaattga

SEQ ID NO: 509367 - DNA, 158 bp, Homo sapiens
cccgaaaatccaaattttagctgggcgtgggggggtgtgcctgtagtcccacctgctcgggaggttaacccaaaggaatcccttgaccccaggaggcagaggtggcagtgtcccaaaattgtccccctgcctggcgccagagggtgactttgtctcca

SEQ ID NO: 509368 - DNA, 863 bp, Homo sapiens
ggagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttacaaagatgacgagaaagatggaactccaggaaatccaactcaaaagaagctaagccaccattgcacgaagaggcagataggaagtatgaagaggtggctcgtacagttggtgatcattgacaggagacttgggaacgcacaggaggaacgagctgagctggcagagtcccgtttgccgagagaatgggatgagcagattagactgattggaccagaacctgaagtgtctgagtgctgctgaacgacagagtactctcaccaagaagatacattgaggaagaaatcaagattcttactgataactcaggggcagagacccggctgagttgctgagaaatcggtagccaaggctgggagagacagttggatgacctgggagggataacttgaattgcaccaaagagggtgcacctcgtgtaccaaacggatgctggaccaaaccctgttgaccttgatgaatgttgaacgcccagtgccacctggtgatggtcatcctt

SEQ ID NO: 509369 - DNA, 612 bp, Homo sapiens
gggggccctggtggccctgggatggggaaccgcggtggcttcctgcgagaggtttcggcagtggcatcctggggccggtggtcgcaggaccgatggcacggggccgggggccggaggccggcggagctacgcaggagggcaaaggccgacaggatacaggcagtggatgccctgtcacccaagtatgggcgcgctatgcgtcaaggcacatgcaagatcacagtcccttggaggagaatctatactcattactcccttgcccgattacaggcaatcagagcatcattgcatttctatccatgaggaggcccttctcatcaagggactgaggtattgggaagatatattgcccagatgcaggaaagccaagaccccgatgccgtacacagcggcacccgaggttcagagggccactcagggttgtggcttactctgagacgaacttaccaaatggtgcccagcgttcggggcaccttgagagtttgtatcacagggttggcgtcccaagtgggacgggattgggcacaacgcgtggccagttccctgatggaggggacccattcaattccctttgtgcgcagaaggcttcattccaaatcgggtcaccacgtg

SEQ ID NO: 509370 - DNA, 843 bp, Homo sapiens
taagaaaaaaataaaacaaatctttactgggggtgtgcttcggggcttggagtgtgagggcccaaatcttaatttctcaaacaatctacacaaatcaaaccaaaaaactacaagtggtttcccaggcaccggacgacgaggccagtgggcagggcgtggttgactccttaagaagaagagggaagcagggggcgcagagttactccgaggccacaccccaaatggggaggccaagaagaggacacagcagaggatacaggaggggagggttcccgagggggccaagtacgcaatccccgaggggaaccccttctcgcggggagaagcgtggagtctccgtgggggtggcctatctcgaagttctccccgagacagtgtctgttgcagccgaggaaacactccgaaggctgtggagtgtgagtccacgcggagggagagaaagaaacacgcccgagctccacgggggggcgggggaaagagttactaagcgtcgcaagacaagccccgtgtgggaggaacccccgggacacatattgggtgggcgtcggagttaaaagcccccggaaaaggctctgcccaagagagcgtttgaacagacacccgcccgcgtttgaagccccttgaaaagaggaaaacggctatggccctcaaattatcccccccgcgtttgtttttacccaccggcgggttcaggcacccctatggaggcggaaaagggcccggtgggcgccgcgagggctcaccggggctgtcctcaaagacaaggggtcggtgcccgaaaggggaaacacacccgaggaaaacgtggccccgaagggccggatctagaaaacccagaatagc

SEQ ID NO: 509371 - DNA, 377 bp, Homo sapiens
  misc_feature (10)..(10): n is a, c, g, or t
  misc_feature (58)..(58): n is a, c, g, or t
  misc_feature (60)..(60): n is a, c, g, or t
  misc_feature (87)..(87): n is a, c, g, or t
  misc_feature (93)..(93): n is a, c, g, or t
  misc_feature (100)..(100): n is a, c, g, or t
  misc_feature (114)..(114): n is a, c, g, or t
  misc_feature (117)..(118): n is a, c, g, or t
  misc_feature (139)..(139): n is a, c, g, or t
  misc_feature (142)..(142): n is a, c, g, or t
  misc_feature (160)..(162): n is a, c, g, or t
  misc_feature (177)..(177): n is a, c, g, or t
  misc_feature (190)..(190): n is a, c, g, or t
  misc_feature (205)..(206): n is a, c, g, or t
  misc_feature (213)..(213): n is a, c, g, or t
  misc_feature (236)..(236): n is a, c, g, or t
  misc_feature (259)..(259): n is a, c, g, or t
  misc_feature (276)..(276): n is a, c, g, or t
  misc_feature (288)..(288): n is a, c, g, or t
  misc_feature (314)..(314): n is a, c, g, or t
  misc_feature (325)..(326): n is a, c, g, or t
attgaatgtnacttcataactgtactacgattgtattaaaatatttctggaataaaananaaaaaaaaaaaaaaaaaaaaaaaaaancattanactctgnaattgaatattatnccnnaaaaaattgcacatagtagancgntatctgggaagctatttnnnccagttttgatattnctagcttatctanttccaaactaatttnngtttttnctgagactaatcttattcatttnctctaatatggcaaccattatanccttaatttattattancatacctaagangtacattgttacctctatataccaangcacattttannggtgccattaacaaatgtatcactagccctcctttttccaacaaggagggg

SEQ ID NO: 509372 - DNA, 351 bp, Homo sapiens
agatctacgagcgcggcagaagagagcatagcaccttgcaggcaagatagatgtagggcagtcaaagaggtcctgatggagagcccgccggactactccgcagctttccggggccgactttggcattccctgctgtcccagtgcacctgaaacgccttcttactcgtggctggtggtggtggtcctcatcgtcgtgatgattgtgagagctcctgctcatgggtctccacatgagccagaaacacacggagatggttctggagatgagcattggggcgccggaagcccagcaacgcctggccctgagtgagcacctggttaccactgccaccttctccgcgatcgaagtgt

SEQ ID NO: 509373 - DNA, 225 bp, Homo sapiens
cgatccctcttcgaggtgtctgtgtctgttactgtgaagacacagcaacagccggtagtaaacacctaaaaccccagagctggccgggcacagtggctcacgcctgtaatcccagctactcgaggctgaggcaggagaatcacttgacttgggaggcggagggtgcagtgagccaagattgcaccaatgcactccagcctgggcgacagagggagactccatctt

SEQ ID NO: 509374 - DNA, 223 bp, Homo sapiens
gcggccgcctactactactactgctcgaattcaagcttctaacgatgtacggggacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaaca

SEQ ID NO: 509375 - DNA, 1196 bp, Homo sapiens
aggtctcacatcaggaattttcaaaaatgaaacaatctaataatgaagctaacttaagagaagaagtttgaagaatttagctactgcatatgacaacttgttgaactgtagctaattgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaaca

SEQ ID NO: 509376 - DNA, 453 bp, Homo sapiens
ggcgggggagaaaaaaaagcatagtagctcattcctgtaatcccagcatttggaaggccgaggcaggaggatcactggagtccaggagttcaaggccagcctgggcaagataagacactgcctttacaaaaaaaaaaaaaaaaaaaaaaaaatgggtgggcggccttgggccctggaaaaagttttcaaaacccatcgcgttgtgggggcggggccccagggggtacggtacaaccctggggccaaaggagtggttcccaaggagagaacccggggccatggagacataggggctgggcttcctcaccaaataaaaaacgcgcccggggggaacccgaacgggtctggaaaaaatcccaggatgggaggtccaggagagcaaatcacggggcgctctataaaccggggaggtcacaggagggcgctcgatcatcaaattaaggcccggcctgg

SEQ ID NO: 509377 - DNA, 1047 bp, Homo sapiens
gaagaaaagaaaagctgatattttatgtgtgttaatttttttctatcatgttaatttttaacactctgtctttgataaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaaca

SEQ ID NO: 509378 - DNA, 221 bp, Homo sapiens
ggtgcgagctgccctttcttaatacattctcatcagtctaaccaataaataaaacgaggatgcgcaacgcattgcttggagttagtctatagcctagcgggaattatccagccattagccctggcccagatacttctagaagccctggagggaactgagaactttccaaggttgtaggccgctgaggctaggccctggaggtgggagcacacggccgctcg

SEQ ID NO: 509379 - DNA, 920 bp, Homo sapiens
  misc_feature (17)..(17): n is a, c, g, or t
  misc_feature (37)..(37): n is a, c, g, or t
aatactcgaatatttantcttattttcttcagtattnatttttggatagtattaaacacttggtactcttttgttttaattaataacaggataggaatgcttttctctgacaagtgccttgaaacagtttttttcactccactgttctttaatagactaaaaaatagaaatgactttcatgaaaaacgtagttctagaatgattattgttttattttttagtatttgatttaccaatcaagatttttctgttttcttctatcaggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaaca

SEQ ID NO: 509380 - DNA, 1126 bp, Homo sapiens
agagagaggctatgagagaaaatgatgcccaggatgggctctgccgcccgccggctgcggagaggcccacactgcacacgcgcagacccagcgcccgcgtcaaaacatcagtcgacagcgcgttccccatgtcctgcgcctccggctggcaggagttcctctcagtcgtgacccccgccgccaggccggggcggacgagctaggtctgatcggcgatgccccgggagatcatcaccctgcagctgggccagtgcggcaaccagattgggttcgagttctggaaacagctgtgtgctgaacatggaatcagccccgagggcatcgtagaggagttcgccaccgagggcactgaccgaaaggatgtctttttctaccaggcagatgatgagcactacatcccccgggctgtgctgctggacctggagccccgggtgatccattccatcctcaactcctcctatgctaagctctacaacccggagaacatctacctgtcggagcatggcggaggagctggcaacaactggggcagaggattctcccagggtgagaaaattcacgaggacatctttgacattatagaccgagaagcagatggaagtgacagtctagagggattcgtgctatgtcactccattgctggggggacaggttctggtctggggctcctaactcttagagcgactgaacgaacaggttccccagaaactggggcgagacatactcaaggtgttcccaaccagggacgcgatgagtgatggtactggtgccagcgccaagaatcgctcctcaacataaaagagggggagccaatggcgatgcgctgtggttgcggcacacaaggccggaacagggtcagcaagagcgtaaaatacggaacagcacgtctctccagaacaccaccgcgggcaccgcagatgagcggacacacccccggggaccggagaagaagagagacgacgagcaggccgaatagcaaccgtgacgcccatagggggacacccacgcacaagagaggggacacaacacgacgagcacgacgcaacgacaagaaggaaagcacagagctacgcaaccagcaaaacacagcagcgcagagagggtacagcgacaacaacgggcacag

SEQ ID NO: 509381 - DNA, 1598 bp, Homo sapiens
aggtctcacatcaggaattttcaaaaatgaaacaatctaataatgaagctaacttaagagaagaagtttgaagaatttagctactgcatatgacaacttgttgaactgtagctaattgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacagttgtcattgttatgttttgttattgattctcattactgtctaattttttttctggtattagtctcattttgtatgtatataagttaaacagatactgtttttaagtgcatgaatagtacaagttattatcaaggatgttttacagggaaatcaaaagaatattatcatactttatctttcgtatgctgattagtaaacgatttttgacatttattttagaaagtcctataatgtggaagaaacaaacagttgctaccaaagattcttcaaataaacatacaaataaatgtgtatatttaatgttttattgttagcttctccagaaaattgatgcaaattctggtaataattcttgcattttttccccataacctggttaaaataaatacgccattggcaat

SEQ ID NO: 509382 - DNA, 411 bp, Homo sapiens
gtaggcgccggcgtgctcagcgggggtgttgttgatgagttcgcccgcgcggaccgcgtaccgcgtggtcaggaacggcaggaccgcgacgttgacctgctcgccggtggatctcgcgtgaaaggtgacgacgccgccgtcgccggcgggtcgcgcctggccgacgaggtgaatgcccgccgccgccatcagcggtcggtaagcatcgaaggtgcctgcgtgatcgtgattgcctgccatcgcaatcacttccgcgccagtgtttttcaactcgatcaatgtgtgtacgacgagacgttgtgcctgcgctgacggtgccgacgtctcgtacaggtcgcccgggatgagcactgcatcgacgtgctcgcgggcggcgatgtcgacgatctccttgagcaccagagcttgttc

SEQ ID NO: 509383 - DNA, 1282 bp, Homo sapiens
aggtctcacatcaggaattttcaaaaatgaaacaatctaataatgaagctaacttaagagaagaagtttgaagaatttagctactgcatatgacaacttgttgaactgtagctaattgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtaaatcttataattttaaaataaattacttaagaacaaaaaaaaataaaaaagacaataaaatgtaaaacaaaaaacatgttggccgcctgggcccagccgactttagattggagcgctttcg

SEQ ID NO: 509384 - DNA, 1437 bp, Homo sapiens
  misc_feature (1312)..(1312): n is a, c, g, or t
aggtctcacatcaggaattttcaaaaatgaaacaatctaataatgaagctaacttaagagaagaagtttgaagaatttagctactgcatatgacaacttgttgaactgtagctaattgaaggaaggcacaaagttttacaatgagttgactgaaatcctggtcaggttccagaacaaatgcagtgatatagtttttgcacggaagacagaaagagatgaactcttaaaggacttgcaacaaagcattgccagagaacctagtgctccttcaattcctacacctgcgtatcagtcctcaccagcaggaggacatgcaccaactcctccaactccagcgccaagaaccatgccgcctactaagccccagcccccagccaggcctccaccacctgtgcttccagcaaatcgagctccttctgctactgctccatctccagtgggggctgggactgctgcgccagctccatcacaaacgcctggctcagctcctcctccacaggcgcagggaccaccctatcccacctatccaggatatcctgggtattgccaaatgcccatgcccatgggctataatccttatgcgtatggccagtataatatgccatatccaccagtgtatcaccagagtcctggacaggctccatacccgggaccccagcagccttcataccccttccctcagcccccacagcagtcttactatccacagcagtaatatgtctgctcagcagctcagctgattcagatcagagggaaagaaataccaaccctgcaataagtgtactaaactctacgctctggttaatgtaatgtactctcctggactgaatgcagtgtataatttctgtctacagctagaagctgtgccccagttccacatttgattacacatgtgagatttgctgctgttgcagtataaacactaggtataataggatttgaaattgcattacagttcataaaaattgaaaatgagaaattaaacctgcaagtgaaacatttgaaacgattatactttctacataagacatggttgggacatcagatacttacaaagatggtttaagtatggatactagagaaaattaagttttctttctctttggtttattgatttggtttaatttccattatgctattttgcataatcaaggcactgtttggactctgggcactatttggactctgggcactgtttggactctgtgcactgtttggactttgggcactgtttggactctgtgcactgtttggactttgggcactgtttggactctgggcactgtttggactttgggcactgtttggactntgggcactgtttggacttgggcactgtttggactctggcactgtttggactctggcactgtttggactctgagcactgtttggaatctgagccctgtttggactctgagcactgtttggactctg

SEQ ID NO: 509385 - DNA, 243 bp, Homo sapiens
ctccctcggcctcccaaaatgctgggattacaggtgtgagctaccatactcagctgaatttattagttttaacaggattttgttttaatatttaagggggtattataattattttttttaactttaaaacattaaaagaaatttttttagagacaggatcttgctctgttgcccaggcttgaatgtcgtggtatgttcatagctcactggagactcaaactcctggggctcaagtgacactcc

SEQ ID NO: 509386 - DNA, 501 bp, Homo sapiens
acaccgtatatcctgacccgccaggaaaaatacggtaccaacgcttcaaggattacggctgcattgcctgtcaccaggacgtgaacattggcggcaatatgttccagaaattcggcgtgatgggcgattacttcaaggcccgcggcaaaccgctggaatcggacctggggcgctaccttttgacccaggatgaagaagaccgccatgtgttcaaggtgcccagcctgcgcactgtggcacgtcactggcgccgtacttccacgacgcctcggccaagacccttgaagaggcggttgacgtgatgttcccgtacccagttggggcgcaaaccgtcccaggaagacaaggagctgataatccagtttctcaagaccctgaccggcgaatgggcggggacagcgttatgagagccttgtcacgccgaggcaccagccaaatcctgctaggcctatcaccctgtgcctgtgctccaacctggtgaatgagtacctcacgtcttcc

SEQ ID NO: 509387 - DNA, 105 bp, Homo sapiens
ccgtaagtgtatgaaaagtgaatctttggtaaggatcaccgacagattgaccggtattgcgcagggaggcttgacgcttttcgccgattgccgcgacgaaattgg

SEQ ID NO: 509388 - DNA, 279 bp, Homo sapiens
tggccaggctctctactccaaacagaccaagaccaccaagtaaaatatcagggtcggcacggaaacgtatagcttgtagggaggggggcagaataaccccagcctcctccaggagttacaaaccggttgaccagactataatcttcttaagaataacccttcatgagggctggagtctcctccttggtgctggccttaccaacaggatcaagggccctcactacccgatctcatgcagcttggcacattgtaggtggtctggatacctgggcagctatg

SEQ ID NO: 509389 - DNA, 107 bp, Homo sapiens
gcgacacggcaggttcccgcccggaagaagcgaccaaagcgcctgaggaccggcaacatggtgcggtcggggaataaggcagctgttgtgctgtgtatggacgtggg

SEQ ID NO: 509390 - DNA, 291 bp, Homo sapiens
actaaaaaagttagccgggcgtggtggcgggtgcctgcaatcccagccactcgggaggccgaggtaggagaatcgctcgaacccaggaggcggaggttgcactgagccgagatcgcgccactgcactccagcctgggtgacagagtaagactctgtctcaaaacaaaacaaacaacaaaaaaaccaaaaacaaaaaacaaaaacaacaacaaaaatccccacaagctctaggagtttgggatagagatacaactgaagtctctaatacagctcctactcgtttctgtcgac

SEQ ID NO: 509391 - DNA, 692 bp, Homo sapiens
  misc_feature (10)..(10): n is a, c, g, or t
  misc_feature (73)..(73): n is a, c, g, or t
  misc_feature (594)..(594): n is a, c, g, or t
  misc_feature (634)..(634): n is a, c, g, or t
gtggtgctangagtccaatgtaaaattcagagcactcaggtcaagcagtcaggtgcaggttgctgctacaatntgcctccatccttttctcacagcaatgaatttgcaatctgaacccagtgaaaaaaacaaaattgcctgaattgtactgtatgtagctgcactcaacagattcttaccgtctccacaaaggtcagagatgtaaatggtcaataccgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtgttatattggcatgtttagatgtcaggtttagtcttctgaagatgaagttcagccatttgtgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataanttgtggctgcagaatattgtaatttgttgcacactatgtnacaaaacaactgaagatatgtttaataaatattgtacttattggaagtaaaaaaaaaa

SEQ ID NO: 509392 - DNA, 723 bp, Homo sapiens
  misc_feature (10)..(10): n is a, c, g, or t
  misc_feature (73)..(73): n is a, c, g, or t
  misc_feature (434)..(434): n is a, c, g, or t
  misc_feature (439)..(439): n is a, c, g, or t
  misc_feature (448)..(448): n is a, c, g, or t
  misc_feature (450)..(450): n is a, c, g, or t
  misc_feature (625)..(625): n is a, c, g, or t
  misc_feature (665)..(665): n is a, c, g, or t
gtggtgctangagtccaatgtaaaattcagagcactcaggtcaagcagtcaggtgcaggttgctgctacaatntgcctccatccttttctcacagcaatgaatttgcaatctgaacccagtgaaaaaaacaaaattgcctgaattgtactgtatgtagctgcactcaacagattcttaccgtctccacaaaggtcagagatgtaaatggtcaataccgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtgttatattggcatgtttagatgtcaggtttagtcttctgaagatgaggggggtttntttcncccccaaangnccactagttcagccatttgtgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataanttgtggctgcagaatattgtaatttgttgcacactatgtnacaaaacaactgaagatatgtttaataaatattgtacttattggaagtaaaaaaaaaa

SEQ ID NO: 509393 - DNA, 149 bp, Homo sapiens
  misc_feature (28)..(28): n is a, c, g, or t
tcgaatcgttttagacgaaggaaattanaaaaatgttgtaactcgcaacagcactgttgaatattgggtatcggctttctttttcactttgactcttaacattatcagtgcaacttccacattaatgaaagttgacctagttgatttgc

SEQ ID NO: 509394 - DNA, 209 bp, Homo sapiens
gtcggagtagactactataagatagcagataaaaatatcaaatagtgataaagtatcagttaaagtttataactgatgagtatattttttaattattaaatgtagttaaccatacatttattaaaaaagttttattttagttttaaccaaatagtaatttgtaataatttgtatttatttttggagaacactgtgatgttttgttacat

SEQ ID NO: 509395 - DNA, 247 bp, Homo sapiens
agaacacgcattatagcatagtactctatttcagattccgtcaaagctgggcgttgtagcgagaatgaccaatttcgcttggccttgtctgatcatcttcagagtctgcttgtaccccaggacgtacttcccacttttcataacgagttggagcctagagttgatcgactccagcgactttttcgtcttcttggcggccaccatcttcctgccttaggagcgggacggcccccaaccaacagcagcc

SEQ ID NO: 509396 - DNA, 463 bp, Homo sapiens
  misc_feature (422)..(422): n is a, c, g, or t
  misc_feature (443)..(443): n is a, c, g, or t
gtagatgaccgcctgtgcctggctgacgttgctcggctggccaaaagtacaaatggggattgaatctctgcaagcgttcttgcgtgcggcgtttgcacttggggtctgggtttacaccttcctcgaacgtattctgatcccaaccggtttacaccacttcatctacggacagtttatctttggtccggcagctgttgaaggcggcattcagatgtactgggcgcagcatctgcaagagttcagtttgagcgccgagccgctgaaatcgttgttcccggaaggcggttttgccctgcacggtaactcagaaatctttggtgccgtgggcatttctttagcgatgtacttcactgccgcaccggaaaatcgggtacaagtggcgggcttgctgattcccgcaaccttaaccgccatgctggtgngaattaccgaaccgctggaanttaccttcctggggatcctc

SEQ ID NO: 509397 - DNA, 369 bp, Homo sapiens
accggatggcctttactgcacttgcagagggggagcagtagctcatctgacagaatgctgcctgactgagggggggctgcctgaaggcaaagcgctccctgcctgataccccagttccacagccccacagcactggggctcctgcctaataaactcttacattgcacacccccttcacctcccagcgagcctgccagccgactacctcaattttcagtctgaatgattgattgcttcaacgggctacaacacaacagaattaagataacacatgctgtaactttaaggactgcaacatgaccctcgctgcattccagcagaaggccactgccaggacgtggtctttattttgtgagtcgagcccagact

SEQ ID NO: 509398 - DNA, 1095 bp, Homo sapiens
gaaaggctggaagacgagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgccagacacgacatacaagactgtgagatgacacgtgcccgttctaggaacgttcagacagatacaatccatcttccctctgcgattaaccctgaagaccccaggtcccaaaagagagcgatttgatccaaagtgtggatggaatgcctcacatttgtcactattcttcaacatgatgtgaaagaacaggagcttctccaggaactctatttcagaacatctctgcattgatctgtattcacccagactcccaaaaacctgaaggaatgatgatccgaggagttgaaattggctgtgatccagagacttagcacattaatgcactcagcttatggggacatcattctgactttattatgagccctccattctgccacgtttaggatttgcatgtatctattacatgataggccttgacagaaacaggagaaatcaaagcaattaaaattgatgccttaaaatgtatacaggttctactcttgcagatgtgattgtccaggtcacatccaaaggtcatttggatgaacttgaacaaagcagttgggggatatgaaagcatctataatacttggaatttcaaatgaaatgacaagataataacagaaacttcaaacaagtaaaaactatgatgaaatattccgtcaagaatcttatacacgaaacgtgaagcatcaaacatgacggtgaacaatcacaaaaaatccaaaggtccaggaaaacagtaaaagtagaaaaatataactaaaattgtcaggttataagaggaacacaataggtgtaactacttgtgagagattgaatagtgtctataaacgaaacaaagggagagcgaaacacttacgatgaacgcatctgataaaaaagaaagagatagactgcaatagcaataagagaagaatacagtataatatagataataaataaacatgacgcctagc

SEQ ID NO: 509399 - DNA, 339 bp, Homo sapiens
cacctccccaatcccagctacggggaggcggtcctgcatggtggttaagatcaaggcttttgagtgaaacagaccaggaattgaatcctgcctctgcagcttacaaactgcacaccatctatctgtttacgaaaccactgaaagcttccttgtttcatctgttcatgaggatagtatttttttactcaccgcagtatgaggatccattaagatgtatatccagagtttttagaacagttccccgcacattttgattctctcgtcttggcttgacagcaacacaaattccaattccagtaggactcaactcaaatatatctcttatacaacttcaagaaa

SEQ ID NO: 509400 - DNA, 1012 bp, Homo sapiens
cggacgcgtgggtcgagccacgcgtccgccacgcgtccgtaaatattatactagcattttaccatctcacttctagagaatactagtatatcgcctcacagcctcatatcctccctactatgcctagaaggaataatactatcgctgtctcattatagctacatctcataaccctcgaagcacccacgtccctcttagccgaatattgtgcctattgccatactagatcttttgccgcctgcgaagcagccggtgggcctagccctacatagttctcgaatcgtccaacacatatggcctagactacgtacgataacctaaacctacctccaatgcttaaaacataatcgtcccaacaattatattacgtaccactgacatgacgtttccaaaaaaacactatacatttgaatcaacacaagccatgctcacaggctaggttattagtcatcatcccccctactatttttggaaagcaaatcaacaaatcgaactattttagctgtaccccaagcgtttttcttcctacccccctaaacaaccccctcctaatattgatatacctgatttgctacctctcacaaattcatgcgcagcctgacgtccacttctccagtgaagccaactatctactgaattgagacgtcctagcttcgtcctaatacttaggttcgtcctctacaagatctcgtttagattatgcggcatttcccagcaccgctgaacctaatccgcatttattatcatctttcgaaaacaaaagttattccacaacggtggtaatcatccacccgaagaggcaaccacgccagaacggcttgaggcggggacatagttcaatcaaacgccttgtaaggcccttccctatacattgcagaatattacttcataactaggctttataaacttaaatccctacggcagaaattcatctgagacaagttattacattcaccacgttagagcacactaggaccatactaaacctgaccgctgaacaaccggctacgcg

SEQ ID NO: 509401 - DNA, 766 bp, Homo sapiens
gtgtaagctagtaccaggtgtccacccaggcggtcttaccgagctctggtcaaccgagcacaggatcctgctgaagagtctgtcacacaagcctgtgaccgacgagcaccggacattgcaccgcatgatgactgaagatgcactgaattctgaccctacgcgacacaggtcgacgacagacacgaggacaagtccagagcgaagactctctagtgacacctcgagaggaaggctcgtctgtgtacgagcctgtcctattcctcctatgcgtgcctccttgagctatgcgcctgagatgatacaaacgtgggaccatcttcgggaagggtatacactggcgtatgaacgaccatctagatcctgagaagagtatgactcggtgccataggtctagctggggtagtcaagacttgacccacgcaacacctttgacccagcattggacattggcttgggcccagaagattggcatcggagggactcatcgacgaagcgagctcagctagacaatggtcgtaggactagacagcagacaaatacccgtggattgggcaggtggcccgaccgagaggtcgtggggtcagaagttctttcaatcatgattagaccaagacaaagaggagccagtagagaagccccaagagaaacgcagtatggtgggcagaccaggaattggactttgggacaggtgtggtcacaggccactcacatgggcgcttcactccgcaggtaaagcttcagggtgggttttaactaacaggcactg

SEQ ID NO: 509402 - DNA, 671 bp, Homo sapiens
  misc_feature (415)..(415): n is a, c, g, or t
atctccgacccttactctcctcccacctccattcatccatttattcatctatgtatccatccattcatccatccacccaactatctatccatccaatcatccagtcatctttccatccatccacccatttattcattcatccagccatctatctctttatccatccttccagcaagtgatccatccattcacgcatccagatggctgtctgtccattcattcatccatccaccacttcctacccccagacccatctatccacccatcatccactgacttcaaaagcttcatttgatcgtctgtgcagcagacatggtgtgtgatgctctgacacctcttaagtgctttggttgcccacaagaacctcacgggaggtctctaagttgggctcagaccttggtaatgaaaaccaganataaaagtgatttaaagaaagctgatagaaacctaactttagcaaatggtaagataaaaatgtactcctttgtcctgtaaaagaagttgggaatgtgagtcgggctggcacagccgtcctgctgtatcatcagccaccctgatacctttgctcaacgtgttctgccatgcttagaatacaacttctggccgggcgcggtggctcatgcctgtaatcccagtactttgggaggccgaggtgggtggatcacctgagg

SEQ ID NO: 509403 - DNA, 651 bp, Homo sapiens
  misc_feature (484)..(484): n is a, c, g, or t
  misc_feature (630)..(630): n is a, c, g, or t
ttgtgatgactcatgcctgaaatcacagcactttgggaggccaaggtgagtggatcacttgaggccaggagttcgacaccagcctggccaacacggcgaaaccccatctctactaaaaaatacaaaaaattgccagaagtggtggtgcacgcctgtagtcccagccactctgagactgaggcaggagaatcgcttgaacctgggaggcagaggttgcagtgagccaagatggcgccactgcactccagcctgggtgacagagagaggctccatctcaaaaaacaaacaaacaaacaaaagtgtgcctcttgggctcggcgcagtggctcacacctgtaatcccagcactttgagaggctaaggcaggcagatcacctgaggccaggagttcgagaccagcctggccaacatggtgaaaccgtgtctctacttaaaatacattagctgggtgtgctggtgtgtgcctctagtcccagctacttgntaggctgaggcacgagaatcagttgaactcaggaggcggaggttgcagtgagccaagatcacaccaccggacttcagcctgagtgacagagtgagatcctgccttgcacgtttatgcaatgccggcgcaatccgagctcactcggncttcgccctatagtgagtggc

SEQ ID NO: 509404 - DNA, 251 bp, Homo sapiens
tttttgtagaaatggggtcgtactttgttgccagagcttgtctcgaactggactcaagcaattctcctgcctcagcctcccaaagtgctgggattacaggcatgagccaccacatctggctttttttttttcttttttttaaatatagagacagggtcttgctatgttgtccaggttggtcttaaacttctggcctaaagtgattctcccaccttaccctcccaaagtgctaggattacaggtatggtgag

SEQ ID NO: 509405 - DNA, 300 bp, Homo sapiens
gaacgctgcaaaagggtgcagcagggcactcagtgagagaggactgagcgcactgaggtggattttccttaggagcatttatggaccttaaggcagaagcttaagggcaatttggaccatactggccacataggtcatgatacatgattacatctgtagatgttttggtgccttaacgtcagcaagggttgcacagtgagtttcagcatgccattccagagatgtgtagaaattctagttacttataaatttggagggaagaatctgggaccagatgcctgctttaaatgatagggaggt

SEQ ID NO: 509406 - DNA, 979 bp, Homo sapiens
cgctcacgcggcgatcatggcgtatcagtgtctcactgtgcctctcattagtgatgagcgtgttctggggcttcgatcggcttcttggtgccttggatcatccctaagggtcctaaggcggaggaagttatcatgtaccatgttggtgacctgttcagtttgctgctatctctttcggctgattgcaatatctggtccatctcaagcctctcttggcgacccgcagatgcgaaaaatgaagagccatctggtatctgaagtatcgattggccttgaggaagaggacatgctctacagagctcagtcttggaggtcagcgagaatgagaatgccttctagatgcaagatcacgctccaaagcagatcactttatctggacttgcctgtgaggccattatgtgcccttaaacgttaacagcacgatttgaatgccgtatattctaccaatgcagccgtgtttaccatttgcctttagtgcactttggtgaattacgtggcctccataacctgaacgggtgccgactccgacaaaacgattatgtaactcttctgagatagaagaagctgttcttcatgacgagatacgttagctctctcctggaatctgtggatttgcagatggttcctgcctgctcaacgtggggacatcaggtggacgtgtttcagaaaaccggctgtacgacgaacactagaactcccagtgggggggggtcagttacgacgagccacgttcggcagggaagaagccctcttaataggagtcgcccgaaatgatactctgaagatgaattctcttctggcgacttggttaaattttccccgttttgtggagcacacagaaacacaaggggggggctaaagagcccggggccccgatgcgcccgttttgtgaaggccctagagggtaataaagacggcgttaaacgctacacaacctcgtttggacacctgtggagtgtcccaaaacggaaaatgattg

SEQ ID NO: 509407 - DNA, 1172 bp, Homo sapiens
  misc_feature (1172)..(1172): n is a, c, g, or t
aagatatacacatacagtcaagtggctgaacacccaccagcaagattgctggaaaccaagccgcaccacacctgccggagcatccaggaccatctactcagtgcaggctcagcagccatgcctacctttgtccatcccaggtatggctcccccaggtgccagaatcatcaacacacactgactgatgatgctgctcttacctgctggcacgcagtcggctgcctcccagctctaagcctgtggggcagccaggagagtcttgcctctggcctccgttggtcccatacttcctggcgagtggctttgcacggcagcccagccctggggaactatttcaatggagatgaggaagctgtctaaacccacggctaatgctaccccattgcttgatctgaatggtctagtccgaatgaagttcgtggaccaatcgccagtttattttggccggtggccagggattactggtattgatccaccctaatctggggctattgggcctcgaatatccgcaggaagcaaattacacatcgatgtctgcatgggaacaggtggatcgcgaagaaggttcattttgggcagacctgttcaatcgactgaaagatgatggctggctttaaacaatgcatcctgcagtagatagtacatgggcagcgatcaaatggcacaactcaggggaatgctgtcccagttctgaagaaattagcgaaagcaagtcattacattttaaggcaggtaacccttctggggcgatgcgagaaaagggttcattatctgatcgcattggggaacaaattggactcttgttcatgttaatcggggaacaggataagaaaaaatgtcgggcaaaacagattaatgcgcccaaggggtagggcgattctaagcggcgatgaaggaatggttgcgggcggaacggggtttcgctgctgaaacgctggttcctttccaggtccgatgcgagtcgtgccatagttacttgtcgctgcgctgccccgctagggcaatgtccccttgggactacctcgcgaattgatacccatgttttttagttgttcctttggtcgcgcagtggtctctcctgtaaaagtggtgtgtgcgtaatatctcggctcttctttggcgctcggcgctatacaaacctcttgcttttcttatccgtgtgtccgttgtgn

SEQ ID NO: 509408 - DNA, 106 bp, Homo sapiens
  misc_feature (53)..(53): n is a, c, g, or t
gtagttagaggatcccatccggctctgggtagagtatttgaaacttcatcaantggaaaagtggttggggttcctgggtttgaccacgtgaaaggatggtgggaga

SEQ ID NO: 509409 - DNA, 358 bp, Homo sapiens
aagaatgatatatatatgatagatatatatttccataggacaacaacatcagatgtctacccctagatgaacgatgcagagtcaaactgcaggttcttaaaacaaaaacaaaaacacaaacaccatgatactaacaacggtggcagggtgagggtgaggaatcaccgatggagagatccaaatcagaaggaaacgtagacatagagtcccaggctcgtgcccaccgccagaaatccagccccgcctgtgctgagatagttcgtctaaggtgctccaagagatcccccttggactgcaagagaaggtgtccctgccatatctgggtcgcttccttttccactctcctcagcccgccatc

SEQ ID NO: 509410 - DNA, 624 bp, Homo sapiens
  misc_feature (613)..(613): n is a, c, g, or t
  misc_feature (621)..(621): n is a, c, g, or t
cctcggggctgtaacataagcggctgcggacttgtacaaacagcctcagcacccctgggagctcgagacatctaaggagttgactgaggcccctccctgacatactgaagtggaatctgcattttagcaagatctgcaggcatgtgtgggccattgcagcctgaattaatcaggagggaagaagaagtgcgacgataactggccagtgatacacagtgggaggtctggaagaatgcacacccaatgctcacagaggttccatctgggaaatcggattggacagggccagaatagatccggggaaacattcactgaatatatatacttatgtattgtggaagctttgatggtggtcatgtacccaagaagggaaaaaacagactgcggaactgcccatgaggccaagcacctattagtagaccaagaagcatcacccatccatggcctaagtcggcagccagctattgttctcatctgagtctgggagttcaggatttccatcctgacccggctactttctttcaacagttacccactgtaaatttccgaatactttcagctactaatcccagtgtacccaattaaaaatggctttcctaataaaggcatttcngatcgaantta

SEQ ID NO: 509411 - DNA, 402 bp, Homo sapiens
  misc_feature (92)..(92): n is a, c, g, or t
  misc_feature (228)..(228): n is a, c, g, or t
  misc_feature (241)..(241): n is a, c, g, or t
  misc_feature (263)..(263): n is a, c, g, or t
aggaagttaaatatcttgctcagaggagaaccaaaggttatattcaggtctgtcgtccagagcccatgctaggcctgcatgccgtctttccntcgagtgtttgagtctagttagcagaggccttcgtcagggcttttgttgtgggtacctgatctcatgaaccgtgggcccgtctgttcctttctaccctcccttgatcccgtggattccaaaccgccttccctttanccccttgggtggnttcgacacaatggctttggccnaggccccaggaccccttccccatgtggccctgtgggatataaatttttccgccgttgggttccgttttgtggggcccccaaggcgggttttgggcgctgttccacatttgggccccctttgggcgccaaaacctttccc

SEQ ID NO: 509412 - DNA, 112 bp, Homo sapiens
gggttttatttcaaagggaaaagtttgaacccccccccccttaaatatttttttttttgggggattttggggccagttaaaaaaaaaaagggaacccttgtgttttccccta

SEQ ID NO: 509413 - DNA, 470 bp, Homo sapiens
  misc_feature (459)..(459): n is a, c, g, or t
  misc_feature (467)..(467): n is a, c, g, or t
cctcggggctgtaacataagcggctgcggacttgtacaaacagcctcagcacccctgggagctcgagacatctaaggagttgactgaggcccctccctgacatactgaagtggaatctgcattttagcaagatctgcaggcatgtgtgggccattgcagcctgaattaatcaggagggaagaagaagtgcgacgataactggccagtgatacacagtgggagacagactgcggaactgcccatgaggccaagcacctattagtagaccaagaagcatcacccatccatggcctaagtcggcagccagctattgttctcatctgagtctgggagttcaggatttccatcctgacccggctactttctttcaacagttacccactgtaaatttccgaatactttcagctactaatcccagtgtacccaattaaaaatggctttcctaataaaggcatttcngatcgaantta

SEQ ID NO: 509414 - DNA, 466 bp, Homo sapiens
aatggctcaggcatgttaaccccagcctttgagaggctgaggtgggcggaccatctgaggctcaagagttggcgaccagcctgagcaacatagtgagacccgatctctactaaaaataccaaaaataagccgggcgtgatagctgcacgtctgtagatcccagcatagtagggatgctgaggtgggaagatcgcttgaacacaggaggtgacggcttcaggttagcagtgatggtgccactgtactcatccaggcaacaaagtgagactttgtctcataaaaccccaaaaccaaatgtagtagtgtgctgtagggtatataccagcacggagtcagatcattaatgcagaagtacagacaaaaagaaaattaatggaattagttataggcttatatggaggaagcatggatcagaacagacaggacacggataaatctaatacctgaaatggatctccaacaggaa

SEQ ID NO: 509415 - DNA, 293 bp, Homo sapiens
tgccacatctgagttctagaatggggacataggagaagaaagcctctcatggactccgggagatggtcccagaagggagtctagctggtgcagtttccggctgtaggtaaggctggacgggatgagctcctgccttcttcctcctcctccatagccaagtcctgagagcttgaagcctgggccccgcctggggcctcctcgcagccctctccctcaccacggccgccaccgctgctgcccggctcgcctccaccctcttccaggggctccagcgggggcatcgataaacaccg

SEQ ID NO: 509416 - DNA, 405 bp, Homo sapiens
tctgcatcgctaatccttttagatatgaagtccacacacatattgttagggatggattggggatgaagcagcctctttgcttaattacattgtgaaccctttccctatgttgagtttcaaccaagaatgcaataactagcatcaaacgattcttctgccgttcttcctttctttctcttttattctctcttcaccttccccttgctgttccacggcgtctttcactttgcgaggctggaaccttggtggatatttctgcatgtggatttgccactgggtgaagtggccgttgatcctgttccttattgactggttccttatcattgagcaaaagcgagaaacacatattcattttaaatgtgtacctagagttctcacgttattgcctgggcctactacattaac

SEQ ID NO: 509417 - DNA, 107 bp, Homo sapiens
cgtacgaggtctctgtatcgctcccccgtgactgcaccgcacggcctgctccagcttcccgagtaccccacctgtctctttactactgatcgctccccccgccccac

SEQ ID NO: 509418 - DNA, 1011 bp, Homo sapiens
gaaggtggaagaaggtgggagaggccgatttgctaagtcttccagccttcatctttctcccgtgctgcatgcttcctgcccacgaacatcagactccaagttcttcagctttggggctcttggactttacaccaggggtttgccaggggctctcaggccttcagccacagactgaaagctgcactggtcggcttccctgctttcgaggtttgggactcagactgggcttccttgttccttaccttgtagatggcatatttggagagttcaccttgtggatcgtggttcttgtcaggaatggctggtccccctaaatcttaacaatgacatttctgtacctatctacatgatcgcctgcagataaatgccttctgattggttggcacaaagaattatgcaggattaaaaacttcaatgaacaatatctcccttctgttagggctttagaaatcacggtagtatcggtggaactgtacccctcccagaccccaattcacatggtgatgttctaacccgcagtacctcacaatgtgaccttatttggagataggcattctttacgaggtaatcaaggtcacacaatgagggtcatagggcaaggcctaacccaagatgacaggtggtcctctattgagacaggcgggaattggacttagaacacaaccaagggacaatctgttgaagattgaaccagagaccggatgctgctcacactggcccaggacacagagaatgccaaacaacactaggaatccgggaacgcgggaacagtgggcccccacaggccccaaggagctacactggcaaaggggatacgaactaaccaccccaagtgggggcgaaaggggtacgaccgcatgggcatgacgaccgcgaaagaaaacgcagagcgagggggccccaaactcgggcagacgggggaagatatatgagagcagaggggaacaggcgccgtgctcctctctaactgacctatttgtttccatcgagcagcgataaacgcaagcacaa

SEQ ID NO: 509419 - DNA, 270 bp, Homo sapiens
taccccttttatttttttccccgcttccccagtttttaaacattgggcgctatttactcagctcccccgtagggcttgaagctgccctttttgaaaagttggtatggggtacccctaaagtagggggtttgggggggttttccttacctggttatgataaaaatgcccatcaaaccctttccccgttttttcctgtattccggatcagattgcaaaaacggaatgtttcttttttttccgccagggatttaaatgcctttttaaattcca

SEQ ID NO: 509420 - DNA, 1089 bp, Homo sapiens
gtagcgactgtgcctgtagtggagcgcttcctcctccccgccgcgccctcgccatggcctgcgcctggccccgggcctcatctcgtgtgttctcgagttcccagtgagctgggtgctggcgcgtagctgcagctgtgttgtgcccatgctgctgcatgcatgcttgcctggcagtggtgccctgctgccctgtttctgctgctctgtgcttgtctgtggcgtggatgcctcagtctcgattgctatgccctgcgacgctaccctgcctgcctgtcgccacctgcacctggtgccaggctaggcttaagcgctgctggcacgcttgtggcttcttgcagacgatgcgcactcgtgcccgttcggagtcacgccgaagagcacagtacgtgctctacccgggacgcatctttcctctccaggactgccggagtcccaggaaagccaagggtgaatcacgcattaagcccctggagcttgccttgttggacggaggcgtgcttgaagtgactaacgccaagaaagcttgagcaccacggcagttccaagtgggacctccagtcccggttattacgacctgctgaatcctggtgggtgggccccgactggtcacacgcgtgctcacttcgttcccagaacagcccgctccttacagggacgctgggacgaaccgatatggggggttcccagtcgagttgactcccccgaggaccaccgggcaccagagggtgttgaaccgctcgacggctagcatgtccgtgagagttgcgggcacggacaactgtcgatctatggtgggcagagctggagaacagggcgacggcaagggatgttgtcttcgacaggccgcgattatttgtgacgggaccgaaggaagtgacaacaaccccgggttggcgccggcacggacacgttgggtccagtggccccccacacgagccgggggcaacacggttggtgactagcgatatactatggcactcaagcggcgtgggccgcacgccggcctaccttcacgcggttgcccgttttgaggagtgccgtacgcacgagtataggtaaggattgcggcagcgatggtgactcctgcag

SEQ ID NO: 509421 - DNA, 620 bp, Homo sapiens
gcgccagagacgcagccgcgctcccaccaccacaccaccggccctcgttcgcctcttctccgggagccagtccgcgccaccgccgccggccaggccatcgccgccctccgcagaccatgtacagccaggtccgtgtcctcgatcctcctaccggcaggatgttcggcggcccgggcaccgtgagccggccgagctccagccggagctacgttgactacgtacacccggaactacagcctgggcagcgcgctggcgcacccagtagccaggcgcagacctctacgcctcgtaccccgggcggcgtgtaatgccacgcgctccatctggcgtgcgcctgagagagccagcgtgcccgggggtgccggctccctgcaaggactcgagaggactatctcgctggccgagcccatcaacaccgagtgccaaggaacagcccggcaccaaaacggaggacgggtggaagcttgcagggagctggcactgcaccgcgatcgcaagtacgtcgcccaaggatgcgcataccctgggacgcagcaagctacgaatcctgctgggccgagcccgaagcagctcacgggcccaggcaagtcgcgcctgggggaacatcaacaggagggaga

SEQ ID NO: 509422 - DNA, 755 bp, Homo sapiens
ccagaggtttcgccaaggtcacccctctgacatccggcctgcttcttctcacatgacaaaaactagcccccatctcaatcatataccaaatctctccctcactaaacgtaagccttctcctcactctctcaatcttatccatcatagcaggcagttgaggtggattcaaatccaatacccatactacacaaaatcttagcatactcctcaattgacccacataggcatgaataatagacagttctatcgtacaaccctaacataaccattcttaatttaactattttatagttatcctaactactaccgcattcctacatactcaatcttaaactccagcactcacgacctctactactatctcgcacctgaaacaagctaacatgactaacacccttaattccatccaccctcctctccctaggagggcttggccccactaaacgggtcttttggcccaatagtgggccattatcgaagaattcataaaaaataatagcctcatcatcccccatcatcatagccaccatcaccctccttaactctacttctatctacgcctgaatctactccacctcaatcacagtatccccatatctaacaacgtcactattacaattgacagtttgaaattaaaaaaccagccattcgttcccagactcatgccttacagcgtatctactgattccttttatatgataatctttaaaaaaaaatggggggcggctaatatcccggggcccagtgggccgttg

SEQ ID NO: 509423 - DNA, 915 bp, Homo sapiens
gatgagaagttgcaagagaaggcatggggtgcagttgtcccactagtaggcaaattaaagaaatatacgaattttctcagaggttagaagcagcattaagaggtcttctcggagccttaacaagtaccccatatctcccacccagcatctagagcgagagcaggctcttgtgctaaacagtttgcagaaattcttcatttcacactcgggtttgatgacctcaaggatgacaaatcctgccataacagaatgatccagctataatagaagaacatggagtcgtatgaggataaccaatgtaccggcagaaggagaaaagtgagtaaattaatgattggcgcaaatcgaagtgtcttggtataatgctgaggcaatccaatgttgaaaaccttgagttgatgccaaacaaaaattttgtatcagagaataaaaatgtttaccaagtagaaaataccacagaatggttttacgcacaatggctagttgtatgcagagtcatgtggaaacaaccggaatacaggaagcagatttaccacacttgaaagagacacgtgtcatctgctatgagggataatggggggggtcataaatactcaatgaccacgtacatccaggggaggcattttgttaaaaatttccaaagatggtatgaaaggttggaatcaaagttcttaaggaccaacctcataattagtggggaaggtcttctaaaatgtctaggtaccacaaacattgatgtggaatacttcaggaataatctggtgatacaatttgtatagagctgtgtggacaaaaaggtttgaaggggaaagcgtagggtggaaaaaactaatatgggaaatagtgggactacatataaatgttaattttgggaaagacgacggagtatcatcaggcagagggatgtgggcgaaa

SEQ ID NO: 509424 - DNA, 141 bp, Homo sapiens
acctctttactcaacctgaacaggcacaggcaaaggcagtcctcccacctcagcctccagggtagcttgagtctacaggcacaatgccaccacatacctggattaaattagtatatgccagaggtttcaccaattttagtc

SEQ ID NO: 509425 - DNA, 112 bp, Homo sapiens
  misc_feature (17)..(17): n is a, c, g, or t
  misc_feature (89)..(89): n is a, c, g, or t
  misc_feature (91)..(91): n is a, c, g, or t
aaggaagatgaaaatanaagtaaaatttacaattttagaaggagacaattcaattttgtttaaggatatctataatgacacaggataananaccatagttgacttactgacg

SEQ ID NO: 509426 - DNA, 214 bp, Homo sapiens
tctcttccaaatagtgttctgtttctctctgtttgtcccctcttgcctgtgttcttctggggccattgtgctttcggctgtgtgcattaataaatgatgtgtatttaatatagacctgcttgcatgggctgatgctcctctaatacccggaagttggattcaaccacccataggggtggtcataggcgaatggccatatagccgttggacaaat

SEQ ID NO: 509427 - DNA, 394 bp, Homo sapiens
cccagaactttgtcctcagagcacagtttaatcaggccaggcatttccgtttcctcccattgggcctgactttgcactcgggtttctcacagtccctcttccgacagcttgtctgctgcagcttatattccagcctcacaaatattccagctggaaagggcgtgtccacggcgctctccacactggtctcctggaaggccctctgcacgggcgggtgcttgtaaatctcctccagggccacttgcaggcccgcggctctgggcttccgtgagctcggcaacgcaagcccaggcaccacccaggcacagagggatcagcagctgtcgcatgcttccgtgtcactctgggcgtccttccgtgcgcctagaggtctcccctgagcgtcccacatctg

SEQ ID NO: 509428 - DNA, 188 bp, Homo sapiens
ggacagtgcgtaggacgcacgcaggtaccgcgtccataaagtgcgcatgcttgagtaccgagtgggaaggctcgtcaatcaagggtagttcacattgtggacgctgtcgagctttggccaggctcagaaatacgccacatccgacacttctgcatccagcacatcctgggccaacgcccaggcgcgat

SEQ ID NO: 509429 - DNA, 1830 bp, Homo sapiens
  misc_feature (943)..(943): n is a, c, g, or t
  misc_feature (1147)..(1147): n is a, c, g, or t
cagcaggcatggcggctgggtgctgctcagacggcttctcctcctcctcttgctcctccagctcctgctccttcgccggtgatgtgcctgccctgcctgatgtcctgcgccatgctgccgatgtgcatgcctcgctgcgccccatccctgtcccgccgtggcactcgtgatgtggcagctgcgcctgtgagtgccaaggttgcccctgcactggccctggctggtgctgagcagagctctgtggcttgcagacagcccctgccgtgctgtgcagctgcacaggcaaacttttgagaggacgtgcagatgcatgcatgcacccagtgcaagctggccggcaagcaggctggcaaatatgacccccattgagcatcagaggcgtacatacagtaggcatccattgtgtgccatgcgttgtgaggcccatgggtgtgggacccttgtgggggctgcctgattggctggttgcagcaattagctactgctcacaagggacaacaacacacacaggggaactagcactttacattggcacaaacttcacagaaccactccagattgcactccactgggagacccaacagggctggcgcatgcgcgccgaacacgaaaaggccttgggctcacacaccgtcgacgcggtggcccccctaaacggcggcaacacagcctgtggggatccttaaccaacccgcaatccagaaagaccacgcaatcggcaacaggaatttggtacaccacggacagcgcccttacacaacgcaaacagcgaacgtcgacccaccacccagatcggtttcgccaaaagataaacccaaattaccccaaaagcgaaccagtggaacacacagcctttttcacccatgaaggaatcagctccaattccttcgacttggtgaccccacttctcacaacggcacttgaggggactgctgcgtttccnacacccagaacaggttaaccacccagagatataaccctatcggcatttggaagcacacggtggtatccgagccaggattcattaatttggacagtggtggccagcacacgcaattgggtacaccacacagagggagcagccatataggatgagcccaaaagcagccttactcccgcgtggcggcaaagaatcgcgtctgggagngaccccccaagacgtccaacaccactatccatacacaccagcgacgtggccaaagcggcagaggactcaggacaagcgtaactcagcggagctcattccgacgccattggcgaggatatgagaaacccatggacacagagagtacacagcacacacggagcagacacctaaccccatggcaccttcgagcatatatggggtagagcccatttcccaagcgaaagcacacacataggtcctacactagggacccagacaaatgccgaccgccacaacactacacggcgagaaccccaccggcgcatgaccccgaagcccaaacaacagctgaacagcccatgcgaatcgcggcgacaacgggatgggggataacggcgcaacggcgtaccccaacgtccaggtgtgacgccccctctgacaataccacgaccccgacgggacggacagagaaacacagatagaaccagacgacacgccgaccgacccgaacgaaccccgacacagacgcgaacaccaccactgccagacgaaccacgctgaagaacgcgagagcagactgcacgagcagcagacgacgccacaccgccgcacgacgacacaagctgcgacgctgacgacagaccacacaccacacatcatacgatagatacacagaaccagacagaaacacgctgaaaagacaa

SEQ ID NO: 509430 - DNA, 152 bp, Homo sapiens
tgacgtagaaggccaatatctagaaccaacagcagtctgatgagatcactcaggccagccagtgacaacctattgctaactatgtctggagtgacatactcattgatagttgatgtcaatgacagctgtattcctctatgactgctgctgat

SEQ ID NO: 509431 - DNA, 212 bp, Homo sapiens
  misc_feature (149)..(149): n is a, c, g, or t
tgagacaagatctcgctgtgtggcccaggatggagtataatggcgggatcatgactcactgcagcctcaacctcctgggctcaagtgatcctcctacctaagactccaaagtagctgggactacaggtgcacaccactgcacccagctnttttgtttgtttgtttgtttttttaatagagatgaggttgttgaaggaatgattttgccaggg

SEQ ID NO: 509432 - DNA, 206 bp, Homo sapiens
gcacggacatgccaaagctaaaacacatagaggttcctgcacagactgacaacattagtaacggattaatcttcacagtttgtcacactcacctcctgctttaaggagcagacaaaaaaaacatatccaataagaacaagcattgaagatgacctgcacgatgatgcacaatcagatagaaactctggagaaagcccacaagcgca

SEQ ID NO: 509433 - DNA, 345 bp, Homo sapiens
cgaacatggtgaaacccagtgtctactaaaaatacaaaaattagccaggcgttgtaatctgagctactcaggaggctgaggcaggacaattgcttgaaccccggaagcggaggttgcagtgagccgagatcttgccactgcactccagcctgggcgacagagtgagactctgtctaacaaaccccgttttgtctgttggagacaagagtgcagcggggccatctcggctcactgcaacgtccagctcctgggcccaagcgatcctgccacctcagcctctccagtaactgggataacaggtacgcaccaccaggcccgactaatcttttttggttttttgtagag

SEQ ID NO: 509434 - DNA, 110 bp, Homo sapiens
ctagagaatccccgctctacactcgctcattactatcgtatactagggatcactctcgccacaatatctcagcatcaccacaatatacccagtgcaatcaaacactatca

SEQ ID NO: 509435 - DNA, 228 bp, Homo sapiens
tttttagttgtattgatcatttttattatcactgtgatcaaaatgactggagaaacatcttgtggaaagaaggattgattttggctcacagctccagagggatcagtctgctgtattgggaaagtcatggccgacacagcagcccatatcattatgaaccaggaaacaggaagctggcatggagtggtgaggggatgtgaacacgaacatggaagacaatgacttagg

SEQ ID NO: 509436 - DNA, 292 bp, Homo sapiens
ggggaatactcctcaacacctccaactctgtcctgaagggagcagctcccgggcaggacacaggtattcgacggactatgaggaagtgagacgagcacatttctatagtctgcacttggatcaaaagcaaaacagtctctccgccccgcaccagatcaagtagtaaggacatcaccctcactgaaaacttgcgcattcttcttaagttttctgccatacttttcatcacgcatgcgaggaaacgatttcgagtcaagcaagacttttcatttatgcaacctcttgaacagga

SEQ ID NO: 509437 - DNA, 562 bp, Homo sapiens
agatcgagtctgtacccggtcccatgaacagttcggtcccctatgcacaggtttgagagagtagtggttctcccagcacgcagttggagatctgagaacggacagactgcctcctcaagtgggtccctgacccctgagtagcctaaatgggaggcaccccccagtaggggcagactgacacctcacacggccgggtactcctctgagacaaaacttgcagaggaacgatcagacagcagcatttgcggttcatgaaaatccgctgttgtgcagccactgttgctggttatccaggtagacggtctggagtggacctctagcaaactccaacagacctgcagctgagggtcctgtctgttagaaggaaaactaacaaacacaaaggacatccacaccaaaaacccatctgtatgtcaccatcatcaaagaccaaaagtagataaaaccacaaagatggggaaaaaacagagcagaaaaactggaaactctaaaaagcagagcacctctcctcctccaaaggaacgcagttcctcaccagcaatgtaagacagctggttggaga

SEQ ID NO: 509438 - DNA, 82 bp, Homo sapiens
gacagcagcttctacatctgcagtgctacccgggacggctcccacgagcagtacttcgggccgggcaccaggctcacggtca

SEQ ID NO: 509439 - DNA, 335 bp, Homo sapiens
  misc_feature (54)..(54): n is a, c, g, or t
gcccatattacagaggttaattgtaagaaagcaaagaataaggccggacacagntgactcagtgactcacacctgtaatcccagcactttgggagcctgaggcaggcagatcacgaggtcaggagatcgatatcatcctggccaacattgtgaaaccccatatctactaaaatacaaaaaattagcctggcgtggtggtgtgtgactatagtcccagctactcgggaggctgaggcaggggaatgcttgaacccgggaggcgtaggtggcagtgagccgagatcatgtcactgcactccagcctggcgacatagcgagactctgtctcaaaaaaa

SEQ ID NO: 509440 - DNA, 143 bp, Homo sapiens
  misc_feature (99)..(99): n is a, c, g, or t
  misc_feature (123)..(123): n is a, c, g, or t
ccggtttcgagtcgctgacctgcagcttccctgtggtttcccgaggcctccttgcttcccgctctccgaggagcctttcatccgaagcgggacgatgcnggataatcggcagccgaggaaccngcagccgaggatccgctccg

SEQ ID NO: 509441 - DNA, 154 bp, Homo sapiens
gcttactggtaaatgaatcgaggcacggagttgatacgggtgtacgggaattggacagctacacctggttgaatgtacacttgtttggggccaacaccgtgtacggtggcctcgcagtgcgggcctggatgtcggagcgcggaccttcgcccct

SEQ ID NO: 509442 - DNA, 371 bp, Homo sapiens
acgtgcttgatggtatcgtttcgtgttagatatagatgaagtccaattatttattttttctttggttcttcatgcttttgatgtcacttctacgaaatacttggccaatccagggtcatgaagatttagctatgtatcaattcttttttttttctttttttgagacagggtctcactctgttgcccaggctagaatgcagtggcatgatcatggctcattgcagcctcaactcacgggctcaggtgattctcccacctcagcctcccgagtacctgggactacaagcacacgccaccaagcctaattttttgtatttttggtagaggtggggtttcgccatgttacccaggttgatcctgaactcctgggc

SEQ ID NO: 509443 - DNA, 117 bp, Homo sapiens
cttagaggatccctgagctgaggaggagcagagcaacatggatgctgctcaacgaccgcttccgcaagaccactctacaggtggacacactgaactgccgagctagcagccgagcgc

SEQ ID NO: 509444 - DNA, 276 bp, Homo sapiens
aaaggggggcccccccccccggggggggtccccggggcccccccccatttttttttttaaagggggggggggggggggccccccccgggggggccccccccccgtttttgggtttcccccctgggggggtgggtgggggaatttaaaacccccccccccccaaatttttttttccgggggggcccccccgtttttgggcccccccctttcccgggccttggggggggtgggggtttcttttttttttttttttttaggggggggccccccttttta

SEQ ID NO: 509445 - DNA, 162 bp, Homo sapiens
gctggggggctcatgctctgtgcgggtggtgcggtagtggattatggtttcggcggtggcgctggtggtggctttgtggctcggtggcggcagttggcttctggcaggtggcttcgtgtggccctgtgctttccgtgtcttgccctacctgcaaggtatcca

SEQ ID NO: 509446 - DNA, 115 bp, Homo sapiens
cacccgagaattctctgccctgtacaaagactccctttggccgtaaattaagagtcgcttgcgttgtgacagaacgttcaaagcggggctcgggatctcggattttaccagccct

SEQ ID NO: 509447 - DNA, 296 bp, Homo sapiens
tttttactagtatcaacatcacaagataaaacactctggtatcacctgcccatatctaccttagtcgtcacccaagacatttgactactgatgtggttaattagataacttttacttgctccactttacaatagttttgtattacctacatcttattaccttgggacacaaaagtggcagcgattgttgagagctgatgacaataaaaaggagaacactagaggaaatgagactagaaagaaagccaaagctgattttccaactctatgctgactccaacctacagtacaaagccg

SEQ ID NO: 509448 - DNA, 387 bp, Homo sapiens
caatggcatagttctaaatgctgaagctgcagataaaggactttgacttacagaatccacagtgtccttcatagtctttatcaactcctttaaatttagcatgtttcctggccaggtgcggtggctcacgcctgtaatcccagcactttgggaggccgagacgggcggatccgaggtcgggagattgagaccatcctggctagcacggtgagaccccgtctctactaaaaatacagaaaatcagctgggtgtggtgccacacgcctgtagtcccagctactcgggaggctgaggcgggagaatcgcttgaacccaggaggcggaggttgcagtgagctgagatggtgcccctgcactccagcctggcaacagagcaagactgtctca

SEQ ID NO: 509449 - DNA, 150 bp, Homo sapiens
cagatccctaccaggacatcaatttccttcaattgaatcccaaataccttctccaaggaatagcctgctcgttcaatgattctaggggtacacctacagtgtattctattgattgatgtaccttcagacagtgtcctgagctgcattgat

SEQ ID NO: 509450 - DNA, 373 bp, Homo sapiens
atacattgttggaagtgcctgtttctggcttctggctggaggctcacttcccagcctggcatttatttatgagaaataaagctctcctttccaaataaaaaaattttccatcctggctaacacagtgaaaccccatctctaccaaaaatactgaaaaattagccaggcatggtggaacacgcctgtagtgccagctactcaggaggctgaggcagggagaatcacttgaatctgggaggcagaggttgtggtgagctgagattgcaccattgcactccagcctaggcaacaagagcgaaactccatctcaaaaacaaaaaagtaccattgagaggcaatgcctttccccagatgtctacttttttatttcttc

SEQ ID NO: 509451 - DNA, 404 bp, Homo sapiens
  misc_feature (273)..(273): n is a, c, g, or t
  misc_feature (325)..(325): n is a, c, g, or t
  misc_feature (397)..(397): n is a, c, g, or t
tttcttacggtgaccttagggacgaactgggcaggtggaacctcttcttcctcgtcctcatggtcaggagcaccaagagccaattccagatcgggatcgatggtgatggctaggtggatggctttgtgaaaatggtcagagaggagttcttctagttcgtaacgcatctttgattcaagacggtcacgggcaaattcgttgtgaacggcaaccatcgccgtagaagagtgcatccgcaccggcgtagtgttggataaccacgcgcgattaggnttcgaaaccttcgcaaggatgttggcccagcttcattgaaggccttagaggngagcatcagcgccctcaagggccccagctcggatttttaaacaatggcatactgtttccttggtgaaaatcnctctttg

SEQ ID NO: 509452 - DNA, 185 bp, Homo sapiens
acagctgatgaagtaggacagagggaaatcctgaagcaatagacgatagctctgctagccgacattctgacccggttgcaaagaggctttcttgcagaaggggtagattcttgcatactgtagtagatcctctgacccagccgccgacaacgctatgcgcacgtatgaaacatttaccatgctag

SEQ ID NO: 509453 - DNA, 987 bp, Homo sapiens
agagcccgcagcacatcctctgagcagaagatggctgtgccccccacgtatgccgatcttggaaatctgccaggatgtctcaccaagggctatggatttggcttaataaagcttgaatttgaaaacaaaaatctgagaatgggatggaatttacaagctcaggctcaggccaaacacttgagaccaccaaaagtgacggccagcctggaaaccaagtacacgatggactgagttacgccctgcacgtttatcacagagaaactggaataccgaccaattacactaacgcccccggagatacctgtggaaagatcagcttgcccgtgcaccctgaacgctgacccttacgattcatccttcttcacctaaacacaggtgggaaacacaaaatattgctaaaaatctatggaccaggtaacaaggcgggagccaacataaacgccgtgggctgcgaaacattgtgatttacggacaatttgcttggtgccttccataccggggatgcctctggatgcataggatcaccaaggcactgggatggccgggcttcaccaaaattgaatttggagaccggcaaaacccagagttgaccccagaagcaaatttgacagttggctacaagactgattgaatccaagttccacattatgttcatttgccgggaccagcacgttggggggtcccattttaccaagaaaggttgaacacaaacaggtgagaccggttgcaatctgcctggaacggccgacaacttaacacgcgctcgaatacggcgccaagtttacagttgcctggcccgtttctcggtaagggaacatcccggctgaaggtaggataaacaaaattaagccggttaaatactggtcttttgtgcagagcgcatgctggccagctgtcttgggctacgcaaaactgacaggatacaatgggaaccgcaacggatcaggtgtgacatattaccgcatgtcgatcgcaaaaccagtgaga

SEQ ID NO: 509454 - DNA, 1508 bp, Homo sapiens
  misc_feature (1436)..(1436): n is a, c, g, or t
tattttttttttggaaggaacaaaagcacagatttattgaagcaaaagtacattccaaaaagcggaataaggctcaagcaagtgtgcccgtgggttaaaaaactcgtggggtttaagttaccctttataaaggtttccatatatgggtataccacccttttgttaaaataaaacattgtgccgtgccaccagttcaaaggcagtgaaggtaaagtgctcctttgtgtcctccagaacaccatattactcgtggccctacaggggaattccttactcacttaaccaaaaaatttatttatttatatttttctctatattttttatatatttaaacaaacaaatccccgtgattctataaaaaatattttataaaatgagaagccgcggggcgcgcgggtgcatctcaagcgcccgtgttaactccacaagacatcattgggggagaggccaaaagaacgagggcggaaactcaggcgaggttaccgaggaaacctcaaaaaacccacatcctgtgggtgttagtacaagcggggtgaaaaagcgccccacaagggctacttcacctataaacacaaagcacaagatattagaacaacaacaaaatatttggggctatggtgagaaagagatgtgtagtgggcttgggcgacccaccgtggattagacgcccacatggatataactctagagagaacgggctcatgcaaaccgacaggagaacaaaaagatgggcacaacagaaaacccccgggacgacaggggagtgcagcccttctgaccagcggagacgagcgaagaaacactcgcgcgacccaactcatgtacgcaccgccacgcacccacagggggagacaaccaggggtgtcgacaaaacctccacaaaacgtacacacaacaacaaaaacgaaaggaagctaatcgagccactagaaggcccaaaaaattttgcaccccccgaggaaaaagagagttacacggcgagagaacggtgcaacagatgtcacagagattgatacaatgagtacggagaaggagaacgaggagaaaaaagaaagaagaggccattgccagaaaaagaaccaacaacacagaggcgcgaccacccgagggggacaaagcgagcacccgaggcaagtaatgaaatgatgacgaaaaaacggggaaataacactactgcaggatgatgaacacgcaaggtgacgcgaacgccactagcgagcaccaaggaacgcggcagccccacatacgtgggcggcaaagcagaagggcgcagacaagacgaacgggaagagcaagcccagaaaccacaaacatcgaacgagaaagcagcagagaggtagagccaacaagccaggagccgggagcagcaacgacacgacacacacggcgagggaaacaccgggaagcaaacccaccgaccttcgtaaagtaacganagaactacaccacgcgagggcaggaggcgaaagaggaagaggagcagtagcagcaagcgcgacacggaaagg

SEQ ID NO: 509455 - DNA, 387 bp, Homo sapiens
cattctaagaaacaaacgagtacccatgttactttcctgcattagctaattgcttatacagataatgaagacatgaaagaaaacggagaccaggagcggcagctcacgcctgtaatccctgcattttgggaggccgaggtgtgtggatcacctgaagtcaggagttcgagatcagcctggccaacatggcgaaaccccgtttctactaaaaatagaagaaattagtcagttgtggtggcgagggcctgtaatcccagctactggagaggctgaggcaggagaattgcttgaaatcgggaggtggaggttgcagtgggccgtgggctgagatcgcaccattgcactccagcctgggcaacaagagcaaaactccgtctcaaaagaaaa

SEQ ID NO: 509456 - DNA, 213 bp, Homo sapiens
acacggtggatgtataaagaaaagaagtttaactgactcacagttccacatggctggtgaatcctgaggaagcttacggggcatggtctaaggcgtaagataacacacggcacgtcctacatggcagcaggataagcagcgagagcagacccaccaaacactcttgtccgtgaatgacagaggcatgtttatccgaaaccagccgtccgtccg

SEQ ID NO: 509457 - DNA, 254 bp, Homo sapiens
gaggctaaagtgaatctcttttaactagcatatagttgcatctttaaaaaaatcatgcctgggctcgttggctcacgcctgtaatcccagtactttgggaggccaagtcaggcggatcacctgaggtcaggggttcgagactagcctggccaacatggtgaatactgtctctactaaaaatacaaaaagtagccaggcgtcgtggtgcactcctgtagtcgcagctacttgggaggctgaggcaggagaatcgc

SEQ ID NO: 509458 - DNA, 271 bp, Homo sapiens
atgtatgtgagttgggttggggggatggcccgatgtagacgttcttagttgagtgtatcaaaagggagctgctcgtgtggtagtctcgtgtggattggcatgcgtcgatatttggattgtgtttgtgtagtataaaggggggacccctcgccaaaactcaaccagtgggctacctttcattagtctcattaccccgccaccctcctcctccactccatctccgaatccataactacgatctacccgctggccactcctgtaccacaatccc

SEQ ID NO: 509459 - DNA, 831 bp, Homo sapiens
ggcagggccgcgcacgcactgacggctgaccgccatcttccctcccgaggcggcagttccaggtgcaagcgccgggtttgctgcccgctgggcgcccctgcagcggcccgagctgtggccggcgtggatgaggggcaggcgaggcagggccggccctccagtattgccgcccctcccgccccagggcagggctgggagggtacagcccgggggcgggctcgggtcgcctcccggaccgccgcgtcctcgcttgcgcctgtgccccgacagaccggcatgcttccgcggtgcggcagcttgcaccggaacatgggactaggctgccaaggatcgttccagcttccgaaggcgacttcagagacagcggaccaaggtgtcccttgggcggcagcgagcaggaagtattgccatccaaagaagtgcatggatcgatgtgctaccttgtcacagtccgggggcgcttttcgccgattgctaactgggccaaagcttaccccttaaggtaaggcaggttctggtagtgtaacaaagcaaagatgaagactcaaaacgtttgatatggctgtatccagaagttaattagacacagctctctgttggtcaagcagatggatggatctgagagacttacatgcttatttcagataagaagatcgatgagcgtatgtggaagttggtggcaaaatggtaatgatgccagttgaaatgttggcattcaaatgagaatgcttgaagtatagaagactgagaataattatggctggtgaaaagatgctagctatgtgatgtaggaatgaaaaattggaacactgcttcaaaagggtatatagg

SEQ ID NO: 509460 - DNA, 359 bp, Homo sapiens
cacgcgtcgcacgcccgtgggctgcagttggaacgatggcggcggcagatgccgtagggcctagcccggggtctggacctggggactcccagaagggcccgagggggaggctccggagcgtcggcggaaggcgcacgggatgctgaagctttactactgggctctcggacaggggaggcggcgggagccccgctagtgtgccgacacccctgtggcagccgactgatctgaacggggcgcacttcgcaccggaagtttactagaaagctggtagagagtgcctctggccagttgatggacagtgagaccggacattggtgcggcagatcctgggctctagaaagcgacatgccagaccc

SEQ ID NO: 509461 - DNA, 329 bp, Homo sapiens
gggggccccgggttccccgccgccgcccgccgtcccgcagtccgcagggcccttgcctgcagacccgttgttgtccttccacctggatttggggccctccatgctggacgcggtgttgggggtcatggacgcggggcgcccggaggcggttgccgccaagcccgacggggaaccccgccccgggaagcagcccccccaggcccgctgccgccccaacggggacctcgagttgaacgaggtcatcggcctttaggttccctcattccccgggcccttcccgcccggcaccccatttttgtaaacataaacggccaaggtgtgtgcccgga

SEQ ID NO: 509462 - DNA, 104 bp, Homo sapiens
caagaacaaatcatgtctttgcagcacatggattgagctggaggcccattatcctaaacagtactcaggacggaaacaatatgctgttgtcctatagtaggagc

SEQ ID NO: 509463 - DNA, 801 bp, Homo sapiens
tctccgctcccagacatatgtgtccctacgcgcttcctagcctcggaagcgcagcagcaggcatatgtaggtgaaggtgaagagcttccctaaaggatagacccataccaagccggtccacctacacagcctatacctagggataacaaggctaggcatagactacacatacgtagcggtgaagtacgacatggccgcggataccaaggctagaacaagcaaggcaggtaggtaggaggctagtagaccatatagtaacgagcacaccatcccataggtaggttagtagggcatatcgtagggctaacgtaggaaacccctacgaggcctaccggcacctatacaagactagtactatatagctagaagcacatacagctagatagaatagccatacgcacggccgtatctacgtaataaaagcaaactatagggcccactaacacactacctaacacgccacatgcatatgcggccctttatacacctaaaagctaacccttagccacacgtcacaccactcgcggcaggcggcactagcagcgaatcgcggccacagcaacgcaaggccttaggcaggcacagcgaacctctacaagcccagcgccactagacacgcaaaggtaactatgcgcaagtacataccgtagtacatatagccgcacacccgagatagcggcctagctatacctactagcgtccagacagaaggcccacctagataggagatccaggtagaacggaggcactgtaggccgagaagctaggactagggcccgcgagaggcttgagcagcaggta

SEQ ID NO: 509464 - DNA, 156 bp, Homo sapiens
ttgcagttaatacatacagggctagtgaagggcttaattctaagttgtagggggaggcaagctggggaggagtcagatcagatattttcctgcaaaaaaaatgaccctcttggcagcatcaaaatgtgggtgtccttgttaaggaattgatcgtgg

SEQ ID NO: 509465 - DNA, 449 bp, Homo sapiens
accatctgcagtggagaggaatatagacaaaggtaaagatgcagcgttcaatcattcctgcccatggttaactggagcacatagtgtgacatgggtttctgagtaaaatgtcttaatcatccctgtggaagcaatttctctctccagtaaattgcagagcatggtaacgagtgatctctcagagttcttgtgtaccttccctccttcgtgttgagtccagtaacgtaaaccttgaataacaccccgggacccacacgaagtgccacaagggatgttgcaagtgccccaagaagcgggaatatcacagcattgccaaaaagctgaattgtttgctgtgcaccacagattgaggtctgcagcgtggttgccaccatttcagaccattcatctcataaacagatgatgtaaacttatggtgtcaataaatacagtgcagtgctctaagtaaa

SEQ ID NO: 509466 - DNA, 931 bp, Homo sapiens
actacttctagatcgcagagttcctgattccaagtcacctgtgctttctgggagccaaagaatggtgcacctgcatggagtccgggcagagtcgttcctacagttgtattgctactaccaggagctcaccataggcttgctgagtcccagtaggaaggctcgagggtctgtgccaggccatgttcaggatggctgctcagtaaccgttcatagacctctcttgtcaatgtctgttgtgtgcccctattgtactgtcaaccatgcaaccagcgttatggcttggggaccaggccctcctctgggaggagccagaaggtagtgagagaggaggaaggggagtaggcagtctttgatagggctgcgtgaattgtcactttcgcatcatgcaagtcacatcccgcccttttatttccccaaattgtaaatgaaagagttctggcaactgtggaaacttcagtccctcaggctggcgagccatgccagtacctgtctgtggggtagggagggtagcctgagcagacatgaatgcaggctgaaaggcatgagtgggctccatggtactgtttccagatcccctcactgcagaatggttaagttcgctcccttacacattcgacccgtttacgcgaaattcaatcctaaagctaataaaaagcagttggttcattactttgagaccaaaaggcaggaacagcatcttaagacaacgagagagaggaaggttacaccagtgtcacgagaccaccgggtagcacgatcatgagaaccagggagaaggggggcctggaaataccacaccggagataacgcaaaggaacgaccaaccaggaaacaaaaagcggtcatagcaagccaacaacccgggaagaaaaattacaagacgcgggcagaggaacgcaacccgaacgacggcagacagaacgacaacata

SEQ ID NO: 509467 - DNA, 538 bp, Homo sapiens
aaaccaagatatgcttagaggcttctgtcacggttctctgccttgtgaaccccagacaatgagaatggttgtttcccaagtataaacatgaccagctcactaattggttgtttggcacagcattaaagtttatcctctttgcgcttactctggaaatttgtttctactaaataattcaacttttcgatttatgtaataatgtaagctagcttttcatgttcaagaaggtatggtgtccccatgagttattattcaacctcctggtatagcagttagtgttacacagaagactgtctagattctaaaaattttttcattgccctcatggtgaaaacatatgtgctgcgtcccctttgtgacatcaactaatcactgaggcagctgtttttgaatctttgttttgtgttatgaagtgtatcgtctctccagacttgatatatctgcaattttgggggttcgagagaactataagtttcgtttataccggttgtaacatgaacgcttattaaacaacgtactcctgaaaaatggtttaaga

SEQ ID NO: 509468 - DNA, 192 bp, Homo sapiens
cgctgtggcttgcgctgtagtcccggcctacttgggaggctgaggcaggagaattgcttgaacccgggaggtggaggttgcagtgagctgagatggtgccattgtactacagcctgggcaacagactgtgactccgtctccaaaaaaaaagattccagtttgttattttctatgcagaagtgcgcctgggtg

SEQ ID NO: 509469 - DNA, 537 bp, Homo sapiens
cagaggatcccgtaacggagattgtacatggttatatgtgtgatgctaaggttagggtatggatcccatcacccaagtactgactagagtacccaacagatagtttacaactcttgcactcccctttccttcctccctctggtagttcccagtgtctattgttcccatctttatgtccataagtacccaatgtttagctcccatttataagtgagaacatgcagtatttggttttctgtttccgtgttaattcgtttagaataatggcccccagctgcatccatgttgctgcaaaggacatggtttcgtttttatggctgcatactattccatggtatatatgtgccacattttctttatccattccaccattgataggcatctagttgattccatggcttttgctattgtgaatactgctgccatgaacatgtaagtgcatgtgtcttttttgtagaatgatttattttcctttgggtatatacccagtaatgggattactgagttgaatggtaattctggtttaagttctttgag

SEQ ID NO: 509470 - DNA, 891 bp, Homo sapiens
atcggtgttgcaggaggggcagctttgaagcccacgtattgttctgtcgcggatgtattagcgcccgtgatctatgctggcgatgataagcggcgactttcggcatctctatagaagaccttggagtgactgggcgtagcacttctaatactcctgtgtaactcatagagaaaagtgagcctctgcttgcggacaaattggaggaaacggtccacattatgatcagtcctgcgcatttacagtgtaataattcgataatttcgagatcgctgcggagctgaaattgggaatggtggttaacgccgctagttgttcgatgtcaccgagcccacgctctccacggcgtaagctagcaatcaggatcgtgcttgatttggcattagcgctgaactgatccctttgcatattcccccattaaattcaagaagtacccggcatttgtaggacagaccgccccgagatgtgcctgctttaaccttaaatcgccttgtgaggaattggtgcttccccagcgtcaataatagagggggactattagtccttggggtagaatcctaagttgtgattgcccttgggcgcccatttctaacgcaaccgtcttgagagtaaaagcaggtctctaaaaaggggtcgcaactatatgggaagttaggaaaggaggtaacctttgggccgtaggttgagagtttggtgtagaccaattgttgagtttccctcttttccggaagggaatggtttgtgagagaggttctaggtgaacatcctaaaggagttatgtggttcgcgaaagagagagcgggtcgagaaaatgagattggaggaaggggttgaagatgaaatctttaagtcgagaggtgatggtgtgcttattgaattttagagttagacgtg

SEQ ID NO: 509471 - DNA, 355 bp, Homo sapiens
tgcttggaatcccagcccagaccctcaaccagcatggcccaggacgggccacgtgctgtttcctcaggaagcctcaattttttcatttggagacagggacaatgaatcccttccaggatcactgtaaaagacaggttgagcatttttaatttgcaaatttgaaatccgaaatgctcccaaatttgaaactttttgagtggggacctgatgccgtaagtgaaagcccgcggttttttgttgtcgctgttgtttcacgggtgagccccctatttgctgaaatcgctgttttggttggtcgccctgaactccttattttccccctgtattaatggtatgtcaaactttttaccatgga

SEQ ID NO: 509472 - DNA, 973 bp, Homo sapiens
  misc_feature (37)..(37): n is a, c, g, or t
  misc_feature (65)..(65): n is a, c, g, or t
  misc_feature (82)..(83): n is a, c, g, or t
  misc_feature (87)..(87): n is a, c, g, or t
  misc_feature (91)..(91): n is a, c, g, or t
  misc_feature (110)..(110): n is a, c, g, or t
  misc_feature (121)..(121): n is a, c, g, or t
  misc_feature (138)..(138): n is a, c, g, or t
  misc_feature (141)..(142): n is a, c, g, or t
  misc_feature (164)..(164): n is a, c, g, or t
  misc_feature (197)..(197): n is a, c, g, or t
  misc_feature (205)..(206): n is a, c, g, or t
  misc_feature (208)..(208): n is a, c, g, or t
  misc_feature (211)..(211): n is a, c, g, or t
  misc_feature (214)..(214): n is a, c, g, or t
  misc_feature (220)..(220): n is a, c, g, or t
  misc_feature (315)..(315): n is a, c, g, or t
  misc_feature (350)..(350): n is a, c, g, or t
  misc_feature (391)..(391): n is a, c, g, or t
  misc_feature (400)..(400): n is a, c, g, or t
  misc_feature (447)..(447): n is a, c, g, or t
  misc_feature (589)..(589): n is a, c, g, or t
  misc_feature (597)..(597): n is a, c, g, or t
  misc_feature (644)..(644): n is a, c, g, or t
  misc_feature (685)..(685): n is a, c, g, or t
  misc_feature (747)..(747): n is a, c, g, or t
  misc_feature (819)..(819): n is a, c, g, or t
  misc_feature (821)..(821): n is a, c, g, or t
  misc_feature (940)..(940): n is a, c, g, or t
acacaccttcttcgtcagagtcagcggacgccctcanctcccaatgactatgtccacgggtgaancggaccgagtgtcaggnngctntgtnttacaggggtacaagtatnactgaagctgnacgagcccggaaaaacntannggaacccacaccacatcagccnggcccgtgcgctctaacgccttgcccagaagancccttcanncngtncantaactnttccatcgaccgcgtattccggaatgagaccctggacgccacgcacctggctgagttccaccagatcgagggcgtggtgcgggatcatggtctcnccttggcccacctcatgggcgttctgcgggagttnttcaccaagctggtatcacgcaactccgcttaagccagccnacaacccanacacagagcccagcatggaggtgttcagctaccaccaaggcctgaanaagtgggtggaggtcggaaactcgggggtcttccgtccagagatgctgctgcccatggggcttcccgagaacgtgtcggtcattgcctggggcctctccctggaagcgcccaacgatgatcaaatatggcatcaacaatatnccgggagntgggtggggccaacaaaggtgaacctgcagatggtgtatgaacagtnccccttgttgccgcctggatgccgagccgaggccccctccnacacaggaggctgcgtgacatgggccactctaggacaggtcatcctccccgagtccctgctntgcgctctctttgcatccctggccagtgaccttgtatttatgaggcctctgtgaggccagcccccaccttcntntttcccacctgtcccaggaccagaatcccagggacagaggactgggtagcaggttccttctgttgtcctgtgtggtgtgtctactgtgagggtgggccctgaggagacctgtggcgccncctattgtttaataaagtgggcagttgccccca

SEQ ID NO: 509473 - DNA, 794 bp, Homo sapiens
  misc_feature (423)..(423): n is a, c, g, or t
ccccccgcgcgttggttcggagcaaggcaacataatgcgacgacttggcgcgcgtcttgagtggagtcacaaaaccccgcggatagttcgcacgacccgccctctagtggcgaggtgcctcactcgagagcgagtgagataagagtgtcgcggccagggcccccccccaggtgtgcacacgacacccaccccctcgtcgggggagacaccacagggccaggagagagacaccacacgctgcgcttctcactaaagaggcaggaaacacacgcagacattaaggtcgtcgtagcgggacacactggagggcccagacaataccccttgacgaacatgcacgctgcactacacaccacgcgtaggggagagaagttcgcacacaatagaaagacacgcgcgtgctacacacacgccagtgcacgngtgcgagcgtggaccactccgcgcgtgaccaggggatgaacgaaaacacccctggcgctccctcccaaaccgcagggtgggcagacccagaggcgtgaagtatagagtagttggtaccaccaaaacagagacagaaaaaacacaagagaagaaaacaagatagcaaaaatattcaaaacaagaaggggataacaagacacggccaccaaaggggatccatgtcagaagcggacagcgaggacgccccccgagggtcctcgagcggggcactccgggtgtgcacgtccgccagcgcccggcggctgctccctctagatcaatgacaacgccagggagggcgacgtaccaacgcccaaacaaatgaccgcaaa

SEQ ID NO: 509474 - DNA, 755 bp, Homo sapiens
gcgctcattcttcctctcggtctacttcataattacattgtctgatttagtaatgtgattacacttaactgctagtatcatgttgctcaaaattaaacaagtgggtaattccataagttgattggccataccattgtcactgtattacgtgctcgatgtcattgcactcggttcatcgttccttctcaagcttagccttgtttgccatcttggaatatattattattcgatatcattatgttgccgaatgtgttacatgggagctgttgtgatccaacaagaaagtacaacaactcgtaagtgcgtcagctcgcaagatcacagcatgagagagtaagccattgatcaagcttaggtttccaacttgctctgcttccttcatgtatctttatcgtatgatcttagctttgattaaatgactgaatgctggagaatgccgtggcttagaatgtcgagcctagctactacagttgcatcagttgaggagcctgagactttcttaaatcatccttagaaccgtgaccatatgcgagtatatcttttcctcttgcgaacaaatagactattctttgctgtatttgtaccatattaagtcttgatgactcactaggtagtcgacatgggtccggcaaaaccgtgcgtgcaccctccagggtgcgggccaaagagcgtacccatggtggaatcgcacagtcctgcctgcccttgtttgttccggggtaatcctgcgctccctattgggggggatcgtccgc

SEQ ID NO: 509475 - DNA, 102 bp, Homo sapiens
  misc_feature (10)..(10): n is a, c, g, or t
  misc_feature (43)..(43): n is a, c, g, or t
cggcggtttngtaacaccccaggccgtgtaaggtttggtgttnccgtttcaagatccactttcagactttattctggctctgaaggcaatcctactttgggg

SEQ ID NO: 509476 - DNA, 184 bp, Homo sapiens
  misc_feature (80)..(83): n is a, c, g, or t
  misc_feature (85)..(88): n is a, c, g, or t
  misc_feature (92)..(93): n is a, c, g, or t
  misc_feature (181)..(181): n is a, c, g, or t
cagcacagcagtggctatcagcctttggctgcaagcatgttatactgataagtcaccttaaggtgtgaaaagaaggccannnnannnnctannagctgatccttcctccacaaccactgggaggaccaactgataactgtttctaaggagagcgtggacatataaccaggatgctaccacnaaa

SEQ ID NO: 509477 - DNA, 1025 bp, Homo sapiens
  misc_feature (1025)..(1025): n is a, c, g, or t
gggagatatatatataactagatatatatacacattatcttaagtgcatgtaggatgtaatatctaatgcactactatactgtataacatgttattcaaaaagggattgccatgttcgtgagacagcagtaacaaaaaaatgaggaaattatttgcttctatttatagcctctgtcaaaagtcaaaagactataaatgctttgcataacactggttgcacgttgcttaaatgcttcatcacagtcacattcaaaaatagtgactctaaagcaaagaagaaagcagcactgtcatcagatgcatgataaagccaaaatatgaaaatgggaaactgtttaattaacctagtaattgggtgggttaagtacatgggtgaattattatatgtgattataagttagtaagtaagtacagattaactgcttatatagccttacggaaagccttttacaaattaaagaacaaatagatgtgaatatcagttttaaaagcaatggaatcaatccaaaggaaataccgttataaagagagtttggatgtagcagctaagtacaggatatatggctcatgtttcaagcaagttcctcacaacattgctgaagtaaggggccaggtcaactggtagcttatagctaaggcaatgggagcaagtgaagagtacagataatcagaccttacaaaattccacgtttaactgacagtataatgctgagagacatgctttctaaatatcagaacgacgggcgaaaacggatgaactggcaactataaaagagaaattatacaaaaggaatagaaacacacacaggaaagagcggaagaaaacgaagaacgacgaaacgacgaaacaaaaaaaaccacaccgaaaaggaatcacagacaccgaaagaccgatgcgaaaagacacagacagaacaaaactagcaaagacatcacaacagacaccaaaacaaagaacaaacaaacaaaaaagccagagacacagcaccaacaaacacgagagagcaacaaacaacatagaagan

SEQ ID NO: 509478 - DNA, 553 bp, Homo sapiens
  misc_feature (306)..(306): n is a, c, g, or t
  misc_feature (507)..(507): n is a, c, g, or t
  misc_feature (515)..(515): n is a, c, g, or t
agcctgggtgacagcaagatcctttctcaagaaaaaaagtgaaaaggaggagggtttttaaagaattagtactacccagttgatacggtggaagaaaacttgaaaatgctaatgagaaacatgagatgtaatcacttgaaggcatatcatgttcttgaataagaagactcaacattattttaacaggtgttaattttccctgttaaactacatatttgtcataattacaataaaatacaaagagctattttggaactgggcaagctgtttctaaatgtatatggaaaaataaaaatgtctccaaanaatccctgcagagggaaactagcccttccagatataaaatatattatagaactgtgtaattaaagcaatatggtactggtccataaaagaacataaaaccaaatagttcagtagactcaaaatgcaagcgttggtgagggtatggagaaaagggaacccttttacacttggtgtgaatgtaaattagtacagacattgtgnaaaacccnctgtagagcttcctcaataaaaacacatatgatccagc

SEQ ID NO: 509479 - DNA, 173 bp, Homo sapiens
ccccaaaagttttttttggtggccctgggttttcatttttctggatgtataagtctgtgtgtcaggtacagctgggccccccccgcttgggtcccttttgtacaagcttgtttttttttgtcttgtggatgcccttggtaatttaaaaataaaaatatttgtttttttgccca

SEQ ID NO: 509480 - DNA, 127 bp, Homo sapiens
tgtgggactggagtgggcacttcagggcaggagaggactggggaggggcacaggatgtactcgggcactagaagcacaggtgcctccaaaagaaggggactgaccaagcggggtacggagctcgaat

SEQ ID NO: 509481 - DNA, 700 bp, Homo sapiens
cgacagccgagaagcagaaacacgacgggcgggtgaagatcggtcactacattctgggtgacacgctggtggtcggcaccttcgtcaaagtgaaggtgggcaaacgatgaaattgacctggcgtaaagtagctgtgaggatactcaatcgacggaagattcgggagccttgagtgtggtaggaaaaatccgcggagaatattcagaagctcaagcgttttcaggcatcctcgatataattaacactgtagccaggtcatcagtacaccatcgtgatattttcatggtgatggaatatgtctcaggaggagagctattggattatatctgtaagaatggaaggggtaagctgttcggctttaatgtctgtatgtattttgtaaactccactctttagtcctttacatagcatcaaaatgtcaggaacagattttgaagaggtctatttaataaccagttccctgagtgcatatatgggttagaatcataaagtatgtagaactagaaaggatctgaaagattatctcctatagccctgttgatacagatgtgggatgctggaggctcggagattatatgattgctcacagtaacgtgatttattaatgacggagttggttgagccccagaaatcttaatctcagagttatgttccagggtatacaatcttgaatatgttcttaaggataacgtacaaattt

SEQ ID NO: 509482 - DNA, 856 bp, Homo sapiens
gccacagcgatcctgggagggggcgacgcggaagcacgagatgcacccgacggcatgcgacggcagaagatggaggacacgaggcaggaacatcatggaccgagtgcaggagtgagcgaaggcacgtcagtcagcactgccagagcctcgcgtaattcgtaggctccaggacacggcccatcacgagaagcacccctgaggaacactcaacctccggagtgccgacatgacaacactcgacgtcttgccacctcctctcaaatcatcactagatcgaaagtacgtcccctcgtgccttgagcttcttcgtctcttccttcctactacgcgatatgacatgatcgactgtcacatcagcgtgatctcatcgaacgcattaccgctgcctgaggacgggaccacgagaagaattgtaatacgccttagaccccaaacgcacgcataatgagataggatccccttgcccctctacaatacaaagggctgcgaagtgagtagtttccatgagttcggaccgtataacatggatgtacgtcccgtggtcccgattgccacgtgaattgaaagcctaagagagcgcggttgacatggcacgcactagtttattctaataccatatctccttcatatccttagacattctaactcgccccaatcccatcaaaactagtggaatcgcaaaagacacaagacaccaaaggggaattaacttgttataccgggagcgccaagaataagagcccagagtcaaaaatgggtactagggaggctcccttagccgcgggcggggaagcatcccgtgcaatgtcttagactcgcctgcacaaatcgggagggggaccagaacccgagaaaa

SEQ ID NO: 509483 - DNA, 105 bp, Homo sapiens
gagatcccaccactacactccagcctgggtgacagagcgagaccctatttcaaaaaataaaaaacaactactatgagtgtggcgcattggctcatgcctgtaatc

SEQ ID NO: 509484 - DNA, 774 bp, Homo sapiens
ctcctgtctagcactgcactcgtctgatgtgactgtgtcagcctcattaggttctcactctgacatgctcgaatctccaagtacaatctcattctgaggtaccatccgtttctcaacggaagaatttagggggacagaattcagtccgtatgcatgtctgtgcagtcagtagtgcatgggtaccagtttctgcaggcccgcaagtgatctctagagcggcagaagcatacgtgacacaagacaggccgctgaactggacaccagactttctgttgggattgctaaataggagaatgtgtgactctcactgggcgcagacgggtaagcagctcttgtctctatgctaccctgtgatctcatggtaaccttggggccagcactgtgtctcccttcgcctaaacgtgactctgttccgtttttccagtcttccagacctggtccttggagcggggagacctgtcaccgttcgctattgtgtggctgtctcggtcgaaatccacccgtcgtccttcacggccatgacgtgataagtcatgcatctggctgactggtttcctgaaatgagatatgcttcttggggtcttcagatgaagaggaatagcaagtgaaaggaggatggtggcagggacaagaacccctaccaggcttactaggcatcccctgcatggcagccagcgctctaagttggcccccaaccatgcctgccttcttctagttcacacccttgtgtggttccttcccacagtgaaaatgcctgagcttgtgtaaccagcg

SEQ ID NO: 509485 - DNA, 516 bp, Homo sapiens
  misc_feature (83)..(83): n is a, c, g, or t
attcccataggtgtggcgaactgacaggagattggcatagtttttccatgaataatgcctttttgcaacaataaaacttggtnttaatacagattacacattaagtagtatgactagtcttgattttgaaaaatagaacacacttgctgtaaagctgtggtaatgcaagcatttgtgtatagttaggccgtttgctcactagttcttagttgttttcaatccctggcttctaaacctgaaaggacaccttttgcatccctcgcaagtcttttatttcagagccagagcctcctgctttgagacaaagccccatcacttcccttctccttccaagcctagaaacctggtgccacttcgtgttgctccaggactccaccagggctcacttggtatggctgttcttgccttttcttggagtttgccaacccatgactaaaattggaagtgagagaaatgagggcaggcatgagggtgtgtgttccaggtctgcagccctcctggccttcagggcggccg

SEQ ID NO: 509486 - DNA, 229 bp, Homo sapiens
tagaggctccccgcaccaggcgcacttctgaggtactggaaattagggctccaatatatgaattttggagggcatcatttagcccataacaactgggtcgataaactgagggacagcctacagaatagccggttagtgatctcacttgagagactaagtgccatttgagcagttcaactacaattgtgaatgcaatcgtggtgattgtgaggccagtactggcgaacaa

SEQ ID NO: 509487 - DNA, 748 bp, Homo sapiens
ccacagtattgccaggacgaccagcctgccagccccgatcaggatgatcagcacggcactgcctgcagcaattgcaggtcgcgcaaaaagggcacgcgtcgggaatagcacagcttccggattggagagaccgtcaacaaagtacttgaggatgtaacccagcatcggttgggtcgacgcgaaaatcagaaatccaaggatactcaacgcgaacaagcccatatagggcttaacgtaactgagcaggcggaagtatattttcaagctcgaagggcttgcgctcggactggagtcggtcatatcacgcggcgttttgaaaaaggaggctgactttagcacagcttctctgttgtacttgcacccggcgtaagccgcggcccggttggatcctaccggcgacattacttagccactagcttaagatggtcggctttctatttctggaatggctttactgtatgcactccaagcgccttacctatggctcaaatcgcgttttcgacttcctggtcctatggattttgcctgttggcttgctgctgctcctgagtgcactgttctttgtcggcaatcgcaatgtactgcaccgcattgtctacatcctgttcagcgtaccgaccttgtttctgttgtgcatgcgccctcgggaattcaaggacctgctgcgcgagccctggcatcgcgttcctggcgttctccgcctgggcgttgaccagtctgctccggagcccgcgcccagagattacgg

SEQ ID NO: 509488 - DNA, 352 bp, Homo sapiens
gcccgtcagggtggtagccaggttgccggggactattcatttcatcatgagccaaaccatgattgctgaatgtactgagggaaatgtctatgctcctgtgtatctcggggcttgtcttgttttgggctgcctcctgctcagttcctctctttaggtattcagtatagcgtacatgtaatgtcattcctgaggacccaaagtgatgctctttaacatggtgaacaatggtcactatatgttgggcaagacagttctgaggggctacgctgagactgagctgattgtatgtgctggaaaatggaacgaagtccggtacctttttgttgctgctattgaaagttctaaaactagg

SEQ ID NO: 509489 - DNA, 433 bp, Homo sapiens
gatgagctacgaggtacaccccagactcatacaatgcagaatgacgacggtaagttcgatgaatctgtaatctgcatgcggaactatgctctcgcttacccatatctgcattcatcgagtgccaaaggatcacgcgtccatccagatagaacgatggaccgatgtgattgagaatggtctctagcgcatgtgtttagtaggcgcagacttaaaacttatgctatcgtgcagagtgagctcatacggcagagatgggtagagatcgatgatgattccacttacttaccagaatgtgggcatagggcggatgtgcctcgatcgcaaaacaactgtcgacttgggatgaagacatctagggaagatgtggacttgattggtcgattaatatagattgatatgacaagacctgaaggacagaaaataatggtccaaa

SEQ ID NO: 509490 - DNA, 190 bp, Homo sapiens
gaggcgatctggactcactgcagcctgtacttggcaggcttttgcgattgtcgtgcctgagcctactgtggagctgttattacaggcgcgtgccaccacgcccgcctaatttttttgtatttttagtaaagacgggttttcactatgttggtcaggctgttcttgaactcctgacctcgttagccgtcca

SEQ ID NO: 509491 - DNA, 1242 bp, Homo sapiens
  misc_feature (432)..(432): n is a, c, g, or t
gataacacatgtgatcggtccgaaggtgaaggagaaaacaacagtaataacaagtggtcgtgcatccgggaaggcatgtttcgtccatatggtagatggatctctccgaagaagcctcttcatgtcagtaggagtgaccatcaggtcgatgtatgcttattgtgcttgagaattctgttcaatatcttactatctcactttcaatactggctgagtgccattgcacagtctgatggagactcaagctcactttggtatatatgactgtaaagggacttctaccactaccttctaaatctgtctccttttctatttagcctgtttggaaggggaattctcgcggagagacacctttctgctgccaaaacaaatgttaactggcgtacgggttgcttggtcaacaatacatgttctgatgagcacttaatggtntgaggacgatgtgcatgtgagcgcgtacgattctatgggtctcatatgaggattctcgaatggaagtaagcgcccacggggagacgaagaatcggtccaatgacttgcctgtgtcgtgggctttggtatcagaatgtttccctagaatccaggttgggtcatccattaacgatggaccacaactcgcaaacgtggaagcacaccttgaatattcaaaggagacccatcgacaagcccatcgtggaatcgtacaagctcccacgagccacaaaggttcgtgaataacgggtctatgttgtccataacttttgccaaagagggttattaatctgatattccttgtcaagttagtgctacactaataacgcatttaaggcaaatcgacattctctcaccccatgtacctcaataattgtacccaaagttgtggggccacattcactcaccatgggtgcgggacatcaaggttaggaagttttccccattactagggtactaacccattcatacatgggagaattttccccgttaacaccagatgactgaactatataatggagcccacctaagggctttaacctcctaatgaaaaacccggttgttccgccatgtgaaccattggattcacaagggattaacatttagagagttaacgcgaaggatttggtaaacccgtcacttttcctttgaacgtcaacgttacgtggaatctctgcattcaattttcaacaggctttactttaacaacgtaacatcggaagaggaagttactacagggaggtcttggtggatccgttgacatcgttattg

SEQ ID NO: 509492 - DNA, 311 bp, Homo sapiens
agggaccggaaaatggttggcaacgtgaccggggcccaggcctatgcctccccccccaagggcctgaacatttgggccctgattttgggcatcctcatgcccattttggtcattgtcatcccaggggtgtttttccaggcctatggatagatcagggggcatccctgaggccaggggctttgcccatgccctgtatcccccggactccaacttccattcctccccccgcccccggagccgagtcctgtatcagccctttatcctcccccgctttttccaatggcattcaataaagggcacgggtttttgga

SEQ ID NO: 509493 - DNA, 315 bp, Homo sapiens
ggagccggagctggaacggccgggggcggcggcagggcgggcgcttagggatctaaaatgtccactgaggcacaaagagtttatgacagtccaagcactagtggaggaaggttccgatggagatcaacgtgaaagtgttcagcaggaccagaagagacagttcagccagaaaaggaggaaaatttcagcaaaccgcttctaattgtaacatgtctaaagatttagaggacttcagaatacattgccccccccacgtagttgaccaagagaacattttttggggcactttttgccccggcctttttaggggggttt

SEQ ID NO: 509494 - DNA, 160 bp, Homo sapiens
gtacggaactctttcacatcacatcccctcatctgcccaaagggatccctcacgctctcagctgtgtcactgcactctatgtacagctcccttttaccacttaccaagttggactaagtagcttttcccacccctcactctccggtttcggtccagcgag

SEQ ID NO: 509495 - DNA, 121 bp, Homo sapiens
tgatcctcagaaaatttcggagtgtaggcgtggtactaacgccacgcggtggtcagcgccaggatctgacccagccgcagccatatcaataccatgctgtatgaagcgcaaatttccgctg

SEQ ID NO: 509496 - DNA, 237 bp, Homo sapiens
gtagctgggactacaggcgtgtgccagtatgcccagctaatttttggaattttaaggaaaaacggtgcttcattatgttgacctggctgttgtcaaactgatgacatgagacactctggccttgttgtcctgacaagctatttaccattatgaacaaccatgcaccatagataacagccatttaccattattaacaaccattgaccactgtcctgcccaaagtgccatgcaaagcac

SEQ ID NO: 509497 - DNA, 410 bp, Homo sapiens
aaggccatagctttaagagatcctctcaccacagatttccaaagtgctgggattgcaggtgtgattcatggcacccagactttgatgcctttattacatgatacaggcccagaagccaaactcaggcactgtatagatgaccactttcgtaaactactgacctagcttgttgccaattgttgattgaacttcccataactccacttcgtgtctgttcctctgtatacagccacgttctgttaccgtcatgagcctttaggtctccacttgccaccgcaaatactatgttccatgtaggtagctcattcagcccctcgcccttcatttcacacacaggttcaattcaggcctggctgccaatttgtgccatcgctgttggttgttgatgaaaataataaaatgattgattc

SEQ ID NO: 509498 - DNA, 315 bp, Homo sapiens
tgatctagcgggtgattcacagactgcgccggtgcccagcgtatcctgcgcaagcgagaggcgtcagcaaccagatgccaggcaggccggtggggtccttgtgggacacgggtctccccttctccgggctcgcgggggactggtccaggagggggagccgtgcctggcagtgggcaggcgcgactgggcgcggccctacatagcaccttggcagcagtatgatgcagccgttctagggagccagtagctgcttctcgcacgcgcggctgcgctgtggcctgtctctgaagacctctgcgcactgccttccttgtg

SEQ ID NO: 509499 - DNA, 1468 bp, Homo sapiens
  misc_feature (569)..(569): n is a, c, g, or t
  misc_feature (1256)..(1256): n is a, c, g, or t
gtctttgtttgatgcgagaagaactccctctgttgtgtgcacccaccaggaggagggtcgttcggggggtgggacctgtttgtgtgtcgccaagagtagggtgtgttcgcaccgagagcgcctacgtgtggcgtgtgcgggggatatatccctccacgagtgtgtagaatgggcggggcggatgaagtgactattggtcttccctctcactaggtgtggtcgtcctaacacgcttccctctagagagagggggtgttttctcgtcctccacagaagtcctgtctgtggtgtgagcgctgtggagtaaggtgtccgcttgtgctcatagtatggtcgcgctcttcgatttggcggctcttcatagaaatgtttctggaaccccccaagagagattggtggggtctctcactgttggggcccccggaagatgtgctctttcttttcttaagagcgctggtccttcacaagactgtggtgggcaccccgactgggcgcccgaaataaggggtgttaggaggggggcgcagtcatctactagaggtggttgctctcctctaagtcttcggttntcctcgcggggggaaggacaactttgttgaagagataatctcctctctctctaatctcgccgttggaccacccttcgtggttttgtttgggggcgcgcatgttgggcgacaccatctagtggggcgctatgactgagcctcctcagaagaccgcttggggggggcgcccctcctggtgcgccgcggcgatactttggtgagccgcgcgctttggtggcgcccaaaatgatgtctccaaacccctagacggtctctccgaacgagaaatgtgaaaagagagagagagtctcttggggcgtcgcacacacaggcttatatagatttgtgccccgcgcacaggagatactcttcaccagatatacctcctctgggggcgcacacatggataagactttgtgtgtggcacacggcacacaccctcttctttccgtgtcacacactcgtgtgggggtgaacacacacagagactcccctccaccctctcggtggtgtcacagctctcacaggcacagtttcgagagagcgcctcctgagcgcacacacacacttttgacacaggggtgtcccctcggtgatagtgtatagcggcgcccacctcctccctgggagagtgtttgtgatcccgcttccctatagaaacttttatacacagaaagcccaaggtgtccctcggagagccctcgtgtnggcacagctttatagctgttgcacagttgccgggtataattggagcccaagtcacatgtgtgtttttttgcctcacacttttcacccacaagggtttatgaatcacatgtgaggcctcgtgttaatttccgggggggccaccacgggtagagttcccccggggttttgttggtccaaaattaaaacctccgtgagaccccatgagaaaaaaa

SEQ ID NO: 509500 - DNA, 872 bp, Homo sapiens
agtttacgtggaggtgtgtggtatgccccacatgcttggtgcaaccccctggcgaaatctgtggctgcacctggtgtgggtgagtcccctaggggatgatgagtattaatacagatacgatggctccgtggcgacctacgcgccgtgagttctgctccctggcgatgatgtttgctaccggtccgttcatctcatacgcgccctgtggctaggtcacacgccagctatggttcacgcccaaaatgcctcttttaagtgtgttacctcggagccacgtgcactttcttttgattgatgtgcgctcccgggatgttacactccttcgctgtcgttcgttccggccctgagcttaagccgctcgtacagtcagtaggcattgactggcagggtcgcgcttcctaagccggcttatcgaaggagtgctctgaccagatcgtttgccgccctcatagagactctttttgtattgaggtattgtacgacagaccttctcggatgagacccttttgcttggttattccccccccgttgtttttacccatctcgggggagactatgtctctgtttagtagtacacatgtttgccgggtcataataactctattgtccctcactatgggcggagctcccaacaaagttattttcgccgacccctatatactccctggtatacactatgatgtacccgcaccacaacaacatcgggggttctgctcaactaacccccccacccagtgaccaaacacgtaaaacgccgttcaatgtacacacacgaggacaacaacacccctcacatggtttacaaccctagtcccccctttttcccctttcccccccccccgaattctttccggggtttcctttttaataaa

SEQ ID NO: 509501 - DNA, 1041 bp, Homo sapiens
  misc_feature (971)..(971): n is a, c, g, or t
ggctcttcaatcgattttctagaggcatttatacaactcagaccattgtgcacatgctgcgtgtcacgccgatgagctgaaggtgaaatacttggctacctatggaaactttgacaaagacattactggtgctgaactatatgatagttccatgtaactgatttcatcagaaacacttgagatgaaattggtttcatgcgaatgacgcgcaggagaagacagttctctacgtacgacaccggtgagtgtggtgactggcggcaattcttgcgaagtccatgtggagtgcataaatccaggatgtcgtttctggtgggatcgaggaataaccgtaaacctgaagtcggaaaaatactggaataggtaacccaccatcgaatggattgatggcatgaacaaagcagaagaatccggggacatgagtgctgcaatctttccttacttccctgaatgtcactcacattgtatgataaaggagtcttgtggcacaggcaattaggcatggacagtgactacacgaaagccacatatgggaacctgaaggctctcttcccagcagaggcaggccatctggtccattatgtagtgcccgtggctataatcgctaagttccgggttcatagcaagagtgcccaatcattagctctgccatcggaggtggcccccccgcggagtcgtgctctacataatagaaacgggctggcagggggccaggtcttgtaccgaaaatacgcccatcaactaaattgccgggcaggaaggaaaccgacgagggggatgtaccgtgctgacgctggacctgacccgccggtagaaagaatccctaagtgacggtaacctggctgagaaaggctgtgcccattgagggtgcccaaaaaccgttaggacctttcaattgaggtgaaagggggctagttgacggctgaaccagttccagtgaacattaggacgcccagcatatctgtacgtantatataaacttctcgcctcctggatccatggggcaaaacaggaggacgaaccaggaaaatagccaaaagg

SEQ ID NO: 509502 - DNA, 331 bp, Homo sapiens
aaaaaaagacccaaattgggttaggggcccctaggggggagcccatgggaggtccccctttaaaaagggggggggggaagggtttttttttttccccccggggaaatggtaaaccaaaccccttttttttgggggggtttttaaacccaaggccggaccgaggtttggggggtcttttttaaagcccaagcccaataaggcttttggggaaaccagtttttaccccccgggggggggaagggccggtttatttgtttttaaaaggggggggttttgggcattttaaacccctttttttgggaaggggaaaaaaattttttttttccccgga

SEQ ID NO: 509503 - DNA, 212 bp, Homo sapiens
tagtcccctttatataatataatcaagttcctccatctgggcattcagttaaattctacaacattgccaaaatctgatttgactctacagaatatgtatagtttatttaaccagatagtaatttaaaattttacaacatgcgtatttcatgtaatattaataacagtaatttaaattaatattcaatacataccgtttgaatttttataagg

SEQ ID NO: 509504 - DNA, 927 bp, Homo sapiens
ggtgctggcctgcagagagcaccgtctggacctccgggccctctctgctcctgcctgctggagaggatctggctggtcagaaacaaggtgacggggccaccccagtggctcatgcaccctggcagaccacggtaaccgccagtggtgtttccacaccgtgcccgtgaggaggccacgccagtgcccctgcgtcctgagctgggggtggggaagctgtgtctcaacaagcctctctatgggattctggcgcctgctcagcttgagaaccgcgctcatcgtggacgccctgtgcatgacatggctgtgcctgaccctggagaaaatggcatgtgactgtgcgtgtgttgtgccttgccagtggatgatgcctgccgcggctgcgtctacatggagtgcagaagacgtaaacattggctgggcagtggattgtgcagctcacgtcagagaattggtgtttctggcgaggagggaccaagcctcaccacggagaaggacgccgtcaccggcgtgcaggctgccaacctgccactctgggaggccccacgcggccctgcacctctcaggagggcgctggcgctgggatggtggccggcaggcaggggtggcaggagaaaacccatccgagtctgcaggtcagcgccctgggcatcagtggggccgggaggggtgtctgagcgcagacaccttctatccccggctcattgtggcccatcagcccaactggagcggcttggaaatgaccatcaccaggcttgccaagggtgttggcctggaacccaagacacagttgacttcccgggcatgactcccgggagagtggcggaactggcgtgctcagaagagttgcgggacgattccgggcttagtgggcgcttcagctaattgggctagatttgctgagggcagtggcagtgccataagtacctc

SEQ ID NO: 509505 - DNA, 876 bp, Homo sapiens
gggacgtgcggcacacttccgtagaggtggacatggcgtgcggttcgcggcgctattgttgcacggttcccagagtgtgaatctcccaccagaaaaattgatcacatcaatatctgcagtcccaattccccaaaaagaagatgtagctgattttaaagctttctgtggattctttaatgggaaaaagagacattgacccatttcaaaggaccagaatattcaatgtccaagggccaaagaagattagcaagaagaaaaggtttaagggatgtggatacagtggttgaagtggaaaatacaggtactggttccaaaggaccttgtaaatttttcaaaattttaaaacaggagaagctcttaaaaaaaagaacggggtggcttacaaaccagggtaaattgtgaggtatggtcaaaaatttatgtgcgtcttaacaagggtgaaacctttttcttcttggatttccccaagaaagaaagatgtgtgggttggaaattccacgttcacctaatattgttgtgccaaaacaaattttcattgtggggccatttgtgggggttttaccatcaataggaaaattttataggcaaaatcttcaaaagaaggtttaagggacatcaaggttattaagcaataaaattaccttgggggatatggggcatgcaagttgtggtcttctgggaacttggcttccaggtgtgggctatgaaggacacaattgcagtccaatctctaaaggatcttctttgagttctggtccagttactaaagaagcgcagatgtaacagtgttgcaaagcggcagggttttcacgatgggaatggggatgtggggcttacggtgaaattggctcgctgaaacttggtaaacgagggatt

SEQ ID NO: 509506 - DNA, 351 bp, Homo sapiens
  misc_feature (2)..(2): n is a, c, g, or t
  misc_feature (109)..(109): n is a, c, g, or t
  misc_feature (134)..(134): n is a, c, g, or t
  misc_feature (143)..(143): n is a, c, g, or t
  misc_feature (152)..(152): n is a, c, g, or t
  misc_feature (334)..(334): n is a, c, g, or t
gntgaatgaaggtgaggattgctggccccgaggtgtacaggaagggggaaaatgtgcgagggcctttaacggggggcaagatgccagcaatggccccccagcagacaanaaggcacagtggggcttggggactnggggaggcnaaccctgtncgcgctgtccttgaaatcaggagggttgtgagtggagtgctgcaatcgcccacccaacccctgtacaacgggggttccatttctgagacccccaaagtatggggcatcttagaggcccgccccacatgctgagcatcaactcaaggaccttcccccatgacgggatcctcagaaagagccanggccagccgatgcataa

SEQ ID NO: 509507 - DNA, 316 bp, Homo sapiens
tatagtctagtagtatcgttcgcaggaatcactttctctcagttttgaagctagtgtcattgcttgtaagcgactgaatcagatcctggctgatgttgtggtcctatccgttccagctctaactgttctgccacctcctgtaatccatctttgagatttttgcagctcttcatgaggtacttcacatcataaatgtcaggaaaaatcaatcgaaggatctcaaagaagtcaagttcttcttcaggccagttagagttggttaggattttgattaagttgccaaagtcgtaactgctatgaactgactgccatttga

SEQ ID NO: 509508 - DNA, 377 bp, Homo sapiens
tggggaggacgccgaatacgcggcggtagacctttgagaagtattcgactgaggtgaaacctgtcagggcggagacttcggttacgctgagtgtggtttgctgaaggtattggtgcgatttttctactcgcaccagcatgtattcgctgtgcagcgtttgccctgattgttgtttgaaacggcgctctaattggcgcagtgacaaacccagctgttgtgcgatggtgtcgcatgagagtgggtcgtcgatgtgtgcttgcatgatggcacgcgctcgcgcgactaccgcgtcctgggctgctgccgggtcgccgtgacgtgagtcgcggcgggggctcaggagcaggtggcgggcgacttcggttgaggtcttgggc

SEQ ID NO: 509509 - DNA, 226 bp, Homo sapiens
  misc_feature (10)..(10): n is a, c, g, or t
  misc_feature (62)..(62): n is a, c, g, or t
  misc_feature (72)..(72): n is a, c, g, or t
  misc_feature (87)..(87): n is a, c, g, or t
  misc_feature (122)..(122): n is a, c, g, or t
  misc_feature (124)..(124): n is a, c, g, or t
  misc_feature (131)..(131): n is a, c, g, or t
  misc_feature (136)..(136): n is a, c, g, or t
  misc_feature (138)..(138): n is a, c, g, or t
  misc_feature (179)..(179): n is a, c, g, or t
  misc_feature (187)..(187): n is a, c, g, or t
  misc_feature (197)..(197): n is a, c, g, or t
  misc_feature (222)..(222): n is a, c, g, or t
tggaaaaggntggaaaagagaatagtttggaaaataaaagataaatttaggagaataaaaanataaattganataaagaatggatanaggttttgtcaattcagaatagtagcctcaaaacntntggactnacctntnatagatggtgacgataggggagtaaagtttaataagttganaaaggagnttaagggggntggaaaaaagtattttgatggaganaagg

SEQ ID NO: 509510 - DNA, 193 bp, Homo sapiens
  misc_feature (1)..(1): n is a, c, g, or t
  misc_feature (28)..(28): n is a, c, g, or t
ntgctaggggaccgctgcatattgatgnatttcatctcaggcagactacaatggaaaaataaaatcacctgaaatgatgaacagttgagttataaatgaatgctgacaattgaaaacagcacaatgtcttgtgtagcttaaatatatgtagaagtcccatgaatttcacactgacacccactctgcactggac

SEQ ID NO: 509511 - DNA, 359 bp, Homo sapiens
  misc_feature (12)..(12): n is a, c, g, or t
  misc_feature (40)..(40): n is a, c, g, or t
  misc_feature (45)..(45): n is a, c, g, or t
  misc_feature (60)..(60): n is a, c, g, or t
  misc_feature (68)..(68): n is a, c, g, or t
  misc_feature (174)..(175): n is a, c, g, or t
  misc_feature (304)..(304): n is a, c, g, or t
  misc_feature (339)..(339): n is a, c, g, or t
ttcccagtgganttgtatatgtacttgctttatccctttnccccnaaaatgatgataccntgtattcnccattgtgttttttaatgccctgaaataatatgtattatggcaacattatttaaacattcaaacatttctcaagaatgagcaacatttgtaactttacaatgtaannttatataatccaaaggtattttagaattcaggccatttgatgttttgtttgcttatagtgatgtgttcccaggcaaatgctgcttttttttttttgggactatgtacatacgttactgagattgtgtanaaagtagatcctgaacagttatcacatttaatatntcttaaactgtaaaagtgta

SEQ ID NO: 509512 - DNA, 173 bp, Homo sapiens
  misc_feature (95)..(95): n is a, c, g, or t
  misc_feature (151)..(151): n is a, c, g, or t
agtctagagatccctgagagaccgtgttgcaatggttcatgcctgtaatcccagcattttagaatgccaaggtgggaggatcgtgtgagcccagnccgagccaacacaatgaaaccctatttctacaaaaactttaaaaaattagccaggncatgtgcggtggctcacaatct

SEQ ID NO: 509513 - DNA, 747 bp, Homo sapiens
cttgcctgccggcaccagccaccatgtgggagctcgtggactctcttgctgcttaccgcgaggcttatgtgtttcggcccaagagaaggtgccctgagttgccaatgtacgcccagagagcctccgtgtcgcacgtgcccccatggtgggcgagccttgccattccttccctcagacatggccatatgcagtaacaacttcttcaagcatgcagataaaaatagtggccccgatctattctgttcgtatgggcaccaagacgtacagtgattagtcggtcaccatgcagctggccaaggaggtgcttattaagaagggcaaggaccttctactggagcggcctcaacatggcaactctagacagtcgcgtccaacaaccgtaagggtatcgccttcgctgactctggtgcacactgggcagctgcatcgaaggctggagatggccacctttgccctgttcaaggatggcgatcagaagctggagaagatcatttgtcaggaaagtcagtacattgtgtgatatgctggaccaaccagaatggacagtccatagacatctcctttcctgtcttcgtggcggtaaccacatgtcatctccttgatctgcttcaatacgctcctacaagaatggggaccctgagttgactgtcatacagaatgacaatgaaggcctccatagacaagctgagcacagacagcctggtggacctagtcccctggttgacgatttgccccaacaaaatcctg

SEQ ID NO: 509514 - DNA, 387 bp, Homo sapiens
agaacagtctaggcaacataaatagaccactatctctacaaaaatataaaaaagtagccgggtgtggtggtgtctgcctgtaatctcagctacttaggagggtaaggtgagaggatcccatgagtgcaggagttcaaagctactgttgagctgtgatcctgccactacactccatcctgggccacagagtgaggaaaaaaactggcatgtaatgaatattaaaatagcatccaccgggtgcagtagctcacgcctgtaatctcagcattgtgggaggctgaggagggcagatcatgtgaggtcaggagttcgagaccagcctgcccaacatggtgaaacccaatctctaataaaaatacaaattccgggcatggtgtgtgtgcctgt

SEQ ID NO: 509515 - DNA, 266 bp, Homo sapiens
  misc_feature (32)..(32): n is a, c, g, or t
  misc_feature (108)..(108): n is a, c, g, or t
  misc_feature (186)..(186): n is a, c, g, or t
  misc_feature (262)..(262): n is a, c, g, or t
cttcaaaattattattcccccccctcttactncttcctccccatcctaccctacaccctcctccctcctacccagagttgctacattgttctttatagtcgctataancctaccacttgagtttatattttatctgttcctttagctcttctctcccttactttctcttttctatctccatccgtntagcctcctctacatttatatttgtctctttccttgttgccccttatctccacgtcatacataacagttcaatttnactg

SEQ ID NO: 509516 - DNA, 149 bp, Homo sapiens
cagcattgtatacataaacaccaataactcccgcctgaccgtcatcgatttggccccttgtgacgttgtgtgccccacaccaggaattcggcttcgactttagccctgtctgcttcctgtaaactccctccatccctacatggctcaca

SEQ ID NO: 509517 - DNA, 541 bp, Homo sapiens
atggggatgacatgtaacgggataagcgttgacggggacgatgggcggtgccacaatttagtgggaggtctttgttcgagacagtttactggtacttatcagctcttgggtccctaagttctcctaacctacagtgtttctctgagtacatatggtttcattgttcgatctactttctatctatctgaatatgaacttctaggatcatgtctattctagtagatgatgacttacagcctgcagtataggagggacaacgtcaactactgcatgtgcaataacaagcttgaagggaagctaaatgttggttacaaatttcagacagtattttaatgccgttggcatttttctaagaattttctataaagctaattctgttattttttgtctctcacttagggaactgtccaggtttatcgctgccgggagactacactgcaaaatagataaagtgaatgaaatagtagaaaccaacaggtactctcatttctcagaataaggggcattcctaaactttacaagtaggtcacctattgtcatc

SEQ ID NO: 509518 - DNA, 398 bp, Homo sapiens
atatattgtgaaatagggatagtggggactaatgtgcacagctatattttttaaactttatttgctgtgaaattctgtgaaggttcaggtatctaaaataaatatacaccaatatgaaatataatgtgttcagaatgcaagggaatatgtgatagtagtgtgttggaagatactcttggctaatattaactagaagtattttgatttgtacaggcataatttgtgtaaaatgacttcatttaacattcactgatggagaataataatggaaggtctgatttaaagaatggtggcatggtgcatgtgatacttttgcaagtgttggggagaacggtatgttttggagagatttcttttgggtgccagggacacagcatttatcatacacctctttatcg

SEQ ID NO: 509519 - DNA, 947 bp, Homo sapiens
  misc_feature (19)..(19): n is a, c, g, or t
  misc_feature (71)..(71): n is a, c, g, or t
  misc_feature (75)..(75): n is a, c, g, or t
  misc_feature (130)..(130): n is a, c, g, or t
  misc_feature (153)..(153): n is a, c, g, or t
  misc_feature (157)..(157): n is a, c, g, or t
  misc_feature (159)..(160): n is a, c, g, or t
  misc_feature (167)..(167): n is a, c, g, or t
  misc_feature (170)..(170): n is a, c, g, or t
  misc_feature (173)..(173): n is a, c, g, or t
  misc_feature (227)..(227): n is a, c, g, or t
  misc_feature (245)..(245): n is a, c, g, or t
  misc_feature (252)..(253): n is a, c, g, or t
  misc_feature (260)..(261): n is a, c, g, or t
  misc_feature (263)..(263): n is a, c, g, or t
  misc_feature (297)..(297): n is a, c, g, or t
  misc_feature (332)..(332): n is a, c, g, or t
  misc_feature (381)..(381): n is a, c, g, or t
  misc_feature (383)..(383): n is a, c, g, or t
  misc_feature (391)..(391): n is a, c, g, or t
  misc_feature (446)..(446): n is a, c, g, or t
  misc_feature (448)..(448): n is a, c, g, or t
  misc_feature (451)..(451): n is a, c, g, or t
  misc_feature (456)..(456): n is a, c, g, or t
  misc_feature (523)..(523): n is a, c, g, or t
  misc_feature (546)..(546): n is a, c, g, or t
  misc_feature (561)..(561): n is a, c, g, or t
  misc_feature (692)..(692): n is a, c, g, or t
  misc_feature (695)..(695): n is a, c, g, or t
  misc_feature (752)..(752): n is a, c, g, or t
  misc_feature (767)..(767): n is a, c, g, or t
  misc_feature (770)..(770): n is a, c, g, or t
tttattgatggtacatganaaggtgcggcacctaggcccctcccctcttcaaggggtctacatggcaactntttnttggggagactcagtgtggtgggggactgagtgtggcagggactccccagcagtnagggtctctctcttcctcttgtncacnannaggggcnggnggnccaggggtctaactccttggaggccatgtgggccatgaggtccaccaccctgtngctgtagccaaatccgtngtaaaannaggaaannancataaaaaagtggtcgttgagggcaatgccagcnccagcgtcaaaggtggaggagtgggtgtcgctgtngaagtcagaggagaccacctggtgctcagtgtagcccaggatgcccttnanggggcccnccgacgcctgcatcaccaccttcttgatgtcatcatatttggcaggtttttctananggnagganaggaccaccactaaaacgttggcagtggggacacggaaggccatgccagtaagcatcccgtacagcncagggatgaccttgcccacagcnttggcagcgccagtngaggcaggaataaagtactggagaacaccgcgaccataacgccacaatatcccggaggggccatccacagtcttctgggtggcagttatggcatggactgtggtcatgagtgcttccacgataccaaagtngtnatggatgaccttggccaggggtgctaagcagttggtggtgcaggaggcattgctgangatcttgaggctgtngtnatacttctcatggttcacacccatgacgaacatggggggcatcagccgagggggcagacatgatgaccctttttggctcccccctgcaaatgagccccagccttctccatggtggtgaagacgccagttgacttcacgacgtactcagcgccacctcgccccaattgattttggagg

SEQ ID NO: 509520 - DNA, 114 bp, Homo sapiens
ttcccaagcccccaaaaaattaaatccccctcctgtatcacccatgggtttttttcagcctgggtcccgcccattgcaacccattacaatttccagctttccccctcaacccta

SEQ ID NO: 509521 - DNA, 230 bp, Homo sapiens
ccgcgtcgggcgagttcggccaacagcgccggatacttgtccacgccgtcgaggccttgcggcgcctcggggatgccgtcgaaatccgacccgatccccacgtgatcgatccccgccaccttgcgcacgtgatcgaagtggtcggcgacatcggccaaggtcaccaccggcttggcgtgagcgtcgtcccaggccttcacccccaccttggccttgtctggctggcccac

SEQ ID NO: 509522 - DNA, 158 bp, Homo sapiens
gtgcggccacttcctgtgtccgtggcagacttccccctctcgtgtgcgcgcgacattgatgataatatacgtgggactgtgtgaatacaccagaaggtctggtactcgtacagcacagatgacaccctccctccagctccagggtgtgagggggggat

SEQ ID NO: 509523 - DNA, 830 bp, Homo sapiens
  misc_feature (592)..(592): n is a, c, g, or t
  misc_feature (669)..(669): n is a, c, g, or t
tggtcatcatcaggcatgctcacccgactacgcccgcacgcagttcctgagccccacccatgaacgaatccctactagaggagaacgcggaaaaagccttctacgtgctcagaggagtgacgaggccaaggtgctgctgtgggtcttgatggatgatcggcctgcctgctgttctgccccactccctgaaatgtccctattgtcattggacccctgaccagcctggctgcctgctgcgcatacacgcatatagccctcgtgactgctatgagtccagcatggcgccgtctgggttggttgattggcgcgtgtgcgtcaggctcatagacttcgcagccatgtgctgcctcaaaggatagagataagtgtggctagtctatctgcgcaaagtgctatgctgagttgcgtgccttagctttgcggcaggaccaccaagtggaagtggtagcatgctaccagtttgtagcgtccaatgaatctgtagtgcgcaacgcattgtaccagtctaattgcagcacgaggtgtagtgtatattgaggtcctcataactcgttgagatgaagcgtatctatacaatacatgtgatcccacnctgtactcacacatcacgcatgactatacatgaatcccatgtagatgcgtcgtgcagcatgtgcttagatcacaagncgctaggcacacagatgaagacgcagacgatttccctatcttgtcgctagcgtgggtaattcgcacgcacgctactacttcgtgcacgccagtggcacgacatggtaccatttggttcggctcgaccaacgatagtcccaagggccaattgtgaccgcgtc

SEQ ID NO: 509524 - DNA, 874 bp, Homo sapiens
tcccgtggtgggcggggtgcgagtggataagtaggggtaggggatgcgagtggtgccctgtgctcttttgtggtacgtcgtccttgggagtccccgtcccggctgacgtttccccgtggggttgttttaggcggggaccctttttttagggaagccgccccgggtgatgccccggtgttctctcggtaggagtggaaattacctccttgggtgcctccgtgtggagccccccggcgctgctttcctcccaggggggttgccccggccgcccctctgtgcaggagaggtcatgttgagaaaactcatatcgggcgcgccgtcggtttgtcggccatatatcctcgtgcgctcgccgaggttctttgcccccccccggaccggcgcggcgtatcctccccctcccgggatttcctcttcggcgtccccgctccgcttctttcaggggaccaaagccccttcttctcagacacccgggggaataccccttcccgctggacccccccccgggggttcatcttgggcccccctacccccctggggggtgccccgagtcccctgaggtgtattacctcctgagcacgtctcgtgaggagggttccgacagacaccggatggcaatcccgcgcggagcccctctccactgttttacacgtgcgcgcacattaacgacttattggccccagccaaacgtttgataaaccgggtgagaagtaggcgtgggggatattaaagtatcagaacgtatgcagcaaaacttttggtcggaaacggaagcccccgggtttcatcggaagtaatggtagaccacccggcgattacatacctatgtccagtttccagccaaattattaggaaaaaacaaaaacccccacag

SEQ ID NO: 509525 - DNA, 248 bp, Homo sapiens
ccccctctgtctcatgctttccagccacctttgctaccttatcttattcctgtcttatgctataagcgagctttttggatttactgtctcgcgaacggcttcttgtcaatgtatactatacaacattcttaattgtgtctttatttttgtggcctcaggtatctttcaaattctttccatttctcactttctctagagcccaattatagctatttatgcaaaacagcatgctccacatagcccatatt

SEQ ID NO: 509526 - DNA, 293 bp, Homo sapiens
caatacacggttgaactggtaccttgcccggtcgaagtgcgtggtcatcatgtaccactggcgtgctacccagaataaatactgatgtcgaaaccagttaccagcacggagagacgggtggaagtgttcgatgtccggtgtttcttccggccaggccatggtctagaacggtaccagtgcagaagaaaaccaggtgtctgagcacctcgtcatcgcgcttcattgcaccggctataaccggcggaatctcgcgttgggttttggcatcaggggactccctctaaagtcgacct

SEQ ID NO: 509527 - DNA, 112 bp, Homo sapiens
cagtgtccgagacggtgacgaccgtgttactactggtatatggacacctaatgcctcttttctaacagcttggtacatttttttcgtgaaatagattaaatattttctctct

SEQ ID NO: 509528 - DNA, 773 bp, Homo sapiens
ggacccggggccacggcgggatgcgggacaacaccagcgaccatcagcgtgagtctggtgagctcggggagcaggggcaataagctgcagttcaggtaccccttccagagaagccaggagcacccggcgtgcagacaagtaagccgcgtagcaggatacgctgccagcaagaggggcgaccatgctgatgagcaggacggtgattccaggttttcagatgttattctggcaacaatgtcggcaaccaagtctgaaatgtgtggtcgaagaaatttggaactgacagattgataatgtgcgaatcgatgggcacccaacactgcgtgacagctatgcttcgtgggcgcagtgctcaacgcaagtactccgatcagttgataaagcatgtctgcatatacctgttctccgtcgtatcagccaccgtgctgcagcacgaggagcgccgctgccagtacctcacccgggaggccaagctgatcctggcgctccaggatgaggtgtccgccatggctgcatggaaatgaaggtcctcagtccccattccatcacatcctgcccaagtgcaagctggccagggacctcaaggaagcttatgacagcctgtgcacgtcgggcgtagttcggcttcacatcaaacagctggcttggaggtgagcttctgccgtgacccacaagaatccactatgcgtgctccagtctgatcgccccagaaggcatcgaacggagcctgaaagcatcgggccctacaatgcctgctgtgctcagtgatgagg

SEQ ID NO: 509529 - DNA, 385 bp, Homo sapiens
gacgtagtgggactgtatgattgtcctcctcagtactagacacttcatccagagaggactctgagccaaccctaagggattcaggctgtagctctggttcgccgcacggaggtggcgcaggaatgcatcggcctcccctgtcctgacttgtcagcgctcctgcgctcatgcctgggagcctggaccccagctctgtcccgacttgttagtgctcccgcgctcatgcctgggagcctggaccccagctctgtcccgacttgtcattgctcccgcgctcatgcctgggagcctggaccccagctctgtcccgacttgtcagtgctcccgcgctcatgcctgggagcctggagcccagctctgtcccgacttgtcagtgctcccgtgc

SEQ ID NO: 509530 - DNA, 1028 bp, Homo sapiens
  misc_feature (274)..(274): n is a, c, g, or t
  misc_feature (350)..(350): n is a, c, g, or t
cgctcgtgtgtcatcctggatgtgtggctacccctcctcttgtgtgattttctccgtatggcgcttcgtttgtgacacaccgagaggactttttccccacatatccctgcctcggtttttcactgctggctcgtcattgtcgcgcgccagttgcgcctgtctccgcccgggctgttttttccccctcgtgtcgaaccccgacacgggcatctcatataaggaacggtttaaacaaatttaagggatctcgcaatttttccccccctgtttcccngagcttcacctttggcattccccgtattagaggccccgcctgcccagtgacacagggttgaacggcccggttaccntaccgtgccaaggtagcataatcacttgttcctacaatagggacctgtatgaatggctccacacgagggttcaactgtctcttacttttaacccagtgaaattgacctgcccgtgaagaggcgggcatgaccccgccagacgagaagaccctatggagctttaatttattaatgccaaccagtacctcacctaaccccccaggtccttaacttcccaacctgccattgtaaaatttcggttggggcgacctcggacccagaaccccacctccgagccgtacatgctaagacttcacccagtccaagcgaactactatactccattgatcccataaacttgacccacgggaccagttaccctagggataaccagccgccaatccctattcttagagtcccataatcccaccaatagggtttacgacctctgatgttggatccaggaccatccccgatggtgccagccgcgtattaaaggttctcgtttgttcaacgatttaagtcctacgtgatctgagttcagaccggagtaatcccggtcggtttcttatttacttcaaattcctccctgtacgaaaggaccagagaaataaggcctacttcaccaagcgccttcccccgtaaatgatatcatctccacttagtattatacccacacccaccccagaaccgggttta

SEQ ID NO: 509531 - DNA, 430 bp, Homo sapiens
  misc_feature (165)..(165): n is a, c, g, or t
  misc_feature (219)..(220): n is a, c, g, or t
  misc_feature (248)..(249): n is a, c, g, or t
attgaccaggcgctgtacctgccagctgtttgcgcaggctggctacgtcggtttcggtagtcaccatcgccatatgctcgcgcttttgcgtcacgctaatcttctcaacgccttgcggcaggttattcaccagaatccggttggcacgatcgaccgcttcacganagtcacggtatttgtattgctgaccagacatatacagtgtcttatcgcgtactnnatttcggcgcgtcaaagcccgcgtatanntcagggcggtaagttggtttgctaccgtggtgtactgcaatccttcagattcaggcgcaggttgatatgccggttttggcgtatcgcgcaaggcagggcgcagatcgttgaaattggtccgtaacgtgaagcccaacattcacgtgttaccggggtcatagctcaggttgagatctgtcca

SEQ ID NO: 509532 - DNA, 180 bp, Homo sapiens
tcagcatcaactattactgcatagactataacagtatacactattacatgcataaactattacatgcatatactattcccccgagcattctcaattacaatatatacaccaccaaacaatgttcaaccatgtaactactactactcgaacgcccattatcatacaaatgcccccgttggt

SEQ ID NO: 509533 - DNA, 259 bp, Homo sapiens
actatattaggaataaatgaaccctgatgaaggcttgcacctacctctgatttcctctttggagctatggacaaacagttatccaactgcacctcgttggcatcttgtacttacaatccatgcacacccacacactgctgtggggtccaatgttaaatgtgccacatgcacccccaacatcctcaagatgtggcccctcaaggggtgtgatgcctataccactggcacagcgttagatcacagcacacttgggatctaa

SEQ ID NO: 509534 - DNA, 973 bp, Homo sapiens
tatgctttagactactccttcagaatcgatggcagtccacacatactgactgctagtctctcctatccttacacatctcatagttctagcttctcctgtctaggcactgagactcgaactccgtagacagctccaagccaagtagtccagcgctagcatcaggctcttactcatggacaaacaatacgagcaactactgagaacaagagctttcggccacttgtcgaacaaagctggaatgattcataatagacaactggtctgttaatctttttcatcattgtcgtgtataatttacctctcattagcaacggctaacacacattttcaagtgccacaggttttacacggattctgcagaaacaacaaagtaaaatcagtccttcagctctcagaacctacaaccagctcgtgctatccttgacttaatgtactctcctcatcgcatggcgtgcacctacagcttattgcctgccctaacctcggtaactctattcctgttcgctattctctttcccaagtggtatactgctcgcgtgtgcgagcttctcccatgcaccgccctatccacgctccccgctcacctcgtgccccttcttttcacacttatgaagtggcccttactgctcgcacttcctttagtctttcctctagccctgggtccacagccccttagcgctcccccatcatctggacttatcacctggtaacctgctggctcttcccctagccttaccctaccagctgcccccaagcccttttgtcccctcgtatctgcccctgacgttgctgtaccagccgggcctttccgactcccccgtcgtaacctcttccatccacctcgcctgcgaccccgttattcctgtttccacaggaatagtccttgctctcgcctcctccggccatctgttccgccccctcggcctgttagcttagcacgtttattctctccctctctttctctgccgtgccc

SEQ ID NO: 509535 - DNA, 118 bp, Homo sapiens
agtagacaagccaagaaacagaagactaggcggacgtaggaggaaggggacagttagcagtctcacttagggacaaggccacagccaggggtccaggccactaacccagcccgtaggg

SEQ ID NO: 509536 - DNA, 172 bp, Homo sapiens
gttttaaaatccccctttttcccctaagggttcttttttttccttttttggggaaaaaaatacccggtttttgaatttccctttttagcccctttgttttttctggccccaattttttttttaaaaaaaaattaagggttattttttgcccggttggtttttttaaaattta

SEQ ID NO: 509537 - DNA, 595 bp, Homo sapiens
aatggggcacagatttcctcgcggccgtcctccttcgccccgcttgtgtggtcaccccccccggctatgcctcgctccacccacccgccgcttcgcccgtctgttgcaatagtgttgtccacattagtggccgtctttgctagcacagaggcgctgtggtgggggccccccctcttgttttcgtctcgtgttcttctctctctcttggtgggcacagcaccttgtgcgtgccccgccgcgcggatatatctattatcgccacacgctctcccccggcatatatttctgggccaatatacgcactctctctccgcgagtctctctcactcgtcccccggcggtgtgtcatagcgcacgcgggcgagagacacttctatcgcgcggcgccatcctcggcggtgcctccccacgaggcccccccccttgtttttcctccacacaggggccgcgagggcggcaacacacccggtagccatgggcgcgtgatcagtggttcgaatgaccacggtgggcgccggccacctcgtgcccacgccgcccctgggctctgctctaggttaaatcgctcctaccttcccgacaaatgacaaaacag

SEQ ID NO: 509538 - DNA, 500 bp, Homo sapiens
  misc_feature (35)..(35): n is a, c, g, or t
  misc_feature (37)..(37): n is a, c, g, or t
  misc_feature (132)..(132): n is a, c, g, or t
  misc_feature (202)..(202): n is a, c, g, or t
  misc_feature (387)..(387): n is a, c, g, or t
caggagtcaaaccagctcgcagtgaaccttgcccntnctaaaaaatataaaaattcaaaaattagccggccgtggtgttgtccaccttgtagtcccagctactcggaggctgaggtgggagaatcacttgancccgggatgtagaggttgcagttgagctgagattgtgccactgcactccagcctgggcagcagactgagnccctgtctgaaaaaaaaacaaaaaacaaaaaacaaaacagctgggtgcagtggctcacacctgtaatcccagcactttgggaggccgaggcgggcggatcgcgaggtcgggagttcgagaccagcctgaccaatatggtgaagccctgtctctactaaaaatacaaaaattaggccgagtgcagntgctcacgcctgtaatcccagcactctgggaggccgaggcgggtggatcacgaggtcgggagattgagaccatcctggctaacatggtggaaccccgtttctactaaaaatac

SEQ ID NO: 509539 - DNA, 1807 bp, Homo sapiens
attcattactacagggcaggaagggcacgttctcatcagcatgagggagtgcctttccatccacatcggtcaagctggcatccagattggggacgcctgctgggaactctattgcctggaacatggaatccagccaaatggcgttgttcttgacactcaacaggatcagctggaaaatgcaaaaatggagcacacaaatgcatctttcgataccttcttctgtgagacaagagctgggaagcatgtgcctagagcactcttcgtggacttggagccaactgttatagatgggatccggacgggccagcaccgttcactcttccaccccgagcagctccttagcggaaaggaggatgctgccaacaattacgcgcgaggccgttactctgtggggtcggaggtcatcgaccttgtgctggagaggacccggaagctggcagaacagtgtggtggacttcagggatttttgattttccgaagctttggaggaggcactggttcagggtttacgtctctcttaatggagaggctcacaggagaatatagcagaaagactaagctggagttctcggtctacccagcccccaggatctccactgccgtggtagagccttataactctgtcctcaccacccactccaccacagagcacacggactgtaccttcatggtggacaacgaggccgtctatgatatatgccatcgtaaactcggtgttgaatgcccctctcatgccagcatcaatagattggtggttcaggtggtatcttccatcactgcctccctccggtttgaagggcccttgaatgtagacctaattgaattccagaccaacctggtaccttatccgagaatacatttccccatgacagccttcgcccccatcgtctctgctgacaaagcctaccatgagcagttctctgtgtcagacatcaccactgcttgctttgagtcctccaaccagctggtcaagtgtgatcctcggcttgggaagtacatggcctgctgcctactctatagaggggatgtggtccccaaggaagtgaatgcagcaatcgcagccacgaagtcgaggcactctgttcagtttgtagattggtgtccaactggtttcaaggtgggcatcaacaatcggccgcccacggtgatgccgggtggggacctggccaaagtccaccggtccatctgcatgctgagcaacaccacggcgattgtggaggcctgggcccgcctggaccacaagtttgacctcatgtacgccaagagagcatttctgcactggtacctcagagaaggcatggaagaagcagagttcttggaggccagggaagatctggcagccctggagagggactatgaggaagtggcgcaaagtttctgaggcatgtatgatgggtgcaaatgaatgtcaagttaaaatggcatgttttcttttcaagccgttatatgcctagtgggtagttcccctgatgagcagaaaaatgaactcaaatcaggcaagactctaggttccacactaaattaagtgggtcagtaccaacaatgaacacattatttcctggtctactggtacaagtcagctctgctacctgggagcctttggaagcttagagtcctttgaactgctgagtcacttctaggtgggatttttttgttttaccaagagacaatgaaatcctaaagtttatgcttttcctttctggtaccggaagtagaaaacagcacatgttgattacgaatgttttttcccccatgtctacattttttacactgattaaatcataaatattttcagtatttattaaaa

SEQ ID NO: 509540 - DNA, 126 bp, Homo sapiens
tcacgggaggtcaccatattgatgcgaacttagtgcggataccgatcggcataggcactacagccagaactcctggactcaagcgatctccagctcagctcccgagtagctaggatacaggaacgc

SEQ ID NO: 509541 - DNA, 810 bp, Homo sapiens
  misc_feature (380)..(380): n is a, c, g, or t
  misc_feature (504)..(504): n is a, c, g, or t
  misc_feature (734)..(734): n is a, c, g, or t
  misc_feature (753)..(753): n is a, c, g, or t
ttacccccattttatagatgaggcagttgggtacagaaaggtttttttgctcagggtcacacatctggggtaaaggcgggaaaccatcttgggaacaatgggacttttcttattttgtaatttttgagactgggccccattctgtcgcccagcctggagtgcagtggctcgatcacagctcgctgcagcctcaacttcctgggctcaggtgatcctcccacctcagcctcctagcggagaccacaggcgtgtgccaccacacccggctaaaattttttggtagagacagcgttgtccaacatgggctcaagcgatcctcccacctgggcctcccaaagtgctgggattacaggcgtgactaccgcgcccggccccaactnttttttttctttttttttgaggactcccactgttccccaggttggagtgcactggtgagatcttggctcactgcaacctctgcgctcctgggttcaagcgattctcctgcctcagtctcctgantagctgggattacaggcacccactaccatgcccggctaatttttgtatttttagtacaggcggggtttcaccatgttggccaggctggtctcaaactcctgacttcaagtgatcttcccacttccgcctcccaaagtgctgggattacaggcacgagccactgtgcccagccccatctcactttttttttattatcccaaacaaactctgtacctattaaagtccctatnccctgctcccccacccttnataaacacattctactttctcttcctatgattttgacaactgtagcaccccgtaaga

SEQ ID NO: 509542 - DNA, 880 bp, Homo sapiens
ggagaggacagggtcgcggcgggcggaactggtgtctccttcacttcgccctccagctgctgcagttgctgcccgaacgcgagcgtgccacaatggcgggtttcagccaggtcgttagacgcgcagcggagtggtccgtgcgagtccccctacaggagcagcaccagacttccctctcttcccgcagggctgcgtccagttagttgcagaggcgcaggctggaagcagacttggcgccgcggtccaaatgttgtattctcatccgaatcgatattggctggacgctgtaggataggaaagctcgccacagatgatgactctttcagcaaaatagggaatatgaggtaaccgtggtcagggtagaaaatcttggactgctgaagaacgaatacgtcggttgccagtgggcggtgggaattttatcaaacctgggtacctggtattcattgcttagatttacaggtacgaactggtatataagattaatctgggggacgcattgtgacggactcacaactagcgaatgttggatggtgtagttatggggtcatggtatctatttccacaaggataaatgtgggaaccaagcgtgagtagacgagcatcatgagggagacgagtaagatcgggcaaatttgaaaggaaccgcagagttgtggttcaaagtgctttttagaatagagcgtagaagcaagtcttgggagtaagctaaactcgtttacttcgatctcaaaaatccacatggggataaagaagataaagtggggttaaaaatcgcaagtcgtttctttaacaaagaagggtgaggttggttatcaatagccatttgcgttgtaggtagaatggtttggacctttttggattttttgcggccttggta

SEQ ID NO: 509543 - DNA, 539 bp, Homo sapiens
cgggtggctcgggcacggtggtcctgcagtgttgctggtctctacctggggcctgtgctgctggtgcgcagcctgtgcccttgtggcctgggtgctctgtgtcaccctgctgcagctgcgcgtcttcccagttgctgcccctgtgctctgtgtgcctgtgccctgatggtggtgtgctgcctgactgtgcatgctgtgtgtgtctgtgtggcctgatgtgcctgatgctccaggccaacccttatctactgacctgctacctgctgacaatgatccatgcttgcttgctgcatgtgtcatgacccatgcttgctttttgatgtccctgccttggatgaaactgcatgttgaatttctgtgaatgcatgccaagttgtgtgtgcatttccatgtgcaatgtgtgactttatactcaaaagttgttgttgggaaccagaactgaccaggacttgcccgttgtggtgcaaacactgtccttgttgaaccatggatgtgactttccactaagcgtgcacaatgaccttctcacggtttccaat

SEQ ID NO: 509544 - DNA, 107 bp, Homo sapiens
tcgctctcccacccagcttggccccctgcccgaccacctccctgggaaccgggcctgtacatagcgcacaaatgtttgttttaaataaataatcaaaatgtcaaaac

SEQ ID NO: 509545 - DNA, 867 bp, Homo sapiens
tgggaaaccatctttattaatctcatataaaaataaggtccatggacggccctcggggctggggctgttgcgggggcgaggtgccctttatgaagttacagggccaggcctccgtgcatgaggctaagatatggctattgggagggggctcttagggggggtgcgtgcaaggcagcattggggggaaggggcgggcgatgctgcccgtcgtgtggccaagaggaggatgcaccagcccgttagaggcgggccacagcggaggagggggctgcccggccagccgagcgtgaggaccacctgtcctggagagcctacagcgcggtccagggccccagcacccctgcgagaaatccaccgggcaaaaataggcggctacagcgggagaggtccggaggtgacctgccaggaggggggccccgggggaacgccgaacgggccatgtggcgcgggcccgtgagtctgcgcggatgtagggctggtatccgccgacatctgtgaagatgctcctcccaagggcccccaatacacgagtccgttcctcaataaaagtgaagtggcccctatcgtgatgccacaggatagcagcttcaagaagattaagggtccatcattgaggacgcaggggccatatgggagcgaacatgggcggtgcagggcgggctcctcctttggcacggggtatctaaccagcatgccatccgaggagcaggcgggatccatttatcccaatggtccacctcctgaggccaagctactagagcgcctaaagaaacggcgtaaacagaggaaaaacacgcctgggagatatcacacggagccacacagactccacccaaaataaagggctcgtcagctggtttcgcacat

SEQ ID NO: 509546 - DNA, 744 bp, Homo sapiens
agcggggcgtgtgcttgtggcggctaggcccgcgtgcgctggagacctccgtgctggcccccgcgagcctcctggccctggccctggcgctgcggactctgccgcagcggcgagcatgggtgagcccccgggtgcgcagtggctgagtgtgcgagcgggcctgcatgcttcggtcggcgggctgcctgctacgtgcatttacatggcgtgacccggggtcggcggcggggcgacctgcgagctcagggatacgcatccgttcgaaggtccagcagaaagacgtataaccatgattggtacgatatgactgaatgtactacaatgctgaacagacttacagaagacgtccgtttaccttgctggagctcgaaccgtgagtgcatcctgtaacttacttgaaagagctatgattacttagggtaacaatgcaggccttatacaagattaaccaagctattattcgatgacaagtgggtgagtatcccaacttgaatgatgacacgaaaagtcaaccattccaaccagaagttattgagagcacgaaacgctttaacattgcactaaaactgacctgacgtgtagaatgttgacatgagtcaaagtcacagataaccgggatgcgaggttttgaaaagcagcttctagaaagtgtgtcttgagagatccacgccagtgacatgaaggggactacatcacgtgcccaagtggatacatccaatccttataccctttatgacagccacg

SEQ ID NO: 509547 - DNA, 612 bp, Homo sapiens
agcggacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagcgtttctgtagcctccggatacgccgtttctttttcaggggcgtagctccctagccaagctgctccccgcggcggcctgacacgcagcccgagtcgccccctttccggagctccctctccggagctgtggagtccaggcgcgtagcggagatcccatggatccgtgggtgctagtctgggcccgttccgccaacatgacctctcgtcggggcctggaccccggttcctgtgtgctgccgctgtctgcatgtcgcggcgtgtggggcttcagcctccgtaccggccccggtggccgtagagccggtcaatccatgagaagcttgcttggtgatcacgtgtggcatacagctgacacccgacggggtacctgcgtgttcctgcgctctgcggacgttcttcaattagaactgtgcgggacccttgggcctgggagaaggagtggcgatggaga

SEQ ID NO: 509548 - DNA, 380 bp, Homo sapiens
gtcggttcgtcgagaaacagaatgtccggttcatgcatcagcgaacaggccacgccagccgctgtttaaaacctaatggcagttcatcggtggcgtgggagcgatacttttcagccgaacgcctcgctcatgcgggagattttttcgttctgcgcccgaccgcgtaagccatacacaccagagaaaaagcgtaaattctgttcgaccgtcaggttaccgtagagcgaaaatttttgcgccatatagccgagatgggcgcgcttaccggaactctctttcagatccatccccagcaccagcgcctggccggaagtcggcaccagcaaaccgcacatcatcttaaaggtggtcgatttacccgcccgtttgccccagcaaac

SEQ ID NO: 509549 - DNA, 521 bp, Homo sapiens
  misc_feature (1)..(1): n is a, c, g, or t
natatgctgtctcagcgaatcctcaaaataacatggtgagtcaccctgccccaacacccagaccctagcgcccagaacatgaggccccgcgcgcctccctggccttttgcgttggcacagatttggggaatgtggttggcccagcgtgacagccaggaactggggttgagattctggttaaggacttttgggggttttgtacagcttgtcctccattacggcaacaggaagaatctttttgcagttcctaagaattacaaaaataccgcagctggaggagaagaggaaagcctcccgggaagaataggcccaaataatgtctgtagatgccctgccctcaaggacccagagcgcgactttgcactcctttagtgtgtgctgcgcacagcgaggtccttccagagagcactgtatggaagggggcaggagtagccttgcagtggagaaaccagacacactcagcctcagccaggtgatcaaggtcaacatcgacaacaacaagccagttagacagcatatca

SEQ ID NO: 509550 - DNA, 681 bp, Homo sapiens
atacccaccagacatgtgagtctcaggatctagctcatactagccttagattattctctttcctttggcttcccatttacctcttctttccacaggtaaatcagtggcacagtatactgcctccttgtgcctctggatcctgccacttcacatggccacggtattgagtggccatgtgagaaatgcgaatcaaaaccacaatgagataccatctcacaccagttagaatggcaatcattaaaaagtcaggaaacaacaggtgctggagagaatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgttgctataaagacacatgcacacgtatgtttattgcggcattattcacaatagcaaagacttggaaccaacccaaatgtccaacaatgatagattggattacgacaatgtggcacatatacaccatggaatactatgcagccataaaaaatgatgagttcatgtcctttgtagggacatggatgaaattcggaatcatcattctcagtaaactattgcaagaacaaaaaacaaacacaactattctcc

SEQ ID NO: 509551 - DNA, 308 bp, Homo sapiens
gagattcgtatctaggcaacgatatagccacatattccctggtaaaattcaggagacatagggcaccatgacctcagcacactgaactatatggcgatatagccataatatctgcagctccatccagtctagaatcgtagagcttaggaccaatcagaaaatataaatccaccattttgtcatcttcgcggacgagggtacgcagtcaaaaccagattacagtgggcctgcacaacagtagcctagagtcgtctagacctagggcttctagcgtcctggtatctgcaatgctatatactaccggtaga

SEQ ID NO: 509552 - DNA, 342 bp, Homo sapiens
attcctcagaagtgttatgttagtgagttaatcagtaaatgtttctttttaaaaaaaaattggggccgggcctggtggctcacacctgtaatcccagcactttgggaggccaaggcgggcagaacacctgaggtcaggaccagcctgaccgacatggtgaaacgtcgtttctactaaaaatagaaaatcagccgggaatggtggcgggcgcctataatcccagctagttgggaggctgaggtaggaaaattgcttgaacccaggaggccaaggttgcagtgagctgagattgcaccattgcactccagcctgggcaacaagtgggaaactccgtctcggggg

SEQ ID NO: 509553 - DNA, 492 bp, Homo sapiens
  misc_feature (451)..(451): n is a, c, g, or t
atagaaagaaaaaagggtagactgataatgcagtttgtgtagagtcttcagatatctgtacattctttgaattttggattttcttcaagattctggcagcatgttactccactgccagaatcttgtagtcaaatagtagtagtatcctagaagccaaaagagaatttagagaaagagagaatcactagtggctactgttaaatggaagtccaaacagataagtggaaaatgggcatttgtatgaattttgggaagcgttagtgcccttaacagtaagaatttggttagaattgtggtggattcaaaggctgacagtaaacatctggggagtaagtggagaccagcaaatagagactgatgttttaagatgcttaactccaaaggaaggatgagagtaggctccagctccagggatgtgccagctgaaagctgtagaattacctacttttgntagaaatctttgaaaatcctgaaaaatataagaaaaaaaaa

SEQ ID NO: 509554 - DNA, 596 bp, Homo sapiens
  misc_feature (3)..(3): n is a, c, g, or t
  misc_feature (61)..(62): n is a, c, g, or t
  misc_feature (97)..(98): n is a, c, g, or t
  misc_feature (132)..(132): n is a, c, g, or t
  misc_feature (139)..(139): n is a, c, g, or t
  misc_feature (145)..(145): n is a, c, g, or t
  misc_feature (237)..(237): n is a, c, g, or t
  misc_feature (281)..(281): n is a, c, g, or t
  misc_feature (283)..(283): n is a, c, g, or t
  misc_feature (356)..(356): n is a, c, g, or t
  misc_feature (362)..(362): n is a, c, g, or t
  misc_feature (373)..(373): n is a, c, g, or t
  misc_feature (380)..(380): n is a, c, g, or t
  misc_feature (401)..(401): n is a, c, g, or t
  misc_feature (412)..(412): n is a, c, g, or t
  misc_feature (443)..(443): n is a, c, g, or t
  misc_feature (526)..(526): n is a, c, g, or t
  misc_feature (586)..(586): n is a, c, g, or t
ggnaggacggggcctctgtactcttactacctggcccaacagcagaaaactgactccatanntcattggggggcactgcttgcaaggcacgaaaaannacagggaggcaccagtaggtggagaaggcagggncagtccnccagtnttataagcaccaataagactgacagtaacggcaaggccctcccctggctcccgaaccatggacttcactgtcgcagtcaccacaaggctgcnggcacagaagtcgccctgcaaggggcctgtacggcggcactgcntngggcaggggggtgcatcaggggctgaaggagattcctctgttttctccggaggttgggactaggggggcagcntgactntaggctcagtnccccgtntggggccgggcccctgccccnctttggcagtnccccgcggcagggtcttgtaggagggctganaagccatcagcggtgacacttagatctgagacgaactggacgaggagttcattcccttcggaggagatggagcccgggactgngttgccgcagaacttccccagcctccgggagttgtcgctcacggctccgttgaacacgcngaccgagtga

SEQ ID NO: 509555 - DNA, 176 bp, Homo sapiens
ccgtactcacagcatctgtattcttttggacttttataacagccattggtcaggatattttaaaatcttctacggcctaattttatctgctggattatcagtttgggacacaccggtattaaaatatctcactataatggtagacttctaattcttaataatggggtagtcacaga

SEQ ID NO: 509556 - DNA, 209 bp, Homo sapiens
ccatacaacacccagtaccagatacaaagcctcagtcttcaagtataggagtacaatgcccgcctccgcttgcgcaccgaaccctgctagtgttcccaagcctctcgccgctttagcgaaggtagtcaaggccacatttcgagccacataggtggccgaaagggtctcttatcagctcctggtatctgctccccaagctacagccagca

SEQ ID NO: 509557 - DNA, 81 bp, Homo sapiens
agcgggacggcagatccctcgctgtcctagtcgctgctccttggagtcatgttcccagccgccccttctccgcggaccccg

SEQ ID NO: 509558 - DNA, 855 bp, Homo sapiens
aactagtctcgagtaattttatatcatttgggaccgggtaaacttaattggagcctccgagcaggccaggtgttaagggcaccagtagtgctgcaggcacgggggcctgtgttgtggccagctgcaggtgatctcgggtggtggactccgaagtgtactccaaaaaggtcccggaatggcaggggaccagctcgggcactgaggcgctgcatggcaggctgttctcagacaatcccttctggcgctgtccgctggtctggggggctagcgtcctccggcttgccagaggacttgctggggggctgcgtgggagatgtgctgctgctgagagactggaccattgggtagaaaccggtctgaggtcgactttgggtgcctgcagtgggccccgaggaacggaagggctgactgggaggggctgaggaattaccaggcggtctgggtgtgttggcgaggaccagttgggagcgtgccctgtgccgacgcttggccctgggccctgccggacaggcgggagccaagtaagatgccagatggcagctggcttgggatccagagttgggggtgaccgaggactgggacgggagacatggccggacggggggcatagagggagaccccccaggagcacagtgcttagaacccgaaggaacatggaaggcgcgctagtgaagcggagatgcgctagaaaacctggtgagcgcctggagagccctgggagcggcccctactacacaagccaggacgccctgcgcagcccaagaggacggacacaagtaccaacagggaggagggacagggagaggtaagcatccaggaataccgacggcggaaaagcgtccgccgagggggcaa

SEQ ID NO: 509559 - DNA, 1331 bp, Homo sapiens
tcggaaggaaacgccgccggcgagcccagtcacgccgggagggccccgaccgtctcctgactggggccgggggctcatcgaggcgggtgcggcgcgtccgcctcaccccgggccgtcttccctccatccgttccagggacctcagcatcggagggagtcaagaagaaaagcttcagcccaaatatcatcagtcggaagatcacggacgagcccaaggaagaagtaactggtcaagaaaggagaagcgtgaacggggacagagaccgaagagagagggggcctggacgaggggcgaggccgtccaagaacagtggatccaagtctcactccaatctttggaggcagggcccagcccgaaatgcatgcaggcccacaccggggaaccgggggcattcacgaacacgggcattgtgtccagcaccagtggcacctttctcgagtatcgatcaagagtcaaaacaaggagacagaagagagacaagacaggacggaaacgttaacaccagatctgggcgtatgggtggagaaagggagcgattgtcatcgaatgaccccggggcttgggagggaacgagattcggaaaattattggccttgttgcagattggacggagtagggattcaagctccagggatgggcgtttaacaagggcatgcaaaaatgtggagaaaccagcatggttaaaccgttgggatggttgtgaccccagggaacaaggcacatgggaggtgcgaaataacctggtggggcaacgtgtgcacagagggaagccaccgagcattgacgggcggcagacgcccaccccatgaacgggcttccatcacaaaaggaaggccagggaaagactgcaggagcatccacgaaaggcaggtatctcggggagcagagacggtgaaggaagctgagactaacccaagggaggagacacccggctgtcgtgcacatctgcggaaagaaccccctccctggggggaagagaccacacgccagggaggtttaacggccccttcaaaacacacggggcggcggagacgagccccagtggtgctacacacagggacagacacgagcatagaatctgaaaaatatgtggcactgtgtggatagaacgagacgacggtaagaaaaacctcacacgttggagacagacaccttagaggagaagaatgagaatagatgaatacggtcaaataagtgcagtcgagatgcatgaaagaaaggccagagagaacgattgtgcatgctaataacatgccgatggtctgttctttcttcttctgtttgctcttctcgttctctcgtgatacaggcagctcagaaaaacaaaggc

SEQ ID NO: 509560 - DNA, 822 bp, Homo sapiens
  misc_feature (130)..(130): n is a, c, g, or t
  misc_feature (185)..(185): n is a, c, g, or t
  misc_feature (195)..(195): n is a, c, g, or t
  misc_feature (198)..(198): n is a, c, g, or t
  misc_feature (203)..(203): n is a, c, g, or t
  misc_feature (208)..(208): n is a, c, g, or t
  misc_feature (247)..(247): n is a, c, g, or t
  misc_feature (257)..(257): n is a, c, g, or t
  misc_feature (286)..(286): n is a, c, g, or t
  misc_feature (319)..(319): n is a, c, g, or t
  misc_feature (331)..(331): n is a, c, g, or t
  misc_feature (334)..(334): n is a, c, g, or t
  misc_feature (352)..(352): n is a, c, g, or t
  misc_feature (371)..(371): n is a, c, g, or t
  misc_feature (385)..(385): n is a, c, g, or t
  misc_feature (394)..(394): n is a, c, g, or t
  misc_feature (402)..(402): n is a, c, g, or t
  misc_feature (418)..(418): n is a, c, g, or t
  misc_feature (422)..(422): n is a, c, g, or t
  misc_feature (424)..(424): n is a, c, g, or t
  misc_feature (433)..(433): n is a, c, g, or t
tttgtaatatattcatatagcagaacattattcggccagaggaacagtaacagggcacatcaggggaaactcgaaacctacggccataaaactccctattagagagtctacagataaatctacagagacnattcctcaagtggacttggccatgatggttgtaagtttatcatctgaattctccntatgtagacnacngaacnaaacnaaatatggtttttaaaaaatgaacaatgtgcggtatgcnaatgtagccnataatatactcaactggaaaatgaaatgnaaagataatactggctgggtatggtggttcacnccttttatcccngcncttcgggaggctgaggcnggaggatcgcttgagaccnggagtttgagaccngcctgggcnacatagcnagacctcatttctacnaacnanaaaaaaatnggcccggctggtgtacttgcctatagtcccgccttagcctcccaaagtactgggattataggtgtgagccacagtgcctggcctaattattttctgtgtgatcaaattcaggtttaatgttttcggttaagaatttcctacgtgaattcgtgtacttatttcgtcatttagagttcataaatattagggtttatttgtctaaatagaatagtttaaactaaatataacttcaaaacggtctagttggagtagctaccggtgtctggatggaaattttcgtgatactgaaaaggaacaaaaagcctgggttttctgccagaaccttttgctcccccagtcagtctgtggagcagactagttaggggcccagagtcggcttctgtgtggtg

SEQ ID NO: 509561 - DNA, 496 bp, Homo sapiens
  misc_feature (21)..(21): n is a, c, g, or t
gtcttttgaggagaagttggntcaaagcacgtcagaagcaaaaaaagctgcagaagatgaattaacaaggccccatggccgctctctgggtcctcggtctaaacaaagatgggcacttcttttgatatcaaggcttgaggccaggcacagaacagacattcaacaactgttggtgcaatcggctatgctaggagccatatccaccaaaactgccgtaagaatgactctttaatgcactttcctccttgtcatgattcaccccaactttttgaaaatttgtgttccgaggccaagcacgatggctcatgcctgtaatcccagcactttggcaggctgaggcgggcagatcacgaggtcaggtgttcaagaccagcctggccaacatagtgaaattccgtctctactaaaaatacaaaaatttagccaagtgtggtggtgcatgcctgtaatcccagctacttgggaggctgaggcaggagaatcgcttgaaccgaga

SEQ ID NO: 509562 - DNA, 208 bp, Homo sapiens
ggatccccattaacaggctgagataggagtgattgcttgagtccaggagtacaagaccagcctgggcacacagcaagatcccatgtctaaaaaaaaaaaaaacccattctagtgtggccccttatttatgtaaaacacaataaggctagggcgcagtgcctcacacctgaactccgagcactgtggaaggccgaggcagaacgatcac

SEQ ID NO: 509563 - DNA, 502 bp, Homo sapiens
  misc_feature (428)..(428): n is a, c, g, or t
  misc_feature (453)..(453): n is a, c, g, or t
atgaattaaagtatatgatgccagcctggacaaagggcgaaaccctgtctctacaaaaaatacagaaattggctgggcatggtggtgtgtgcctgtggtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattgtatgcaaatactgttttttttttttttaatttaaacagtctcactgtgttgcccagggatggagtgcggtggcacagttcttggctcatgggcaaactctgcctcgcaagcagctggggactgcaggcatgctccacggtgccccagttaattttttttgtattcttagttnggagacagggtttcgccattttggnccaggttggtcttgaaatttctggaccccaggtgattcaatctcccaaa

SEQ ID NO: 509564 - DNA, 114 bp, Homo sapiens
  misc_feature (76)..(76): n is a, c, g, or t
  misc_feature (96)..(96): n is a, c, g, or t
cgcgtttaagttttttactctccaaatgtaatacaattcttcagctaaatcaggaataatgagacaaaacgctccngtaaagtacagttttaaaanattgttcactggtttatt

SEQ ID NO: 509565 - DNA, 335 bp, Homo sapiens
ggaatttgtggccagcctgggcaacaaaagaagaccccatctggccaacatggccaacctggccaccacggtgaaactctgactctacaaaaatgatctgggcatgggtgacatgcatgtgtagtcctaactacttggggggttgagatgggaggattgcttgatctcagaaggccaaagctatagtgagctatgatcacatcactgcactccagcctggatggcacagggagattctgtctcaaaaaaaaagaaatatatatttaatctctgtccctggttcctggcacagagcttctaaagctcttacaaagacctcagtgatagatgtgact

SEQ ID NO: 509566 - DNA, 269 bp, Homo sapiens
gatcttctagtctccaggcatcaaccacaaatgactcaggttacagagcaagaatttcccagttggaaaaagggaattgatagaagatttgaagtctttgcggcacaagcaggtgatacatcctggtcttcaagaagtgggcttaaaattgaattcagtgggtccacaatgagcattgatcttaaatactttggagtacagttacccttggctccagctactagctttcctttttggaaccctacaggacccaaccctgcctcttctta

SEQ ID NO: 509567 - DNA, 448 bp, Homo sapiens
tcgataaatatatacacaaactgtgatctacctaatggataatcaaaaacacctcaagtggcataactactcactgtgctatatgcaatagagacccctctctatattgggaaaaccctgtcgatgattttctatctgaccaaacacactagatactgaatggagaacttccgatacagcatcaagccgggcattgatttcccttaattaaggagtggctgggtcacccactactttaacttccgtctcccaaatgaagtaaaagtgtggtctaaaaacccacagcaaacttcctttggttatcatatcagtctgattctgtaggatttccagataccttacagtagttccattaatcgtcatacataccatatagacttgatagctagtataaaatactcaggtatggagagcaatcgtatccaagttgaattctaggaggaattta

SEQ ID NO: 509568 - DNA, 937 bp, Homo sapiens
  misc_feature (666)..(666): n is a, c, g, or t
ggggagaaaaaactatcatagttctgaggcaagacttcgacttgatagtgctatcagttccccgatacaggggctcagagttaacccatacatgtatttgtggtgcaggtagagagaaagtggccatttacactgaatgagtggcattctgatcaatgtcttgatctcttatagcgattagcatagtaaattgtgtgaaagcatctagttgtgatcttaaatagcgcataagtgaatattctaggaagtgaggtgacagttagtttacatatggacattatacgatgtctagaatatctcactgttgttttaacaaagacatcatgggggcaataattggtcttaagagggttgactacttggttgacatacaataggttggagatttttattttctggtaggttaccatatagtttctttgaaagcaaaatgcaacgtgagtttgagaggttgagtctttatataggttgtcgtgggtattactctgtttaaatatataagtcttctaattctggttgatcaggtactttgtcttcgtagggggtatttatttgggaggttgaaggcaggagtgagtcggtttgagggcccagtattttaaaggcctgccaaatcctgttgttgaactcgctagggtgaaccagtggcttagtcactgggtcaancattgttgtgtatcttcattttcaaggaaatgttacccagaagtgtcggcatggacctgctgtctgcatggattggctccacttcaccttgatgaggtacttcccttttcggtgcagcctatctcggtgggttcacctgctggtccaagcatttcttttcctccctctgtgggcccaggtgcccttcgatgcctcgcggcgttctgtcccgttgggccttgcttaacccgttggagtgtcactcaccggccctcgtgcgccgcgcgctcag

SEQ ID NO: 509569 - DNA, 365 bp, Homo sapiens
ggttttccccttggaaaaggggggggggggccccccccattttttttgggttgttcccccctttggggccccccgggtttccccttttgtctcccggccgtttttttggggggaatggggggggggtacccttttcccccggggacccctttttcctggtttggggtttttttcggcccccccttgggggttttggcccccggggcccaaatttgggcccggggggtggtccccctggttgccaacccctttgcccctttttccccccggccaaaaaccgttttttgggggggggggggggtttttttaattggtttttaacttttgtttaaagcccaattaattttagggtttttttcccggga

SEQ ID NO: 509570 - DNA, 174 bp, Homo sapiens
gcgctattagaggatcccgggctacgtgatcctaatgagagaagatcgtagagcttctcagcgtaattccagtttacattagaaatgacttgactgagccacacaaacctttaactcagcggcttccaggaataagtcgagaagcacgggatttccgggaacaaatttggacat

SEQ ID NO: 509571 - DNA, 403 bp, Homo sapiens
ttgggccccttggaaaacccggtggtattccatgaaaaaaacccctatgaaaataatccccttcaacaggctcccaattggagaagggcagcaaccccccctggggggagccaaacaggtcagaccagagccccctgcggaaacaaaaaatgaccccctttaccctgaggatgatttgtagaaaattaactgctaatttttattgacccccaaagtttcagaaattctctgaaagtttcttccctttttcccctacaaaatttattgatttcaagttttctattaagggcatttagccttcaatgggaattaaaacccctttagggctggatttcccaatttctgatatcaaagttatttaaaaattgtttatttgaggagataacatttcaactttgttccc

SEQ ID NO: 509572 - DNA, 588 bp, Homo sapiens
  misc_feature (434)..(434): n is a, c, g, or t
  misc_feature (549)..(549): n is a, c, g, or t
acgggggctctcatcacgagaacttagagcccttcccagagagcccttttggtccctcttggcaaggcacacgggggcagggtaaggatgataatgacatttcccagggacaaaccccagagcacaggtgagggcctcggtcatgggctggggccgcaaagctaactaataatggtgacggctcttatgtctcaaattaattaaaaacgaaaaccctagtgtaaaaagaggacaaagggtaacgagttcggaaccaacaccaagaacttcgaggtgcgggtggtttcctaaagcaacatctggactacccctgtgggctgagggcagcggcgatgaagacatgtgtgagggcggtttcccaaattccaggcgcttccccaaccttcagacagagcaaaccaaattaagctgacataacagcggtgacaaacggnctagcaccggggcccagagagttctacgggtgaccatcaagagtcgggagcagggtctcacagggtctcaattttctctccggtgaaatgacgaagaggacactggctacctggntctcagattccagggtcacacaaaatgcccagtctcaga

SEQ ID NO: 509573 - DNA, 260 bp, Homo sapiens
ttgctgaggctggagtgcagtggcgcgatcttggctcactgtactccagcctgggtgacagagtgaaactccatctcaaaaaacaaacaacaacaacaaaaaacaaaaacaaaaaacaaaactacaaaacttagccaggtgtgatgcatgcgcctgtaatcccagggtggctgaggcaggataatcgtttgaacccgggaggcggaggttgcagttagccactgtgctccagcctgggtgacagagtgagactaggcctc

SEQ ID NO: 509574 - DNA, 969 bp, Homo sapiens
ggttcgtcaagccctcaggctccgagtcttgccatgagggacaggagccatggtctcagaaaatgaactgtggatgcggtgcctcctctggattccagggctgatggacctccgctacgaagacatgcgcctatgcttatgacatgaccattgaagttggacggccatcgtaggatcgtcagaggctccaccatacataaccctagggctcaccggtagctagtctaagtcacccatatgttcacaggccccaaggttgaccagatgaagattgtgctagatcaattcaggtctcaagcacgtctggccgttatggctatgtcacgatctttaaagtccagaatgccagtcaaacataggccacaatatgcgtgtactatggattgtcgtcgtcgagtgcgtcataaatgccagatggaatcgttgcctcgagactacgcgagcccacatggcagcctttaagtccctatatgctagcccgagatagggtccaaatgctgccttatgactttttcccaggcagcaacacactggtgagttagctgctaactaaagtctgacgatcggcgcttcaaggtgcccagaagtgccatcatacgtaaagtgggcccaaaatgccacatacaatttctctcagtcgtctcaatgccaatgacctggccaaacagcaggcctaagaccccgtttcaaggcttggaattgataccactaaggccccaacgagctgatacccagacccagaatgtcaatcaggccaaaatggcacttcccaggctgacatagaagaccgaggccaagggtatctcttgaaccttgaccggttgcaaaactgacaagaacattcagcagaattggtttcccagggctcagaaatcttgtagttccccggaaccaataattccgggggcaagagggaccccgcacgcattactaactttcaactgttcgcagacgaccggacgtggggac

SEQ ID NO: 509575 - DNA, 255 bp, Homo sapiens
ctcacacgccgagcgaacatacacttcttaaggtcaggtcacaagtggacgaagttgttgcagatccgtgtggacgatagtggttgctgcacacgccgaagaaccaaacctcaggtgatccacccacctcagcctcccgaagtgctgggattacaggtgtgagccaccacacccggtctctctttttatttaatcgcaacaacttcgtccaccaggacctgatttcaagaagcgtctggaccttcggcgtgtgca

SEQ ID NO: 509576 - DNA, 1593 bp, Homo sapiens
  misc_feature (86)..(86): n is a, c, g, or t
ataagcatcaccaggatccatctcgtgtgactactggaaacggcctgatgcaccgttgacttcgtggccgattccgatcagatgcntagcgatgagtcgaatgagaactaactgggacataagtggtggccgcccttatctattgacttccttgcacatccgtcgactgggagcttctacaatgtcacgcgcatggccatgtggaatcctatgacaagctaatcgtacaacggaatcagggtagtgtctcttgcagatggcgatccgccaacgctatccgtcttccgcttgggtcaccatagatagctctcgtatgagcttacacaggagtccatcgttaccgcaaccgctaactggaaggctatgctagctcctgctcgccatgcgcaagtcctgaggtagattccagaacatctgtctcactcacgctgcggaggatactcaggattggcgcgcgcttggtatctcttctacactcgttcgcttcagcctttcctactaactgtgcccgctcctcgggtgctctggagcatgagatgccgtgtagactttggcctgagccactctcgtgatccgatgatgagctagacacatccagatgttgtctcccctagggatcaattctcatctctcgagggctccacgaggttagattctcgcacaccttaaatcgtcgcatcttggtgtgagagagctttgcaaaggcgttgaggcactgcgtagctccttgaaagattcgttgatccgtcaatgcgcaatttggtagcaaaaaccgtcggcgtcagaggaacttggaaggcacttggtttggctcctccttgtccccgtcatggtccgtcctggatttgtagaccatgagaaaagcgtgcggccctactagggaacgagtgcggatggaacttcccttttccatctacaatttccctgacctagttcgaagagctgtgttcgttttggatttgtctcccacaagcgatgaaaaattgcgctaaattctaaaggtgttgtgcccagttaatgtcatggtcaacaacaagggtgcgttacaaaacccgaaatctacagggagagggcccaatttgaatagtgcccctattattgtttgaatagtcgccctagtaatggtaacgtttagaactctcccccacaggggcccccggtatgcatcgccgaggagaaaagcaccacgggtgtgggagggcaccctgtaagcacaacgacctgtgtataagcccacacaccgagatctattgtacgaagtgactgtataccagagacctactacaccaaagaattaatatcataggtggcctcccccaaaattttgtagggaggaatgttatacaaacaagaataaaccaggccgtagactcagcataagtaagagagagaccaacaaatactatatatttgagtagtgaatcttagtagctaaaccacagacgcacgagaagaataataatattgcgatatagcaagaaaggaacacacaaagatagttcagctgtatactacacaagctgatagtattactaacacactagaaacagagatacagattacgtttacacatgcagcacgtgactgacacaa

SEQ ID NO: 509577 - DNA, 535 bp, Homo sapiens
atcacctgaggttaggagttcgagaccagcctggccaacatggtgaaaccgtgtctctactaagaacacaaatattggccaggcatggtggcgcacacctgtggtctcagctactcgggaggctgaggcatgagaatcacttgagcctgggagacggaggttgcagtgagccaagatcacaccactgcactccagcctcgtgacagagcaagactccgtctcaaaaaaaaaaaaaaaagaaaaagaaatttcacaccaaaagaactaccttcttgcagaaacagctaactgtaggtctgggacatcctgacatgccagaaagcaagtaaaatatcaactattgctggggtaatgtcaaaaggacacaaaccaattaaaatagttccttgctagtcaaagatggaaaaatatgagcaccaaaggaaaataagatgggattctgcttctagtcaaggtatagaactggcactggatttatcctcccatcataaataagaacaagaaaactgacataatatatgaaataacacttttc

SEQ ID NO: 509578 - DNA, 1387 bp, Homo sapiens
  misc_feature (9)..(9): n is a, c, g, or t
  misc_feature (67)..(67): n is a, c, g, or t
  misc_feature (92)..(92): n is a, c, g, or t
  misc_feature (94)..(94): n is a, c, g, or t
  misc_feature (103)..(103): n is a, c, g, or t
  misc_feature (287)..(287): n is a, c, g, or t
  misc_feature (318)..(318): n is a, c, g, or t
  misc_feature (352)..(352): n is a, c, g, or t
  misc_feature (366)..(366): n is a, c, g, or t
  misc_feature (375)..(375): n is a, c, g, or t
  misc_feature (387)..(387): n is a, c, g, or t
  misc_feature (491)..(491): n is a, c, g, or t
  misc_feature (494)..(494): n is a, c, g, or t
  misc_feature (498)..(498): n is a, c, g, or t
  misc_feature (500)..(501): n is a, c, g, or t
  misc_feature (536)..(536): n is a, c, g, or t
  misc_feature (591)..(591): n is a, c, g, or t
  misc_feature (602)..(602): n is a, c, g, or t
  misc_feature (961)..(961): n is a, c, g, or t
  misc_feature (963)..(963): n is a, c, g, or t
gtgataaangctttcaaaaccgtaagcccaggaagggaaagtgtccaggaacctctgttttatgagncccccagatctgtggattggagagngnaaggctacntaactcctgtgaagaatcagggtcagtgtggttcttgttgggcttttagtgctactggtgctcttgaagaacagatgttccggaaaactgggaggcttatctcactgagtgagcagaatctggtaaactgctctgggcctcaaggcaatgaaggctgcaatggtggcctaatggattatgcttnccagtatgttcaggataatggaggcctgaantctgaggaatcctatccatatgaggcaacagaanaatcctgtaagtanaatcccaantattctgttgcnaataacaccggctttgtgaacatccctaagcaggagaaggccctgatgaaggcagttgcaactgtgggcgcccatttctgttgctattgatgcaggtcatgagnccntccngnnctataaagaaggcatttattttgagccagactgtngcagtgaagacatggatcatggtgtgctggtggttggctacggatttgaaagcanagaatcagatnacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtntntaaaaggatgtataaatttttacctgtgtaaataaaatttaatttcaaatgtagtggtggggcttctttctattgttgatgcactgaatgttgtgtaagtaacatgaacatagattgggctctaagccatacactggacaaggaaaagctccaaaatccatgaactgttggagggctctgagtcgcacagaaaccttgtattcaactagtgtcggggggcgggggcccctcgcggtggggtcactagggagcaagagcgcactccagagccaacaccggcgcgtataaagcagcgggcggggacaacccacaagtaaaaaacccgggaagggcaccgcgaacgttcgagaaagagccccaagggagtccagaaggcaaacagagagcaataccacaggaggcccaggaggcccagacaaagcga

SEQ ID NO: 509579 - DNA, 518 bp, Homo sapiens
  misc_feature (34)..(34): n is a, c, g, or t
gacctcggggatcacgtggtcagagagacgacanccacaagggacagacttctctgtatcttccaagggatggggacgactcgcttttaccttctcggattactctacttttgcgtgtgctccctggctacttcttagtacgcgccttccagctggttggacggacacaatggcaggaacgttcttagcaacagctctattatgtccaaccctttgttggggctggtgatcggggtgctggttgaccgtcttggtgcaagagatccagcacctcaatgtccatcgttgtcagaatggtgtcctcttcattgctcactgtgcgggctgccatccccattatcattgggggccaccattggaccgtcaatcaccaacactatggttgcgctcatgcaggtgggagctcggcgtgagtaccgaagagctttttgcagtgagccacctgtccatgacttcttcacctggctgtccgtgtaggtgctcttgcccgtggaggtggccacccattacctcgagat

SEQ ID NO: 509580 - DNA, 127 bp, Homo sapiens
tgtgcgtggtcgtctagaggtcccgagagggggacacgggtgccgcacgtgccggctattttttgtatttttagtagagacagggtttcaccatgttagccgggatggtcttgatctcccgacctct

SEQ ID NO: 509581 - DNA, 988 bp, Homo sapiens
ggaaagatgtcgtcgtggcacagtagctggtgacagcagaaatgacccaccaatggaagcagatggcttcattatgttcaggtgataattgtgaagcatccatgacagatacgcgccggatatgccctgtacttggattcgccaacgggtcaattggatgcaacgataggtgcgctgaaagaaaagattgatcgccgtctctggtcgacagtcgtggtgacatggacctaaagttccttggaatgtctgtgttgatgctgccgattgttgtagtatggtatcctgcgtgagacccatgtgtgtagagtagcttcttcagactatccaccgtttgggtcgcttttgctggtctgtgcatgatgagacatgacagatgccggcagggtgtcagtcacaagcacgcttgagaatagaggctgctcggagctgggaaggtcaaccaaatctgcccagaagagctcaagaaggctcaggtcgagtattatcccgtacatatcgtgccgaccccagtcttcaatcgagtggtggacaaaagggtcctccagaaatgttagttctcacagagccaccattctaggtttgagggaccttagaagatcgctgtacctgatcaacccatgccttcgaacagagcttcacaagggaaagggagaagaggtttggggggcactcccggatcgactaggaggccgtggtgggactgacaagttgatataggatgttgaaagaacaggattccgaatggggagaacttgaatcgaagcacttggtgtcaggactgtgtacaagcctttaacccgttatttggccccaaataaacaccatcagccctaggtctgggggcgaacagataccattgcgagtgccacgtgttgttacccccttttgaaagggccacagcgggccatgggtgtgtaaacccaacgcgtcgtgcattcatatccttggccccacgttactaaacagaaacacaactcctccagatttg

SEQ ID NO: 509582 - DNA, 642 bp, Homo sapiens
  misc_feature (562)..(562): n is a, c, g, or t
  misc_feature (596)..(596): n is a, c, g, or t
  misc_feature (635)..(635): n is a, c, g, or t
taaggtttttgaataattttcctgaattcatcttctgtagcacatcattcacgtttaatgactactttatacatggtagtccttgtgcccaccagttctcctgactttctttgcataagatggcaacaaaatcatatgctgttctctgtgagccacaggaagccagcttttcaaaaatcatcacacagagtcttgtaataacatttcctgaatagaatctagggagctttcagggaccacatgaagtcatagaggcagagtctcctataaaaagtgagaaatattaataaatatgtttctcctcatcaaataaaagttcaccaccaaggaccatcttatgacccagagagaaaatatttaatgtctgaaagtccgacaatgaaaatgtggaaagttatgctattttatacctcagatgatgttcagtctgggaaaactcaagataactcgttgtttaaaataaaatgcatgtctaatacacatcaattgctggccatttatcttatgcttttaaaagattatacattaaaatgccatccttcttccctaaaagtttgtgccnggagccagccattccattatcgctccacagagangaccgctggcagggatctcttaaatgacggcgctaaagngatgact

SEQ ID NO: 509583 - DNA, 1032 bp, Homo sapiens
gcccagattattttttgtatttgtagtagagacggggtttcaccatgtcagtcaggctggtcttgaactcctgacctcaggtgatccacccgcctcagcctcccacactgctgggattacaggcatgagccaccggtcctggcctctctttcttttttaaacaaagaactttgcacttggccagagcaggaggcagacaagcccattttctcccttcctaagctagatccaaataacagaaagttcagttttcccccataactattcttggggtcatgaactttgatctggagttagtacagttctcaggaactgtgtgcacccagcttgctgatccaacaaagtctatggcttaccagtctagcttgatgaagcctttggccagaagtcacgccggtcgcatcagcagaaatttcctgacacggtatcatcggggacactagtgacagaaacggccacaggaacaagtcctaagtcgctgcagccggcccgcgacatacctacaatttacagactatcgtcagcttgctttccacattgagcccttgcggcccgactgtcatcgcttgacacattggcaacctcgcaagcctttccagacggaacacattccgaccgtacctccgccttggtccacctgccccttccacacgcaacaccactcgcacgctgcatcccggccctgcaccaaaacaaaaaactccacaacacactcccaacacaaaggcagagagaacacaaaaagaacagagacactggaagacacacataaaaaacgcgggctacacaaagaaggagagaccccccgggttgaaaacaaggtaagaaggaagatcgcacaaaaagcgaaaacacgccccacaactcaaattacacaagaacaaacacgaagcgagacaaaacaaagaccatcaaactacacaccagctaaacgggcgatgagcacggcggcacaccgcagcgcggcagagacacaggtgggccagagaacggaggaaaaccaacacaagacccacaaccaacaaacaacga

SEQ ID NO: 509584 - DNA, 418 bp, Homo sapiens
  misc_feature (32)..(32): n is a, c, g, or t
  misc_feature (56)..(56): n is a, c, g, or t
  misc_feature (65)..(65): n is a, c, g, or t
  misc_feature (90)..(90): n is a, c, g, or t
caagggttacctgctggccagcatgaaacccnggactcccttccccggcaagaggncttggtttncccaggttctgcccttagggagagncctcgaccaggaaggccagatgtaatactgactgcatcgtgttaagatgtgtgatcttattctaggaaacataaattatgttttgtattatatgcctaagagcccacattaagtcttctgattaatttgccaggtttttaatgtgttttcagaaagctgtgtgaaatttcatctacaaataaaaatgatgtaaataagactttgctgtctaaattatggctgttaaagatatgaaatgttttgtactttgattatttttatttcttacacttttcttttatattgataacttgctcacagttaaataaatgtacttttgaacttaaaa

SEQ ID NO: 509585 - DNA, 109 bp, Homo sapiens
aaggctgaagacatacaaaagttagaattcttgaaaaaaagcatgttattgaattatcaacatcactggatggtggataatatgcctgtaacgtggtgtagaaatggaa

SEQ ID NO: 509586 - DNA, 389 bp, Homo sapiens
ccgatgaactgagatcatataggaaaatgaactcaactgtggatcaagagatacacttgatgagactggtgtctatacgaggtcctaggagataaaacagtagtgggaaaatcttcatgaggctgcatctggcacgggggaaagtatgacatcgaaagcaaggacaacaaaagaaaaagataaactagagtgtcatcaaatttaaaaacgttagtacatccagcaacagtatcaagaaagtaaaaaggctgactgtggttgcccacgcctgtaatcccagctactctggaggctggcaggacaatcactggaacccaggaggtggaggttgcagcgagcccagattgtgccattgcattccagcctgggcaacaggagtgaaactctgt

SEQ ID NO: 509587 - DNA, 199 bp, Homo sapiens
tctgttaaggatccctctgacttaggcctggatctgagtgaagtgtactatcccatacaagcccacaggaacaagtcctacaattttaaaaaggttctatggaaaagaattctctttctctacttcccttgcggggcggttggggatgagggtccggtatatgactattgggagagactaccactcatctacattcttt

SEQ ID NO: 509588 - DNA, 340 bp, Homo sapiens
gctcggtcctcagcacatggaggatgaggtggggtgtaatgaactgtctgtcatagggctgtgatgggggcaatggatggatgctggtgcagtggggcaaagaagaacttcaaggtgttattctggaagaatgtgttgaagtcaagctttgaacttttgtgagagccaagaggactgggaagtttggttgtctattaagcaaagagaggagtgacaccacaatgacagtaatccacaacagtcttttactgaaaacctgccatggtcatgccctctaggccctggggatatagcagtacaaaccctgccctttcagttatttattgctatgtaattcacc

SEQ ID NO: 509589 - DNA, 329 bp, Homo sapiens
  misc_feature (52)..(52): n is a, c, g, or t
gcgggggtggacgcggcgatttgcaaatccaaaacgacacagtgctgccgcnacgagctattgagagggaggggggccaggtgaagttgtgttcccgtcatagggagagctgagactcccctcccgacctcctctttcccctcccccggagacagaaagacaggcagacgggacaggtgcccgggccacgcagagacccggagcaccacagcgtcggtggagggggagccccagcctcccccagttctgtgactgccctgcctccggttggacggttgggcagtccacccctcccctcccccgggtgtagcccctgcttagcgattcag

SEQ ID NO: 509590 - DNA, 109 bp, Homo sapiens
  misc_feature (67)..(67): n is a, c, g, or t
ccgttcctcagcccacaggacagtctgagtcctcccctggcccattgaaatatcccttccgtgcccnaacttacctctgatctagacttactcacctccttcctcttct

SEQ ID NO: 509591 - DNA, 100 bp, Homo sapiens
ctcggtaccagggtgcacaaacccaaagcaagtttcaaaatatataaaatttaaaaagtttgtacattagctattcaagatttctccagcactgactgat

SEQ ID NO: 509592 - DNA, 273 bp, Homo sapiens
ggtttttcccctttgggggttttaaggggggggttttgttttcccccccccccccggggggggggggggtttacgcccttttgtttccttttgggggcaaagcccttcccccccttgggggggggttccccagggaccaaaggtttttttccccaggggggggggcccccccctgggggggcttgggtccccgggggtttttttttcaaggggggggggggggggggccccgcctttggggggggttttggaatttaataattggaaatttca

SEQ ID NO: 509593 - DNA, 433 bp, Homo sapiens
cacgtatgagactggctcaagtaatccaataaaaatcagtattactttttaattttttaatttttattttttaagacagagtctcattctgttgccaaggcaggaatgcagtgtcacgatctacagctcactgcaacctccacctcgtgggctcaaatgatcctccaaactcagctgggactataggcatgcaccatcatgcctggctaatttttatattttttttttttatagagatgggctttgccatgttgcccaggctgttctcaaactcctggcctcaagggatctgcccacctcagcctcctaaagtcctcctaaagtgttggaattacaggcgttagccattgcacccagccaaaaatcagcattccattttaaactattattattaataacaaggcattatttttatctatgatgtccggtgtcg

SEQ ID NO: 509594 - DNA, 109 bp, Homo sapiens
  misc_feature (14)..(14): n is a, c, g, or t
  misc_feature (31)..(31): n is a, c, g, or t
  misc_feature (39)..(39): n is a, c, g, or t
tgttattagattantttataaaagaaataanattttaanattgaaaggagaaaagatttaatattataataaatgatagttttaaatattattattaaaaatttgggga

SEQ ID NO: 509595 - DNA, 621 bp, Homo sapiens
agcggctggggagccgagcgcgcggcgcgagcgtcacgccagacagcggcccgcgcgccttctcggcgtcggccgccgacgcctcccagaacctcctcgtgccctcgcgtgccaggcccgctggcggccgaaatccgcggttcacagcatgtccgcctcggaccctgctgctggagggggagggaacccccaaccagcccgcgtccgagaaagaacccgcaaatgcccggtcccagagaggagagcgaggaggcacagaggacgaggacgacgaggcaggcaggcaggcggcaggcagcacaagaaacagagtctcatccgtggcacaggcaagagggacacagcacacaccacgtcacacgaggtcgacaatgcaagtctcttccttacagagagagccatttacaattgcacacggacacaggggcagcacaaccttgtgaacttgagaggatacattctgtctctaaagtaagacgaaaaccgatgaacttagaaatctacagcaagactgctttacaacaggccaggcgactgtgtcctcattaaagaagaatgtgggtcagttcagtggctttccatttgaaaaaggaagtgtccaatataaaaagaaggaagaaa

SEQ ID NO: 509596 - DNA, 796 bp, Homo sapiens
  misc_feature (2)..(2): n is a, c, g, or t
  misc_feature (11)..(11): n is a, c, g, or t
  misc_feature (15)..(15): n is a, c, g, or t
  misc_feature (23)..(23): n is a, c, g, or t
  misc_feature (40)..(40): n is a, c, g, or t
  misc_feature (46)..(46): n is a, c, g, or t
  misc_feature (49)..(49): n is a, c, g, or t
  misc_feature (60)..(60): n is a, c, g, or t
  misc_feature (80)..(81): n is a, c, g, or t
  misc_feature (85)..(85): n is a, c, g, or t
  misc_feature (96)..(96): n is a, c, g, or t
  misc_feature (108)..(108): n is a, c, g, or t
  misc_feature (119)..(119): n is a, c, g, or t
  misc_feature (122)..(122): n is a, c, g, or t
  misc_feature (139)..(139): n is a, c, g, or t
  misc_feature (159)..(159): n is a, c, g, or t
  misc_feature (212)..(212): n is a, c, g, or t
  misc_feature (257)..(257): n is a, c, g, or t
  misc_feature (502)..(502): n is a, c, g, or t
ancccgggatngcanacagctcnggtataagcaacatttnattttnaantgtgtagaccntccccccatattttcaaganntaanttacatttctncatttttaaaanagtttggccanaancctagatgcacgcttcnaaatcatgtacctgcacatntgacctttgtgaacagaaatttgcatgtataatttgtgtttacttgtaacttnctggttatatactgcttatatctgtggattcaagttactgaagtnaataccaataaaaagaaaaccctaggccatgttaattggttatacatgtttggaatgttaaccaaaaaaaaaaaaaaaaaaaaaaaaaaaaaaaaaaaaaaaaaaaaggaaaaaaaaaaaaaaaaaaaaaaaaaaaaaaaaaaattaaaaaaaattaaaaaaaaaaaaaaaaaaaaataaaaaaaaattaaaaaatcctaaaaaaataagggggaaaatgaaaaataaaaaaaaaaaaaaaaacntttttggggccctttggccccattttattaaaaaatttaaaaaatttaatttttgggggcaaaaaaagagaaatattggaaaaacccctttaaagaaggggggtaaaaaaaaaaatgggggaggtttaaaaaaaggcggaattgggaaaaaacttggggttaaaaaaaaaaataagcattttgaaaaaaaacccttttttgaaaaaaggggaaataaaaaaaaaggccacataaaagttattttttaaaaaaaaagtgcgaaaacttgaaagggaaattgaaaaagtcaaggta

SEQ ID NO: 509597 - DNA, 392 bp, Homo sapiens
atacacattcagtagaaagcatactttgtatacccatacaaccattttgtttttcacttttagtgtagtgtttaataaattacatcagatattcaacacttcattataaaataggtgttgtgttagatgactttgcccaactgcaggctaatataaatgttctgagcatgtttaaggtaggctaggctaagctttgatgttcaataggttaggtatattaaatgcattatcaacttaagatattttcaatttgcacatgcctgtaatcccaccacttcgggaggctgtattcgtctgttctcacactgtgtcctcattaaagaagaatgtgggtcagttcagtggctttccatttgaaaaaggaagtgtccaatataaaaagaaggaagaaa

SEQ ID NO: 509598 - DNA, 677 bp, Homo sapiens
ggacgaacgctgagatcgccccggtcagtcgccgtcaacatcgtctcggccgaccggcccaacgtgcaggagccgggccgcgctcgggaggcgtctgcagcagccctacgtcggaggccgcgtgactgtcgctacacgcgcatcaagaggccagcaggaccagctgcgcattctccgcgcatgcatcaatgaagctggtgagcctgcgcacagctgagctctagtgcactcggagcaggtcttcgccttgcggctccaggacaagaagcgtgccgcctcctgtctgtcggagatctgggacgtccacagatttgagggagctggccaacccagcccgcacagccttgccatgaccacctctctcagcagatacgacttgctcggcacccccgtcctcttctctagggatggaatgggggcgctgggcacgatgcactgtagacctatcggctctgatcgcattgggactaagcacccagtgccaggtaccaggaggctcccatctcccgcgcacagcgagtcatccagaaggggtgaaaggcttgcaggtcccgaccactgacacattgcaccggatgccctccactcctcagctacacgatcaagctacagcacgcagtgcacattgtacagagggaggggaggacccatggctctcccccttaccgcgggagaca

SEQ ID NO: 509599 - DNA, 295 bp, Homo sapiens
ctccgctaattgaatctgtcatgtataagtcttttatcgttagctgaggtggaacaagtgggtcagcaagaagctgctgggtcactagcttttggagctcgtatgctatccggaaataattaaccccttcaatagcatcatatgcaacaagagtaggagagactccttccaatctgctccttactcgatccagagtatcttatggaagagtcattccagcaatctcagagagtgctcttataattctccagtcttctcttgccaagccaggaggtgtcactgctaccttagtctg

SEQ ID NO: 509600 - DNA, 568 bp, Homo sapiens
gctgagctcatttcagttcttatttcatttcatatcatatttcatggagtttgctcttctgccaggctggagtgcaatggcgtgatctcggctcactgcaacctccgcctcctgggttcaagcaattctcctgcctcagcctcccaagtagctggtattacaggcatgtgcaccatgcccagctaattttgtattttagtagagatggagtttctccatgttggtcaggctggtcttgaactcctgaccttaggtcatctgcccacctcggcctcccaaagtgctgggattaccggcctgagccaccaggcccgggtgagcaccatcttattaagaaaagacacagaagagcagggaaggggagaagtgttccaggaaacacagtccaggctctgacattgctccaggtgggatggagggactcaccccttactttgaataggatgcttttgaaggccacaggggtgccagttgtcctcttgacttgaatcccatgcagagactttgttggcagtttgcacacatccatcctctgctggttgagtcctctgagccaaactgaaatgag

SEQ ID NO: 509601 - DNA, 412 bp, Homo sapiens
ttgacatgattacaatcgagtctcggtaccagtctgtctgaatcccccctcgaagtgtactcacggggagaaccaggcacaagggaggagaacggccgaaacattagcctgtccggatgtctctgttatctgtctgtcacagcgtcttcttactgatgtatcatgcaccgctggagaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgagga

SEQ ID NO: 509602 - DNA, 939 bp, Homo sapiens
ctttaagatataagactgatatgttgaaaacttaaggaagcaaatgctacatatatgcaatataacaatagtaatgtgatgctgatgctgttaaccagaacgggcagaactaagataagcaaatatgccgaaaggggtcttaattgaaatgaaaatttaagtttggtttctaacaatattgtttatctttatttattcttgtggtaagtatagtcaagtgttgttcagaagacagattttcataactgtgataagattgatagttgtggtttcgtctagaaaagtggctcttaacaagatgtacaagtagatgacaaacgatgtaaactaattttgtaagaggcttcaaaaggtttatacgtggaaagcacagcctacatgaaagagcagaaatcggttgctgtttggctatcttgtattccctcttatctgggtatcgtggtcatttcctatgcaaactaatggagcaaacagctgtatagtggtagaagttttaagagagaatgagatgtttatactattaacgacaactttacgattcggaaacactaaacacgtgcctaaagaaacctggcccacaatacgcactacagaaatgccaagaagcaacagacaggaggcggcggaagcgatcaaaagagaaaagatacacgcctgacgaaggaggagccaagagcaagcacgcaaatcccacacaggaagccgggtgaacaaacagagagggaccgcagaaaaatcgcgcacagcaggcgaaacatgccaaggggagaagcaacaacaacccgggaccaggcaggataaaacaacaccatctcgcacaacgagtgcgaagaccacccagcaaacggcgcggagacacctggcgacaaaagacaagacccaccaaccaacctaagagggagagacaacaagacagggggccagaaaacaacaacaaga

SEQ ID NO: 509603 - DNA, 154 bp, Homo sapiens
atctagaggatctgcggagtgcaatggtggaatggcaccaccttcccttggcactagttctctctgggcagcgacgcagctttaccagtgcactggtggctgctgaatggacttggcagcttctagtatctgcttcctcaaaagttcaaggact

SEQ ID NO: 509604 - DNA, 139 bp, Homo sapiens
ctctcagcaagtaccacagaacacaaagacaagatacataacagcaaatcaacctccaacggggccatgccaaagccttccccactccccaaggctgggcgagggctggtaggggctggggcagcattaactacgtcag

SEQ ID NO: 509605 - DNA, 438 bp, Homo sapiens
  misc_feature (55)..(55): n is a, c, g, or t
accttctctgatcgctcaggtggaggtgaatgcccagaacagtgtgctaacgagnaggcaatgacaaccaccacaaacactcaagtggaaggggatgatgaggccggattcctggagcgcctggtcgggtgaggaaagacgccaaaaacgccttcagggggctctggagcggcagatggagtacgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcgatcagagaaa

SEQ ID NO: 509606 - DNA, 263 bp, Homo sapiens
aaaaaaccccctttttaaattatttttggtttttttgggaatttttttaaaatgggcccccaggccggggccaatgggcccccccaaaagccccctttgggtctttccggggggggtttatggggaattaatggggattttttttcaaatttttcttaccccaattttttttttgggcccccccccccccgccttggggaaacgggcccccccccttttttggggccctttttatcccccggtttaattttggttttttttta

SEQ ID NO: 509607 - DNA, 203 bp, Homo sapiens
taacaaaggcctgtcgaagaaaccaccgattgtatactgtcgcatggcattattattatgtatgatggctacagacaatgtgggctctcacacctagactagcttatctggtggaggggcttgggcacagacagacagacaggctttctggatcatgcctttttttgccttgttacctttggctgtgcttttataatataact

SEQ ID NO: 509608 - DNA, 328 bp, Homo sapiens
  misc_feature (158)..(158): n is a, c, g, or t
gcttgacatattttactgagacagaagctagacggaagcacaaggcacctttcgtgtgtgaaagatcatgtatcttgagataagtgtggaagatcacgactccggttgccaagcatctgagcttccctataaggcctgggtcatagaatctgtaaacnatgttaatgattccacccttacctatcatttacgaatatatcaccaccctactaaaccccagttaaacgcctggcagccggaatcctattcgccggatttctcattaataactatatttcccccgcattcctcttccaaaccataatcgccctctacctgaaactcacta

SEQ ID NO: 509609 - DNA, 344 bp, Homo sapiens
aattatagcagtgagaaaattatgacagtgaaagaaatctgacctaattgactccatcttgcttctaacctcccagctgcccttgttcattcctgggcatagggagcactaactttgggaggatttagtttatagtttaactttgaaacaaagatgataacagcccctccctgagaccaacccactccttgcctggggaccagaaagcctttgtaaaactaacacattggccacaagattagatatgacggctcaggagtcatgcagccaaaggctcgagatcatgaacctccccaattgctcctgtagataatattttttttttaaatccaacatgggtgttt

SEQ ID NO: 509610 - DNA, 368 bp, Homo sapiens
  misc_feature (331)..(331): n is a, c, g, or t
tcgatccacatctctctctctgtccctttctctctcagggtcctggtcattctcctccggatcttgattatctctgtccctttctttttctctggtcccattcacgttcttctggatgggccttgattctcggaggtgggacccacagctctcctctctgggctttttctttctctctccatccacctggggtggagtaatgggtctccagggaccaggtctggagtcatcacccggtcggggaaaccgatcatcatcagcacgtctggaaaggcgatcatcatccaggtttctccaagggcccctgtgtcatcctctgcaccaggcctgngaattctgtcatcatcggcgttcctccagggtcctcg

SEQ ID NO: 509611 - DNA, 150 bp, Homo sapiens
ggtcacaaccagtctactctcccttcatgagatctgccttatctagctcccacgttctaggtacaacgaaacgtgatatggtcgaggtcgctgtcgccttgcttatttcacttaagtataaaggcctctagattccatccaacatcgctt

SEQ ID NO: 509612 - DNA, 334 bp, Homo sapiens
ctctgtacatcttactacaatttaccaaactgtgactcacagatcaatgtgatacactgctgttacaaaaatggtgtcacagatgtgccttagtgctgccagaaacctttgatttgtctaaaaacataccatttggtacgccgaaataacagggtcctgcctgtctattactctaggagctgatcaagagatgcctgggctacaaatgtaactctatgaatcatcatctctatcagatcataggacactaaaaataaactaatctgatttttggtgacattataccacttgatgcatttcaaaccttttgatgtggcctggggttccgagctcg

SEQ ID NO: 509613 - DNA, 1524 bp, Homo sapiens
gacccacgacgtcgcatacatattatactagcatttaccatctcacttctaggaatactagtatatcgctcacacctcatatcctccctactatgcctagaaggacataatagctatcgctggtgcatgtatagactagctctcataaccctcaatgatcacatctccgcgtcttgagccgaactattgttgcctatgagccactactaggtctattggccgtccctggcgaacgcagcggctgggccatcagccgctgactgagtgctcgaatcctgccaacgagattattggcccgagactaaacggtgacatgtaaccctaaagcctaatccccatggcgtgaaaccttagtcgtcccgacccattgatctgtactaacgccaacagtcgagcagttgacgcttttcccacaaacatacacagtacacatccgagagtcaccgcaacaaagacattcccaagcaagactaaatatgatctctaggacttccaatcgcccctagggaatatcattaaacccgcaaatccaaaggccaaacggacggcccctaaatagtactaggcctgtgtcccccccccaagtctctggtgttcaccattccggagaccccccgtgtttatacaaaaggtggctcactttcccgtaaggataactttaccggtcacaccagtgagcgttcccttaaggccccttccacaaagggcataaggggaaggcgcaaacgggacctacccctattaccaagatagataacaccaccgccaagtagaacggaaacgcaaggaacttcgctgaaccccctgcacaagaacatagactccttccccctcgagcagggcgcaccccctcggccgccagttaacacctcccggcggccgcacgccgcaagactaccttggcccaaaggtcagtatgacaaacccatcccggaaaaaacaccccacgtagttcaccacaccccgctgccgcccaacagaaacaacgcgccgaacaaaagggccagcccacgcgcccacaaaaccaccgcgaaccaccacaacgggcgcaccaaccaaccaccccagacgacatacgaagccgccaaacagagggcatcgccgtgaccaccagaacaccacacacgacgcacacgtagaacccaacccagagcaccagctgagtagatcacccaaaaccaacggatacaccccaaccccacccccctcaaagtccgacgcacaaaaacacatactagcacggcggggcgccaccccgccccctagtatgagcgtccagccagcaccacaagggaacgcagcacagcaaaaaggcccttcacgggaggcgcccccacataatagcccaccacagcgacacgaaactgacaccccaacgacgaagcagaataacgaatagccgcggacccacccacaacaggccgggcgagaaacgactcccaccctcaccaccgccagccaagacacacagacgacagacgagcgaacacgacggcacaaacgaccgcaggcacacgcgagacc

SEQ ID NO: 509614 - DNA, 320 bp, Homo sapiens
gacagcatcctaaccaggaaacttaaaattggtcttaacaaatccaatctaggcgggatatgtaaaaaaacagaaagatagcatcacaaaccacacgacacattatcagagtttaagaatcaggaaaaaacagggtcagctaccactcagaaaaattggtcatcaattctgaaagggggcctggtgacatcgtcaggatggataaagacagagattggactttcccggggttctcacgtcactaagctggctgcagttttttttggccaaacgggtcatcaaggcgggtatagggatggctggtcgggtaccggagctca

SEQ ID NO: 509615 - DNA, 910 bp, Homo sapiens
gcacccgagccaggtgagtcctccaggtgggggtccactaagttggcgttccgctctcggtgcgcgtgctagtacgcggcgcgcacgcaggtagtgactctgttcctggctgtgcgtgtgtgcggctcctggggggagtctggcgctgctcgggttggcgttgaagtttccgactcccgctccgcgccgggcctggccggggccccgggagtgctccttctagcctcgcatcgccgggcgtagcacgacggttcgttcaatgcacgcccgttgccgacctccttttcgtgcctgtgttgttctcacctgttggccatcaccgtggctctggcgatatgatctacatgctgactggtacccggctcgccggtggggaaggtgtgttgcttgctaaccctactaaggcactttgggctggaggcagtcaatgacaaggagggaacccttgcggtgcttgtgttgtttgtgagcccgccgctgcaagtcatcgcctggggctgtctcccgtgtccaccctttcgttgccgtcttatctgggagatctccactctgaaacaaggtctcgggagcgttgtctgagccctgggtgtctccccggcctgctccctgtacgttggggacaccgacttcggcgcgtgttctattgtaggcatgcaggtgcaggtgtgcgtggatctttcggtggaaggtcggtcgaatgcgctcttgtgaggccccctttcttggacccgcttgctgggagcgatcaggggagcctccagcacctggcccttgaggccgttgcatgggctgcccctttcctggccatactcgagccggtgtgtgttggggatgccagcctggggaggggcatgccttttgtccgcaccttgcgaagcccctgtcggcggcaaggttttgtttgtgccca

SEQ ID NO: 509616 - DNA, 159 bp, Homo sapiens
gccgggcgggtgctcacgccttgtaatcccagctctcaggaaggcaaagagggggaggatagctggagcccaggatgtcgagacttgcgtggcaataataggcgagcacccgggttttctccaaaacaaaacacacatcagagaacaacaacaaaacaa

SEQ ID NO: 509617 - DNA, 142 bp, Homo sapiens
attccctttcatgttcccctgtgattaattcttttcttttttaaaaaatcattttaaagttttttgtttaattataaagtagtacatgccccttataaaaaaaagttccactagtatgaaagggttataaagtaccagagga

SEQ ID NO: 509618 - DNA, 421 bp, Homo sapiens
  misc_feature (15)..(15): n is a, c, g, or t
  misc_feature (115)..(115): n is a, c, g, or t
  misc_feature (142)..(142): n is a, c, g, or t
  misc_feature (145)..(145): n is a, c, g, or t
  misc_feature (153)..(153): n is a, c, g, or t
  misc_feature (157)..(157): n is a, c, g, or t
  misc_feature (221)..(221): n is a, c, g, or t
  misc_feature (225)..(225): n is a, c, g, or t
  misc_feature (238)..(238): n is a, c, g, or t
  misc_feature (248)..(248): n is a, c, g, or t
  misc_feature (253)..(253): n is a, c, g, or t
  misc_feature (262)..(262): n is a, c, g, or t
  misc_feature (269)..(270): n is a, c, g, or t
  misc_feature (272)..(273): n is a, c, g, or t
  misc_feature (281)..(281): n is a, c, g, or t
  misc_feature (285)..(285): n is a, c, g, or t
  misc_feature (292)..(292): n is a, c, g, or t
  misc_feature (319)..(319): n is a, c, g, or t
  misc_feature (327)..(327): n is a, c, g, or t
  misc_feature (330)..(331): n is a, c, g, or t
  misc_feature (344)..(344): n is a, c, g, or t
  misc_feature (348)..(348): n is a, c, g, or t
  misc_feature (352)..(352): n is a, c, g, or t
  misc_feature (420)..(420): n is a, c, g, or t
acatagagatcaacnctgatctgacattatttctatatttttagaaacacttttcactcataaatccaaggtgacaatggcattaaatggcattaaaaatatctacaggaaaggnctaccacgaaatacaatattatgatancantcattgcnttanagtggttacttttctgtattcttcacatgtcccattgtatcactatacatttttataataaaanatcntaaatcaagacanacttcaagcnaagtnttgtcgacnttataanncnnttcttaanacanatgttcngacagacggcattcaactaagacaganaagatgcnggnnggggaggcttgcnaggncccngggggggctccagggtgaagcccatcactagcctttccagcagcactgtccctggagaccagatgctnt

SEQ ID NO: 509619 - DNA, 231 bp, Homo sapiens
taaatcggggggaggcaggaatatgatcagataagggatttaatacctaagaagcaaaatctataagctctctctcagttaatcaattaaattgggcttaagcgctaataggggggtggtaaacttaaagaaatataatcctcccataccaagttaacagcaaacattctagccacctttcaaaaccaaagaaagatacagacccattcatttatagcaatatactaatta

SEQ ID NO: 509620 - DNA, 142 bp, Homo sapiens
cagatatacatggtaaatatagtaggtatcatggggtatagattctaccacagcttgtaagtagctccaaaccttaaagtacccacaattactacacctagtgactaggaaccacatgatccctatttatatccccgccagg

SEQ ID NO: 509621 - DNA, 276 bp, Homo sapiens
aggagggggggaatttccgcgggtttaaaaagtggggggggagaaggggaggcctgtgttttataaaaaaaaggggggccgcccccaaaaaagaagggccccaatttggcctctggtgggggggggagggggaaaatccctggggtttacgccccgggggggggggtgaggtcctggggggggccccccaaaaaaggggggggggggggggtttggaatttttttggggggggggaagggggggaccccccaaaaggggggggggggggggggggg

SEQ ID NO: 509622 - DNA, 1180 bp, Homo sapiens
gatgttctgtgttctccccgccctgtgtccctgcccgacccgctgccctgcgatgctggctgctgctgctgcgtgctcccgcgtggctctgtgccgtgctctcctgttccctgctgctcctgtgcctgatgctgcctcccctgctgtgcctgctgccttgcatgcaatggtgctcctgtgcgaccctgtcctcttcctcctcctcctgtggaaccctgctctgtgtacctgtgactgtggactgccaactgggaatgcctgctcgtgcctgctgtggttgctaggacgctagaatggcagatgtcgtcccaaatgacacgctgagaacttcagagccctgtgcacttggtgacgaatgggcttcggctacaaaggctccaccttccacagggtgatcccgttccttcatgtgccatggctgggctgacttacaccaaaccagcaagtggcacatggcgggaatgtccatctactggaatgcctgcttacctgacgagaactttacacttgaatgcacagtggggccagtgtgtcctgtccatggcctaatgctggtcctaacaccaacggctcccagttcttcatctgcaccataaagaccagactggtcgccatggcacagcctgtcgtgtccggtcacgtcaaacgagggcatggaccgctcgtgaccgacccatacaactctcacggcttctaagcagctgcggacgtgacataccaagaagcacttgtcatcaacagactggtggcccagcttgaagcctaatcttgtggccagtggttagctggcaatggtggcaagctgccacatgttcattccacccagggttgacgcgaaccgcctgctcagaccaatggtgcacttgaacatagtaccgtgttgcacacacccactgttcccacaatagtcctgatcgacacgccctgataaaggcgcgattctacacaccctcggcggcaatggtaaccaaaccacacattgtgtctcccaagaaagacccacccctacctgtaaccgaagccacacaatgcaatgggaacactatgtatggcatgataatgtttaacaccaacacaagtttaatacacaattgatcctgactatcttcgccacccccaaaaaaacattgcctacccgtgaaaaaaaactagattagcaacagcgtgcacgctcacaaca

SEQ ID NO: 509623 - DNA, 204 bp, Homo sapiens
atgtatgtctagaagttcccgtcatggcgcagtggttaatgaacccgactagtaccatgaggttgcaggttcagtccctgaccttgctcagtgggttaaggatctggcgttgccatgagctgtggtgtacgtcactgacgcaggctcggatcccgcattgctgtggctctggcgtaggctggtggctacagctccaatccgacc

SEQ ID NO: 509624 - DNA, 102 bp, Homo sapiens
agttcattaataaaagtagaaaatggaaatacctagtttaacataggggccaaatcaacaaataattgaaggtattatgaaatatgagacagcactttaaaa

SEQ ID NO: 509625 - DNA, 163 bp, Homo sapiens
tgccgtcaaagtcctggtcgagacattcgccaagattgttcggccaaacatcgatgttatctccacacccatctgcatcggaatccaaccattctgtgctgtcgtttggaaatacgtcggcattatcacctacaccgtcgaggtcggtgtcgttccattcgct

SEQ ID NO: 509626 - DNA, 588 bp, Homo sapiens
agcgggggctgggacgggcggcggccgggtggcctcgagccacccgctaattgcatcttttcccggcgtctcgatcagcagagggagcgactatgtctgcggaacgatccccgaggcagccatccgcggatgagcatgaaggaaactggaagatacacagtgacgtagtccagagaacagcatgaagaatgcgacacgttacaagcaagatatcctcatctgtggacaaatagcctggtaggttcaggatcttcgttagaggacaagcggtgtgcagagaagggcgaaaatgatatttgtgatgtcatggcggatgtactagacatggtgtaagagcaagataagtgaagaacataggcaaaggttctctacatgtcgagggtccggtataagactggagggtcactggtgtagccaacatatcccgcacggtcacgacaaaggaagacattacccatcagaacttgaaatgctcggtcccctctgataaggctacgccaatgcctgggcttgggttggaatttcagaacggttggacactggcggtgaattctggctgaaagactgcattatagcttccgttaatat

SEQ ID NO: 509627 - DNA, 112 bp, Homo sapiens
cgtgacttgaagaaatacaggatgcaatgtggaaaaccttccgcgatcgcgatgaagccaggctctcctacttgttaactgtgcctggagtcagactgtacacaagaggagc

SEQ ID NO: 509628 - DNA, 1280 bp, Homo sapiens
gcgctcaccatccaggttcatccagtcctatttcgtaacggcacttatgaatccaaccaattgaagattcttacacaaagcagctgctgtgactacactgacagagcacgcccggcctagatacttcttggactacagcaggacaagcaacgacgcttcggcagccatgagcagcaacagcctactactgacgcgacctggccgacacgcctctcctgctacgcgcctcttctccagcctcaccacgactagcagcgcagctatccggacagcacaactcgtatacagctattcaacacgcaccagcactctcctccacgacgctacacaaggcatcagctgcaatggaagttcacccacatgcatccctctacactctcggctaacctaaaacgccacgactcctgagatccactcacaaacgcaccacgcgctacacaaccacgcggacacgcacacgcgaccacaaccagctcttacgccaaccgcgccccagcccctcaaacgccgctacaccccaactaccactagcgcaaccgccacctcaccgccctaaaacgcaatttaacacagcaatggcacagtaggctacacgtacctccgacaccgacctattccccacctggcaccacctatggctcacacgggcgcctttagtacaacgcggaacaagacctactctccacaagaagtccaccggcgcacaacttggctccccatcccgtttgccacacgcacgaacagctcccacacctaccggcgcacaccagggacccccgcgaccgcacccaacgcaccctccgcgcccctggcccccactataggcatcggctcccacgctctccacccataacggcacacatcgcaccctatccacagccgtagagcaagcgcgttagccccaacacacagcggcacgactgacggaacaagcaaaaggccaccacgcctccaagatccagtgattacctccctcattcgatacatacccgcctcacgaagaccgcactcctaacgcacagcttcccatcacggcaatactaggcgccgtacgcaccataggcagcgacagtaacagcacccccattctaaggccacccacaacaacttggaacacacccaccaccaactcggcaaacaccgcccacgtccacgcaccccccacaaagcaaacaagcgccagtggtcggcctataagccctacccccccttccgacagccacgcgcaccggacacgcgccgtgaacgaccgatacaccagacacacgggccgaccacac

SEQ ID NO: 509629 - DNA, 297 bp, Homo sapiens
cgtatcgtgataaaagacgacgacgtatacatgttcaacagttaacctccaagcaggctaaacaaagagatccacagtcaagacacattacagtcgaattgttgaaagccaccgacaaagggatattttatattttttttttcaaagacaggtctcaccataatatggcccaggtgggtctaaaacggttggcctcactggattctcccacctcgacctcccagagggctgagactatggcgtgtgcaccattagcaggtggaaataccactcaagaaaaaaacccgttaccatctc

SEQ ID NO: 509630 - DNA, 116 bp, Homo sapiens
acgccatccactatgcgttgcactgctgtggtttggctggggtgcgtggacacagtttatctcagagcatctgccccaatgaaggacgtactcgaaaaccttcaccggtgaagtcc

SEQ ID NO: 509631 - DNA, 128 bp, Homo sapiens
  misc_feature (17)..(18): n is a, c, g, or t
ttcaggctggtaccccnncgaggtatgggatatcgtcgaccccggccgtcggctttggcctgtgcggcggggaaacccgctctcgcctcctggtggtcgccgactcgctagtccgcagtgatgactca

SEQ ID NO: 509632 - DNA, 197 bp, Homo sapiens
tgccctatatatcagataaggaaacaattaagccattcactttaatatatgcagcagtggcatctcagcctctgcactttatctacagcccagcacttcttgttggggctgagataggaagtctcgagaaggtgctctagaggaggtgtagactctaccctggactgacaggtggaaggcttagccagagcattgtc

SEQ ID NO: 509633 - DNA, 219 bp, Homo sapiens
gctaagggaaaggcccctttttcccttcccttctcactttggcaggttttaacggaccattcaaaaggctacccgtttccagccttaacccttgaaaagaagggcggtaacccctccagccagtttttgggaataaaccttttaaagccttggaaaattttcccaataggtcccctttccaaaggggtcaaaagaccaataaaattcttttcctttgaa

SEQ ID NO: 509634 - DNA, 212 bp, Homo sapiens
gttactttgactcttctactgtctcagtaccttaggtaacatacctcgcagctgcatttctaacaaactgttgatcagccaaaataaaggggctacagaaacactcatttttatgctgttccctacttgggcttccttccaagacaattctgtgtaaatgttccgttgactctgatttggaaatatgaaccaatcagtccatcctggttata

SEQ ID NO: 509635 - DNA, 109 bp, Homo sapiens
tcacgttgacacttcagaagaacaacaaaaaaaatacaaccccaaggcaacacaaaaactttggtggggatctgtcgccaccccatttggacgttgcattgacatgtgg

SEQ ID NO: 509636 - DNA, 384 bp, Homo sapiens
ggaaaaaaaaacccgaacctcccagttttaatgtgttgggggaaaagttccacatttattcccagagctcccgtattttttacactttgcggttacacagtttttttacactgggttaccttttaattaaggagtgtttatccccccctcttttttacattataaggctttcttaaaagggaggaaaatttcctctcccaatggttttggattttaataaccttttgggtacctcccaatttatatattaattgaggttccactacgcttttttttttttttttgtgagatggaatctctgtctcttgcacagtctagagtacagtggcacgatctcggctcactccatcttctaccttctgggttcaagcatttctcctgttc

SEQ ID NO: 509637 - DNA, 294 bp, Homo sapiens
  misc_feature (114)..(114): n is a, c, g, or t
  misc_feature (125)..(125): n is a, c, g, or t
  misc_feature (191)..(191): n is a, c, g, or t
  misc_feature (223)..(223): n is a, c, g, or t
aagcaatctgcccaggactaccatttacccagcaatctcattacttggtaaagacccaaaagaaaataaatcattctaccaaaaaggcaaaaaaaaaaaaaaaaaaaaaaaagncagatatttanggtgatggatatcccaagtaccctgacctgatttgtataaattctatgaatatattatcacatgtnccacaaaattgtgtacatctattatgcatcanttataaaaaagatattctatcagactttaatgtagttggattccatggtggtttagtgttaaataaccagg

SEQ ID NO: 509638 - DNA, 227 bp, Homo sapiens
  misc_feature (93)..(93): n is a, c, g, or t
atatcccccggcccgcggtcccctttctctcataaaattctttcttagtagctattaccttcttattatttgatctagaaattgcccctcctntttaccccctatccatgagccctacacaaactaacctgtccactaatagttatgtcataccctcttattaatcatcatcctaggccctaaggtctggactatgagtcactacaaaaggattagactgaccggat

SEQ ID NO: 509639 - DNA, 260 bp, Homo sapiens
ccttcctctttcctttcctccaaagcaaggaggcccttccctggtccaggcccagggtatgggtagatcccttcccctccctaccttttgaatgtggggtagatcagggggccccccggggtttcctgaaatccttgggagccggatctccccatctcccctactcactcttcccttttcttctctcagggttgtctgaataaagtgtgaaatcttttgggttttctaaattgccattttcaatgaaaaaaagaatccca

SEQ ID NO: 509640 - DNA, 932 bp, Homo sapiens
  misc_feature (1)..(1): n is a, c, g, or t
  misc_feature (70)..(70): n is a, c, g, or t
  misc_feature (114)..(114): n is a, c, g, or t
  misc_feature (568)..(568): n is a, c, g, or t
ntcctgcacatagctccaccgctgaggccgacgaggccaaacgtttattttaaaagtctacatttaaaantcaatgctgtgtggggggtcccataaggctgttgctgattccanctctaaaatgtaaagtatccaccttgagtgcttagctcaaaattgtattggcactgggaaaaaaataaatcattgcctttattttggagtaacacaaaaagactcactaacggggggtataaaaacttagtttgtgtacataacaatatgaattttgagaagtataagctgtcaactagctatttctaatacggaatagatattttacaatatgggtaaactttacacatgggctcaaaactgaaggagaattttaatttcgtcttcaatataccaacgttatgtatttaggaattaattcttggggtctgtcacagagaggaaattccattcttaagcattatggtgagtgggcatctaaaaaatggtaatttatatttaactgagtgtttgatgatggggggggtcaaggcagggaaacgatgatcataactgccttggtaaaaggacctanacatgtataagtctgcgcaaaaatcttgataatccctaggggggtaaggcgacttcttgcgaccaaatacacgagataaatcattaacttttaaaaagggtaaatggtgtttcccccggaacacacgggaggggttgatgatggcttacaactgggggctgcagtgacacaggctatgggtggggatttcaagcgaaatttagccaccagctgggccttctggggtgctctaagtgcggattcttgagggggtggggcctgctcggttctgagagggaattgggtcttggggtgcccgctcccccaagggcggggtccttttgagcgtggattacccgagattcgggcggaagtctgccctatg

SEQ ID NO: 509641 - DNA, 337 bp, Homo sapiens
  misc_feature (81)..(81): n is a, c, g, or t
  misc_feature (96)..(96): n is a, c, g, or t
  misc_feature (113)..(113): n is a, c, g, or t
  misc_feature (227)..(227): n is a, c, g, or t
  misc_feature (251)..(251): n is a, c, g, or t
  misc_feature (332)..(332): n is a, c, g, or t
caccctgagatgggagccgtcttcccagcccaccatccccatcgtgggcatcattgctggcctagttctctttggagctgngttcgctggagctgnggtcgctgctgtgaggnggaggaggaagagctcagatagggagggagctactctcaggctgcaagcagtgacagtgcccagggctctgatatgtctctcacagcttgtaaagtgtgagacagctgccttgngtgggactgagaggcaagatttgntcctgccttcctttgtgacttgaagtaccctgactttggttctgcggcacctgcatgtgtctgggttcttgtaggcattgngaggg

SEQ ID NO: 509642 - DNA, 207 bp, Homo sapiens
  misc_feature (5)..(5): n is a, c, g, or t
cttgntttcgtcgcggtaattttttgccccatgcatgccccataaagtcctacatcacccctccatatgctaccattactgcacacaccaccatcggagcagagcaatgggcagcatcaccctggtccggccgagcatatcttcattctcaacgaagaacgacagataccctgagccacagcaaaacagcccaccgatgttcgcaat

SEQ ID NO: 509643 - DNA, 375 bp, Homo sapiens
actagctgcatggtccaaggtcacgtaaacttttgggtttcagtttgctcatctataaattaataaacctcccttgcagagtctctataataattagatagcatttatgcatctgatatataataggtcttctcaatagatgacatcattaatagaaatataggccaggcgtagtggctgatgcttgtaatcccagcactttgggaggccgaggtaggcagatcacttcaggccgggagttcgagaccagcctaggcaacacggtgaaaccccgtctctaccaaaaatacaaaaaccagccaggcatggtggcaggtgcctgtaatcccagctacttgggaggctgaggtaggagaatcacttgaacccgggagg

SEQ ID NO: 509644 - DNA, 990 bp, Homo sapiens
ggtgttgaatcgtggccggaggtcgccatggctaccgagcccgaagccgcggagccggtggtgccttcgtctcgatggaatcgatacttcactcgctggtacagaccggatgtctagaggaaaattctagtgaggaccactgtatactacagtactctaaccgggggcaggagtttctaacagagtttgcacctctctgtaaccatttactgctcaggatggtgaagaatatactgtgtctagatctggtggttaggaaggacaggtatctgactaggagaagtgatatgaaacatctactcctctcgagtacacggccatcatattgcctttcaatggaatacaccgccgagtcttaccttgaaaggctagccagtgtgcggagtttggtggttaccctcagagaatctttgataggcaaagataaaataggtcataaaccaatgagagggggttgatgtagacctagccaaataatagctagatgatagcaaagcaaaggtccaattggctgcacacacggcaatttagatgcccaaccaacaagctttagcgtcatggatggcagttgggaccgatgggcagaccagggagagcagacagttggggaattcctatgttgcacctgggtccgtaacaccgatcgagggttcactaccatggcagagagaacgcagttatattgtagaacgcattacccttttaagcagccgcagcacagtgatttgccagggggggacgggcctaggtaggcgcttcggggtttgagtctgttccccttgcctcgggtttctttccagttggactgggagcccctctggggtatgcccactgttgttcttacagggcactggacccacgagtcgtgggggcttggcccgccatggtaatcttcatcatcgtggttcctctttggccagtcttccttcgtaagactaaaactgtggccattgctacaggccaattgcttttgtcctggattcaccctag

SEQ ID NO: 509645 - DNA, 114 bp, Homo sapiens
cgtcatgatgccgggatcctcactccctaatgagcacgaactctactagcgtctcatctggttccctatctgtgtctcctctaggggctgctctacgtagtcggacctgcgggc

SEQ ID NO: 509646 - DNA, 166 bp, Homo sapiens
cccggttctaccttcagcttctggttgttgaatttccagcatttgttccccttgtagaagtaagtgaagacttcatcgctgcccatgaatgaccctctgggagactcatggatcccttcccagactctgatgttcttgtggtactcgctatacactgccctgagct

SEQ ID NO: 509647 - DNA, 1336 bp, Homo sapiens
gctccaaacatgcctcctcccgcactgggcagaccgagtccagcgtgagaaacttatgctagattccatgtgcattgagcaatgcttgattgacagtctcggtgtcttctcactttcgtgcgaccaggtgagccacatgatactgcacagaacatgtcgatcgtcgtcttgctatctgtggttgctgtttctggcgagtacacaagtcttctgtgctgtgttattactgtaggttctttcggatgcgctgtgtgttttgccattgtcaaataccactggatgcggggaccccgcatcacgaacactgtgctatatttcaataccttccattatcgtcatcttactggagctaactgacttggcgacaacagcagaacggcactcaccctcatttcgcctagaactcgcgtcattgccaactgcggctccagtctcaccagtctcccaggtgactgcctgatctcgcagccaaagggccactacaactgtcaaccagggtaaatgcgacgtagcctatgctatccacccaaagctcactgtgacacacttgtgcaagagaattggaacgcgcttcacgtcacacgaacataatgacctccaaactgcgaactgatacacactaggtctactcgtccccagaggagactaccatcaattctacgcatcgcgacacttgcactgggaaatgaaatcaaaaccacggccgtaccaagattgacacctagcatgccttactctccacctcgtcccacacactccgttctccaacacccaccactccgggcaagaacagtgagccaactacacgacccaccagcatatacaagggaccaaagggcacctcgcgcacaactacgcaacaaactccacgaacaccagccggacaacagtcaccacacaccatacaggcccccagcgcaacacccaaccggcagaccacccacaggacacgcagccacatacacactaccctgcacaggacatgtgtcccccacggcccccgcatccgtacacagctccccaaccgcggctggcgcccaccacaaaagcgagcacaccacggggcccaccgactagtcccacacatattacacgacaccacacactatctggaaatccaacacacatataccaacaccaacacatcaaagataacaaaacagagcacacttacatacgcaaaaccactcccacctccaccaaaacacatcccctcaacaccacatccccaacagcatccccgaacagtatactcaaaaacaaaccacacaaataaccacacatatcccccgaattaaataatcaacatcaccacactaccaccattcacatctac

SEQ ID NO: 509648 - DNA, 697 bp, Homo sapiens
  misc_feature (197)..(197): n is a, c, g, or t
  misc_feature (245)..(245): n is a, c, g, or t
agcggtggctcttcttcaagggctccaggggtgggcccaagacgtcccgtcgacggcaccctggtgcccataggactcgcgggcctcatctccaatgattcagaactcaagttcgtcgttgatgcaacccactaagatgtcggagacacggtggaaacgcttatgattacatccggtaagatcaaaagcgttatccntgttgtggcttccgatcgagtgaggaccgtgctcttaccactccattnatacgcaatgcttcttgggatctcctttcaaaacacgctcgtgcgaaactcgcatccatgacctctctagaatctatgggtctaagacagtgttgggatgttaggcgtgtactcattaggaaggtggttccgctacgggaagagtcttgatgggcctatggaaagggatgtcacccttacatctgtcgagatgtcgtccctgacgattcggaatcatacttctgggtaagcatctcgtagctctttgaagcctcgatctcttgcgaggccattcgcccaacgcagattctggagtcagtcatcgctagggcgcgtagggctctacagctctagtctagcaggggtcatgtatagtacaccatatcaccctgttcttcaaagacgcgctatgacagtgggaaatattgggctagtgagacgtatctgacgcatgccctgaggagcatctataa

SEQ ID NO: 509649 - DNA, 171 bp, Homo sapiens
tgcccatattacactagaaagacaaataaagaacctcaggctagagggccatgatagtgagtgtctatataccagctggaccctcagtaaatactctacaaacctgagcaaatgaatgaacaaatgaataaatggaggaatccagacacttgaaaggactagtgtaaggct

SEQ ID NO: 509650 - DNA, 540 bp, Homo sapiens
ttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcaccaggctttcttaaagtgagagcacgcctgtactagagcaacgcaggaatcagagaccttccaggaaatactacctgtgtaagggccagaaatatcttcaccttggtcatcgttcatcatactcatcattactttcgctgtaatgttcatatcgatctattaatatatattatctttcatacattttctacgaaacatttatattgataagatctttatttgccaagg

SEQ ID NO: 509651 - DNA, 412 bp, Homo sapiens
cgctcgtatctatggtttcgctttccacagtttggtacctgccgtcaactgcaagtcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaactta

SEQ ID NO: 509652 - DNA, 564 bp, Homo sapiens
gcacgaggtgaacctgtgggcaagggagaactactgcacatcagagagaatgatttaattggacctagctatgtttgtgtacggaagacttttttgaacaactaagtggttggtgtgctatttgctaagactggaatcaatagagtaggaatgtggacatcagtttcacacatacttagttttaatttcaagagatttccacatagacaatttttgaggcttggttacagatacatttttggaagtctttgacgtagagttggtaactgagaacattataggaaagaatatggattgaaaagaaaatcatataggatcaagccccaaagaataccaacatattaagcactagtagaggagttagagaagaaagaaaggactaagacactttgggcagaagcatagaaggaatactagtagtattgagtgatcaagtaaaataaaggaaagcttaggtgtgcagatttgcctttgataggaggagatgactctcccaattgtatcagatgggtagaaagacagtagaatcctaagcgcagttccatttgtaggtgttttataaag

SEQ ID NO: 509653 - DNA, 137 bp, Homo sapiens
gtaccatatgtgcaggttcatggaggggaagacatgggaggcacgcaatggagtatggtgttgctttagtgaggtgatgtgaaatgtcatggaatacgtggataatggtgatagttgctacaacttgtctgatgagt

SEQ ID NO: 509654 - DNA, 705 bp, Homo sapiens
  misc_feature (436)..(436): n is a, c, g, or t
  misc_feature (513)..(513): n is a, c, g, or t
gtgtattagaccccctctctccccccctcctcgtctaaaaaaaatatattctgtatgtgcgctcgttggcgttttatcgcccacacacagagaggggatatatatatactctcgtggacaaaatagcacgcgcaccaactatactatagggagggccctccactctctctataatacaagagaatgagagattatatactcaaataacctccctctctctccaccctctgtccgtctgtacgccgcaacacttaggatattatgtacccgcctcctcctgtgtatatataaagaaatttttctctaccacagcggagcagttgtctctccccctctcaacaaaggcccacacatatacaatgtgtgtgagcgatgtggccttctgtttctctctctcttttaaaaaagataggtatgtgttatatatataaccacncggtgaagaacggtcgtgtcgtagtgtctgtgtgtatggagagacacacggtggagcgacgcacccctgtgtataanagaagaaaagagccatctgtggactttgttgataataagaggcggcagtatataattctctcccccggtagagcgttcgggggtgctaaaaaatattgtgaaccgcgagatgttttctataagagaaaacgattaacaccccttaaaattcaatgaagagaaaaacacaattttgcggcctaacaaaaacaa

SEQ ID NO: 509655 - DNA, 362 bp, Homo sapiens
  misc_feature (58)..(58): n is a, c, g, or t
ttctctctgtatatgctcatctaataaacctgtaagtatatgttatccatatatagancacacatgacaaaggaatgtgtatcatctcagtctcttcggtcaatttcgtatcacagagacttcatcatatgcttgaataaagcacaatgcttaccaaaatcctattgtcatgtctcactggacccagccagagggtacagagggcattaagcgtgtttgggattcactgaaagtaaagccaccacattcttctgtcaattgtaaatacttatattctcttttctatcttttttctcttttctcttttttttatagacagagccttgccgtgttgcacagtctagagtgcagtcgctcgtgcc

SEQ ID NO: 509656 - DNA, 1295 bp, Homo sapiens
tagacagctattaggtcccgggatgcagctacatctgagcctgctgcatggacggccattaggtcccagtcaccagagatggagttctggaacttctgagtcgcttgtatgatgatacgactgtggcgattccaggtcaccgagtcctgagagtatggaagctggcagtggtagcacttgcctatgtatgatggcatattaggatcccaggtacggcaggtggaatcctggagtctagctcgcataggatcggcgcatatagcgtcccgaggactggagcctgggattcagagcacctgctactgatatgatagagacatagttaagcgtcatcagggactgcgagcttagccactactgagcactagaatagcagtaggaccgcgcccgatctaggggtccatgcgtgactagaggcctgcgatcgcgaactctctgcgtggtgttcagtagcagcacactatacgcgctccacagcgacctgcgtacgcatgtcactccttgagctcttgccatcgcaagtaacaactgcgacgcacgtaaagaagataccaccaagatacccgaggcgaactgacgacgacctaggaacctcctgcacgtcacatatgccattgacgctaagacacaggcccgaatcacaggctccacacgtacaccccacagcgcactggcacacgcctagggccacgctacaagaaagctcacatagccactcagactggataccagacgcagatgccacgagaacaacgaggatagcccccaaaggggatacacccaccaacgcagcaacattgacagcaaagacgtagcgaaagcaaaccaaggacgagccacatagacacaacctcgccaacgcaagttgacaacccgacataacacgcagaatacacccggaggaacatagccacagcgctccttaacaacaatttcacctctgtcacccagccgccgtggacaacattaacaccaacactaaagaaaaacccgaccgtcacccaacaccatcataccaccgcggcacaaccccaccacgcgcagtgccacacctgccggaacgtccgcctttgcgaccccacatatatgcgagacaacacacacaacccacttgacacactccgggaccgacactaccagccaaacccacacccacctctacatcactcacagggcgcttccacacgcagcgcgggccacatctaccgctggcccacacgccatcattggaaatgaccccatgagacaccggccacatgtcaaacacggcgaccccacctctctaggtgacacac

SEQ ID NO: 509657 - DNA, 331 bp, Homo sapiens
ccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcaccttggcaatgacctccacagccgtttccctctgttgggatctttccagcctta

SEQ ID NO: 509658 - DNA, 723 bp, Homo sapiens
gtaaggatatcgtcgacccagcgcttcgtggtatttgtgcgcctcaaccatttgggtaaaaagggggctgattagaaactgttttaaggaggggctgggctcggtggctcacgcctgtaatcccagactttgagaggccaaggcggtcacgaggtcaggagttcgagaccagcctagccaacatggtgaaaccccgtctctagggggggaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaagaaaaaaaaaacaaaaatggtttatacgcgctgggttcccaaggtgggtagagacagacccaagcctggaagctggcccctggcctgtgtgctgacttcttggggacctcaaaccactgtattcttgctgtcggagcctgtactttgggggaagaggatcagggaaggattctgaggaacgtaagaggacaaacgaatccatggtacctcaagagttttccttacccttaaactcgctgtgcagccagtgactgtggcggaccctccatgttgtctaccagcactctactgggccgtggagcgtaacgaatcacccaaggccagtactcctcctgcctggggaatgcgcccctctgagaaga

SEQ ID NO: 509659 - DNA, 1256 bp, Homo sapiens
tatcataaagtttaattatgattcagaaaaaatcgagcgaataactttctctggaaaaaattattattggactctggttattcgacccacagtttattgggggcgagaagggctgggtaggttaaatttatcctattttttattctggaaaatgatcattaatagaaatgtcccgtttccagtctggatttataacagatcacatttggcccaaaatgggtctggaagaataaatcacaacaggaaatgcgaaaagctggtgaaagctaaggcgcatgcaagagaaatatctcagaatacccaaagtgggcaacacaggacacgttgggctgggaatttggaagttatttcagtcatacttgggactatggggctccatggttctcacggatcgcgtggtggaactccgatggtgaattggaaattccccttatttatcaataaggtggcgttctctggtcacagctcatccatattccagttggcgtgggtactccctgggtaagaaaacacattggtgactggggcttatatctgggaataacagttataatggggatcatatggcgctggtgttttcacaattctttggtgtacccggttcattctctaagggagaaacctactaaattcccagtctcaatcattcacattgggacaccacttcattaaacgaaattttctttcagaggggaacgggggaattacctcaaaatggctttactaacaaggatatcccacggtgcggaccacagtctgtttatacaatcccaacaataagagggagacaacggggggagccaacctcggagaaggacatatcatgtgggctaccacacaaagacattggtgcactcgtgtatcttaaaaacgggcgcatcgggcgaacaaaatcactggtggcgagccacaatcttctaaccaggagaaaggcgcgaaatataataaatctcgagagagagataaaaaaattataaccaaattatatatttacccaccaggaggggtatacgtacagagacaaacgacaatcatctatttagaagaagacaccaagcacgacaacaccaaacaagatcagctagagcatacactcacaccaacaacccgcggcacctctcatcgcaagccgacctcctagaacgctactagaactcaatcagctacaaagccgatggtgagtatcgaatcgttatactagtttttgttttttttgtttgtcttatatgctactctaatacgcgaggaagaagagg

SEQ ID NO: 509660 - DNA, 539 bp, Homo sapiens
ggggtcttatgaaaaccaagagaaagggctttctaaaaataatcagtagggtgagggtcactaatcccattgaggcaaatctcaaaacaccagtaccaggtggtacagaaggcaggcactaaatggcgtgtatcgtatgagtaaaggaataaaggcatattggccttacggtaaatcggtgaaaaccaagatataaattcaaaagcatctaatacccactctcaggctcagccaccagaccctacaatatccaaagaaataaccatatggaaaactagattggaatatataaacaggtgtgacaaaggcctagctggaaatcaatttaaaaaatatgtaagatatgaatcataggtaagtcaatttttaaaatattcacttctcggaaaccaccctcggcaagagcaacaagtaggattcttggtacccagtaggcactcaataaatatctaaataaaaggggtgctggatatcacttatctcggctccctcccaaagccttatcaaaaggatgatgagggaataaaaaatctatgacc

SEQ ID NO: 509661 - DNA, 514 bp, Homo sapiens
  misc_feature (13)..(13): n is a, c, g, or t
  misc_feature (365)..(366): n is a, c, g, or t
taaatctactttnacgcgtaatgcaagctacatattgctcactccgtattccctggttcaactagattcacatagcattttctaacttggaaaaggcagtttgcttccctgatactataaaaaaagagcaaaaaataaaaatccccatacaaaagtgaagtcccattgtacccctgccatcatctcctagtggctattctgtgtaactcgggctctttgggattgacttcaaaaactgtttctcattagctactaaaaaactgggagatcaggaggaaaagagaaacccttttgactttgatcagacagctggtctactgcattcggtctgtctgcagctgttgaggctggtactggccaaaggnncgccggcagcatgcagccgcagcagcagctgtcccgggccagcggcggtgatgggctgttggacagcatagctgtagcccccagtggttacatagcctgcagcagctggggatgctgcataggggtactggtcataggcagcggccgc

SEQ ID NO: 509662 - DNA, 362 bp, Homo sapiens
  misc_feature (11)..(11): n is a, c, g, or t
  misc_feature (34)..(34): n is a, c, g, or t
  misc_feature (50)..(50): n is a, c, g, or t
  misc_feature (56)..(57): n is a, c, g, or t
  misc_feature (63)..(63): n is a, c, g, or t
  misc_feature (68)..(68): n is a, c, g, or t
  misc_feature (72)..(72): n is a, c, g, or t
  misc_feature (90)..(90): n is a, c, g, or t
  misc_feature (123)..(123): n is a, c, g, or t
  misc_feature (134)..(134): n is a, c, g, or t
  misc_feature (136)..(137): n is a, c, g, or t
  misc_feature (140)..(142): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (168)..(169): n is a, c, g, or t
  misc_feature (172)..(172): n is a, c, g, or t
  misc_feature (175)..(175): n is a, c, g, or t
  misc_feature (191)..(191): n is a, c, g, or t
  misc_feature (213)..(213): n is a, c, g, or t
  misc_feature (218)..(218): n is a, c, g, or t
  misc_feature (222)..(222): n is a, c, g, or t
  misc_feature (229)..(229): n is a, c, g, or t
  misc_feature (237)..(237): n is a, c, g, or t
  misc_feature (246)..(246): n is a, c, g, or t
  misc_feature (248)..(248): n is a, c, g, or t
  misc_feature (253)..(253): n is a, c, g, or t
  misc_feature (277)..(277): n is a, c, g, or t
  misc_feature (291)..(291): n is a, c, g, or t
  misc_feature (307)..(307): n is a, c, g, or t
  misc_feature (311)..(311): n is a, c, g, or t
  misc_feature (314)..(314): n is a, c, g, or t
  misc_feature (340)..(341): n is a, c, g, or t
  misc_feature (357)..(357): n is a, c, g, or t
  misc_feature (361)..(361): n is a, c, g, or t
tgttggttttnggatgcattgttatcattaaccngtcttttactactaancttagnnggccanttggnacanacagttctgggaccgttnttccaccactgattaggagtggggtggcaggtnttgggggtggngnnggnnnggggttggggggntngnggggggggnnggnggngttgggagctccagcngccttcttgtccactgctttgntgggncccncggggantgtctgtntcatatcangnacagnaaagggacccaaaggtggatagtntgagatgctctcancacacatgggcttgcnaggnacnatatcaacaatgggagcttcaccagnnttcaagaatttagggncatnt

SEQ ID NO: 509663 - DNA, 985 bp, Homo sapiens
  misc_feature (1)..(1): n is a, c, g, or t
  misc_feature (391)..(391): n is a, c, g, or t
  misc_feature (394)..(394): n is a, c, g, or t
  misc_feature (399)..(399): n is a, c, g, or t
  misc_feature (403)..(403): n is a, c, g, or t
  misc_feature (413)..(413): n is a, c, g, or t
  misc_feature (421)..(421): n is a, c, g, or t
  misc_feature (459)..(459): n is a, c, g, or t
  misc_feature (492)..(492): n is a, c, g, or t
nggttcagtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacagcaccaccactcacccccaccgcccccaccacctcccccagctcctgaggtgctggccagtgcatccccactcccaccctcaaccgcggcccctgtaggccaaggcgccaggcaggacgacagcagcagcagcgcgtctccttcagtccagggagctcccagggaagtggtcgacccctccggtgtccgggccactcngcnagagnccanccgccaagcngggggcancggcaaggccaactgcgcagcgtgaaggagcgaaagcnggagaagaagaagcagaaggagcaggagcaagngagagccacgagccaaggctgcgggacttcgatcgtgcggatgctcttgcacacaagtctgcgtcattgaggtcgacaacgggcatcctctgggaaaggacctggggcatggtagacggggcccacgagaaggagcactttgcaccgcgtagtcagactaccagtccctgcctctgccgccaccgcagcagccacaggacagaggaggacgaggaacgactgggaatgcgtagcggggcttccagtgacaccttcaccccgccagacccagacatgggccatgtgctctgacatggacacagccaggacaagactgctcagacactgcttgcctgggtgggggtgataggaaccagtcatctgtgacggagaccagcttcaaggagcggaaggactggcgctgaggcaacacagctggggtggggacttcagtctgcctgtgctccagtggggggactggctccacccagcatacgccacggttcttcttaaa

SEQ ID NO: 509664 - DNA, 609 bp, Homo sapiens
  misc_feature (1)..(1): n is a, c, g, or t
  misc_feature (391)..(391): n is a, c, g, or t
  misc_feature (394)..(394): n is a, c, g, or t
  misc_feature (399)..(399): n is a, c, g, or t
  misc_feature (403)..(403): n is a, c, g, or t
  misc_feature (413)..(413): n is a, c, g, or t
  misc_feature (421)..(421): n is a, c, g, or t
  misc_feature (459)..(459): n is a, c, g, or t
  misc_feature (492)..(492): n is a, c, g, or t
  misc_feature (509)..(510): n is a, c, g, or t
  misc_feature (515)..(515): n is a, c, g, or t
  misc_feature (519)..(520): n is a, c, g, or t
  misc_feature (600)..(600): n is a, c, g, or t
nggttcagtgcctgagattgatgttccgtcctacctgcctgacctgcccggcattgccaacgacctcatgtacagtgccgacctgggccccggcattgccccctctgcccctggcaccattccggaactgcccaccttccacactgaggtagccgagcctctcaaggcagacctacaagatggggtactaacagcaccaccactcacccccaccgcccccaccacctcccccagctcctgaggtgctggccagtgcatccccactcccaccctcaaccgcggcccctgtaggccaaggcgccaggcaggacgacagcagcagcagcgcgtctccttcagtccagggagctcccagggaagtggtcgacccctccggtgtccgggccactcngcnagagnccanccgccaagcngggggcancggcaaggccaactgcgcagcgtgaaggagcgaaagcnggagaagaagaagcagaaggagcaggagcaagngagagccacgagccaannagggnaccnnaagccggacccccccaacaagctggccatgaggcgcaagggcatccccgggaaaggacccggggctggtgaggggcccgnaggaaccca

SEQ ID NO: 509665 - DNA, 403 bp, Homo sapiens
gcacctcgtacagatacgctctcccgcgtcacgtccgccaggacttgaagtcctgagcgctcaagtgtgtccgatggtctagagaaggccatggaggtgccgccaccggctccgtggatctttctctgtagagcatagagcctatttccccgagtctttgctgtcgaagctgtgactgtcgattcggaagtccttgaggagcgtcagaaacggcttgcctacgtaacagagccctatgacccggaatctggatgggaccgacttcgggagctgataggcaaagatgaacagtatagaatttcctaggaccttgctaatatctgtgagacggcagctacagcaggcatcattggctgggtgtatgggggaataccagctattatgcatgctcaactacattggg

SEQ ID NO: 509666 - DNA, 144 bp, Homo sapiens
tcaaggtttatttcttaaaactgaatcaaggagaagctctcagcggcttgaaaatgacaagattctgcagatcattacggaatagataaaaacagagaataactgaaactgaaattcacggtcgaactgctttaaaaattaaga

SEQ ID NO: 509667 - DNA, 101 bp, Homo sapiens
atcaagaagattggacagcgtgggtatcgaggcggacgacgaccggctcaacaaggttacaaggaagctgtaaggaataaaatgactcccatgaagacgta

SEQ ID NO: 509668 - DNA, 375 bp, Homo sapiens
aacgccacataacggcttgactgcttgatgtggatctgcatgccagacatggcgaatccggacataaaatacatcaatcaagagagtaccactcacactgctacacctacaccgatggaagaactggggacagatttttacaaagttcagagaggctgagatgccctttcattctgtgtcatcagaagataatctgccaacgattgaatgccagaatgtttgtgctttaatttttcttcataagcactgcctagaaatgagtcaaaagcagatgctaggaatcaaagttgagctctctactcatttaaaattctaaagaatgctgaaaaattccagttcagaacagctgcatttttcttgagtgaactcatgaca

SEQ ID NO: 509669 - DNA, 298 bp, Homo sapiens
gggaggagggggtggggctaactatgttagtagctattttttttttaacagaacttcacagagaaatgcagtggtctggactccaggtctggtctgtcccgtgggcaagtaaatgcggtacggtcctgatcccgctgctataagaatgcttggtgaaaggatgggagtatgattaaaatgtggttgtcccccaaatgctgggagtagtgatgtgtggagggaaaaaatccagctgagtgataagggctgagtgtggagagaaatttctgcagtttaaagcagtcgtatttggtgatgg

SEQ ID NO: 509670 - DNA, 406 bp, Homo sapiens
  misc_feature (144)..(144): n is a, c, g, or t
ccattacaggagctccccagcgcaagcctgctcagtggctcggtagtcccagctgcaggcctgaggtgtacatagtcttcccggccatattaaccacacagcctgagcctgcccagcctcggctgccagaggtgccggttgcantcaggaccgttgcccgggccgtccttgcctttttcctttcttttttcacacatctgggtaccccagggtggctgggcttgggctatgtgggtggtggtggcggggggtcttgggggcctctacactcccgcccatgcctccctgatgggtggcccagggcggcctctctctgaggagacctcacccactcctcgctcagtttgaccactgtaagtgcctgcactctgtattctattaataaactaaaataaagggaaaaaaa

SEQ ID NO: 509671 - DNA, 342 bp, Homo sapiens
  misc_feature (7)..(7): n is a, c, g, or t
  misc_feature (154)..(154): n is a, c, g, or t
gtttaancctttaacatttggaagcccaaagtaatttcccaccctagaaatgatgcctatcagcccctggcatgggtggctcaccccctataatccccagcactttgggaggctaaggcaggagaattgcttgagcccagcagtttgagaccancctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatc

SEQ ID NO: 509672 - DNA, 248 bp, Homo sapiens
  misc_feature (116)..(116): n is a, c, g, or t
gtcgaggtaccaacaggctggaaatatttgtggaagcactgtgggggttggggtgggcttggaacacaggtgtgtacagcgtggtggagggaagtttggatcatagtaatcctgtntcactctgttatactctagccaagattgactgtattagatgaaatgtgaggatcttgttcaatcggaaacccccgttacctcctctttttctttctctttctattttatttttttttaatttaaaccttttt

SEQ ID NO: 509673 - DNA, 170 bp, Homo sapiens
cgatcgtatagatagctagctagatagatagatagatagaggcagccagacagataaaagatagatgatagatatagataggcagacagatgcatagatagctagatagagatagattagatagctctagatcggcctgacagatgatagatggctagctatagataggc

SEQ ID NO: 509674 - DNA, 162 bp, Homo sapiens
ttatttctgtgcattcctgtgattgcattaaggaacaagcgttcgtgtgcaccaccatgcctggctaatttttttatttttagtagagatggggtttcgctatgttggccaggctggtgtcaaactcctgacctcaggtgatccaccctcctcggcttccct

SEQ ID NO: 509675 - DNA, 544 bp, Homo sapiens
aaggaggtcgatggcagatgcttacgtgcagacacagaccgcagctactttgtggaatggatcccacacaatgtcaaaacaaccgtctgtggacattccccctcgtggcctcaagatggcagtcaccttcattggccatagcacaaccattccggagcttttcaagcgcatctcggagcagttccctgccatgttccgccggaaggccttcctcccctggttcacaggcgagggcatggaccaaatggagttcccccaggcttagaaccacatgaacggcctcgtcttttagtatcaacaggtcccggatgccccccccaaaaaggaggaggatttcggttaggaggcccaaaaggaggcctaaggcaaagcccccctcccctcagggttttcagtttccttaaccgtttttctccactgcccccttcctctcccccagaaattgtgtttgctgcccctatcttgttttttgtttttttttttggggggggtttaaaaccgggcctggcccatagtaggcgccccattaaaacttgggtgttta

SEQ ID NO: 509676 - DNA, 129 bp, Homo sapiens
tgagacggagtcttgctctgtccccaaggctggaagagtgaaactatgtctccaaaaaacaagacaaaacaaaacaatccaaaacaaaacaacaacgacaacaagaaactcttcccttctcaggactaa

SEQ ID NO: 509677 - DNA, 201 bp, Homo sapiens
ccggaaggggcttcaaaatatcatcaaaagccccccccccatagaacaaaaaaaaccaaacaaataaagccccctaacccccccctctccccctctcggtagcctaaatccccccctaaatagaaggcggcaataaaataaaagttaaggacaaagcgcttcaccaatacctttgccctaaactggacaaaaaacaaagaa

SEQ ID NO: 509678 - DNA, 357 bp, Homo sapiens
aaggatatgtaatgacactatcctcagactgaccttcttgcttggcgcatacgaccttatctgctcaagagcttctactatcaccacatattcttatcaatgaccggttggaataattctcttggcaacaacagactgacatacagaataacatgtacttcatccgtaattctttattgaagaaggcctagaaaacaaagtgatatcaagctttgactcttgagatacgtaatttcagaaaacttttcctctgtacttaagttttagaatattcaaataatgtgagaacacattgtactaggaaaattattttcaaaggaaatccataatcccagcactttgggaggcagaagtatc

SEQ ID NO: 509679 - DNA, 833 bp, Homo sapiens
  misc_feature (57)..(57): n is a, c, g, or t
  misc_feature (114)..(114): n is a, c, g, or t
  misc_feature (151)..(151): n is a, c, g, or t
  misc_feature (180)..(180): n is a, c, g, or t
  misc_feature (185)..(185): n is a, c, g, or t
  misc_feature (191)..(191): n is a, c, g, or t
  misc_feature (194)..(194): n is a, c, g, or t
  misc_feature (217)..(217): n is a, c, g, or t
  misc_feature (228)..(228): n is a, c, g, or t
  misc_feature (236)..(236): n is a, c, g, or t
  misc_feature (240)..(240): n is a, c, g, or t
  misc_feature (242)..(243): n is a, c, g, or t
  misc_feature (260)..(260): n is a, c, g, or t
  misc_feature (279)..(279): n is a, c, g, or t
  misc_feature (297)..(298): n is a, c, g, or t
  misc_feature (312)..(312): n is a, c, g, or t
  misc_feature (330)..(330): n is a, c, g, or t
  misc_feature (338)..(339): n is a, c, g, or t
  misc_feature (341)..(341): n is a, c, g, or t
  misc_feature (347)..(350): n is a, c, g, or t
  misc_feature (352)..(353): n is a, c, g, or t
  misc_feature (372)..(372): n is a, c, g, or t
  misc_feature (376)..(376): n is a, c, g, or t
  misc_feature (379)..(380): n is a, c, g, or t
  misc_feature (387)..(387): n is a, c, g, or t
  misc_feature (406)..(406): n is a, c, g, or t
  misc_feature (451)..(451): n is a, c, g, or t
  misc_feature (455)..(455): n is a, c, g, or t
  misc_feature (462)..(462): n is a, c, g, or t
  misc_feature (808)..(808): n is a, c, g, or t
ttctcttgcaaaacttttatgcagaatgagtaaccatttcctattcaagttacagcnatcagaatcagaggttccttacacaacagtagatgcttgagacattttttgaatggngatgtgatttcattctgttcaagaacttatgcggganactgggagtgacttaatttttcaaaagtncaagngaatcngcnccccaactgcttagtgctcaggngggtttctcangggctctnttgngnntggcttgtggtgggttngcacccacctttggggggnttcccattctacttgtgnngccttgtttcggtncgcggggcttgttttagngcattagnngngggttnnnngnngtgttggtttttgacattngggnttnncagtggntctcattttctgtgattgngtgttctgttttgtgttttttgctgcagaatcacattcatatggnagtnatatttngggcacttttgagacatgttcatctgggatgaaaatctgcatgaaccacttctgcataattcaaaatgagtgttgagtgattctagttctcaaatagatagcaaatcaccacctggtgattcgctttcttcatcacaacatgacggtgactgctgagcttgagacatctttgaggtgcctttctggcttcagtaaaaagatgtgagccataaaaatccaaactactcagtttctacttaaaaaaatacaaaatggtgaaatatactaaatgtattatacagatggtttcagctactatcaaaataaataacataatctgactcagaagtctgactgagcttttggncgaaatctgatggaatgtcaaacgt

SEQ ID NO: 509680 - DNA, 118 bp, Homo sapiens
gatagtggagcggttaaagaaatatagaagctagcctataggaaaacagttcaccccatagccagctgctagtagaccatagctaacagccctaacaagaagttctaccagtagagca

SEQ ID NO: 509681 - DNA, 540 bp, Homo sapiens
ggacggcttggtcccaagaggtattccccacagcgcagcatactggctgtggcagatcatggccagactgcctctttaggctgaccctgacccatccctcctcactgggtggggcctccctgcaggaactccagcaactcaagccagggaattagggagagaactctgatctctctaggtctgagtccctagtgggaggggtggctggctgttgtctccacaaaccggaagacttgttctttccccctgctcactctgaggattccaggcagcccagatgagtgggattttccccggcacagcatacccccttcccaaagggacaatcaaagtgcttcattaagcaagtcctggatcctgtgcccctcaactgggtgaaacaccccagtgggtcaccagacaccttatacaggagcatttctactggcatcaggtgggtgccccttaaggacaaagatccccaaagaaagagtgggggccccatcttttgttgttcttcagcacccctttgtgaacatttttaggggtggggagggggcc

SEQ ID NO: 509682 - DNA, 301 bp, Homo sapiens
  misc_feature (11)..(11): n is a, c, g, or t
  misc_feature (15)..(15): n is a, c, g, or t
  misc_feature (17)..(18): n is a, c, g, or t
  misc_feature (20)..(20): n is a, c, g, or t
  misc_feature (23)..(23): n is a, c, g, or t
  misc_feature (25)..(28): n is a, c, g, or t
  misc_feature (35)..(35): n is a, c, g, or t
ataccacccangatncnnanctntnnnngcggtantattcctgcaccgtcgtatgatgcgatggggggacggatcgcggaaggttgtccgggtgttggatgtcccggtccctgcattggagatggcacttaggcaaatccgggtgcgtgattcaagggtgtggggcgagcgactttaggtcgcgaagcaattggaagtggttccaagaaaagcctctaagcttcagtcatacgagaccgtaccgcaaaccgacacaggtgggcgagatgagtattctaaggcgcaatgagagatttcgagc
